United States Patent 12,397,048 (BUNYAVIRALES VACCINE) - sequence listing, part 13

SEQ ID NO: 14273 - RNA, 4323 nt, synthetic construct
  misc_feature 1..4323: note = derived and/or modified CDS sequence (opt5) from TAHV(4057)__GQ386839.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggaaaccgcgcaggtccgcctgcaaacagataccacgaaccattttgaaatcgccggcaccacagtgaaaagcgggtggttcaagtccaccacatacattacccttgaccagacgtgtgagcacctgaaaggatcttgcggccccaagagcatccagtttcatgcttgtttcaatcagcacatgtcctgcgtgagatttctccaccggacaattctgcctggcagcatcgcctcttccatttgtcaaaacgtcgagatcattatcctgaccgttctcacactgcttatcttcattctgctcagcatcctgtctaaaacctatatttgctacatccttatgcccatttttatccctctggcttatatctacggggtgatttacaataagtcctgtaagaaatgcaagctctgcggactggtgtatcatcccttcaccgaatgtggcacacactgcgtctgtggggcccgctacgagacgagcgatagaatgaaactgcatcgggcgtctggactctgccctggctataagtccctgcgcgccgctagagtgatgtgtaaaagcaaggggccggcctccatcctttctattatcaccgctgttctgattctcacatttgtgacccccatcaacgccatggtcgccggagacacacaggaaaccttcaaactggaggatcttcctgacgacatgctgagcatggctatgaaggtgaatatgtactatatcatgtgcattatcaactacgcggttacgtggtccttcattctctgtgccctgctgatcgctctcctgtttaagaaatatcagcaccggttccttaatttttacgccatgtactgccacgagtgtgatatgtatcatgaccgcagcggcctgaagtacaacggcgatttcacaaataaatgcagacagtgtacctgcgggcaatatgaagacgccgctggactcctgacccaccggaagacatacaactgccttgtgcagtataaatctaagtggctgaccaactttctcattgtctacatcattctgatgctgatcaaggattccgtgctcatcgtccatgccgacggcacagatttcgagaaatgtagcggggaagcggacattacgtggaattgcaccggaccctttctgaaccttggcaattgtgagaagaaacagaagaaagaatcttataacaatatcgctacacaactgaaggggctcgatgccattagcgtgctggacatccctatgatttccaagatccccgaggatatcgccggagctctgcgcttcattgaggaacagagatcttaccacgttcagcttaccgccgagtacgctatgctcacacggtattgcgactactatacccagtttacggacaacagcggctactcccaaaccacatggagagtgtatctgcgcagccatgatttcgaagcctgtatcctgtacccgaatcagcacttttgccggtgtgtcaaacacggcgacaagtgttcttccagcaactgggatttcgcgaatgagatgaaaaactattactctgggaagcagtccaaatttgacaaggatctcaatctggcccttatgagcctgcatcacgctttcagaggaacctcctctttctacattgccaagctcctgaaagaaaagaaaaacggcgacctggtgacatatgctgagaagatcaaagggaagtaccctggaaatgcccttctcaaagcgattatcgattatatcaagtacatgaaggacctgaccgagatgaacaattttaaacatgatgaaatgtgggacgatttcatttttgaggttccccctacgaagtctccctccgtgcgccggctggaatctagctatgacttcaaaacaaacgtcaactccaatcccagccacatctgcaagaacattaaaaccgtggtgtgcctctctcctaagtccggcgttagctacgattctatcattgcctgtggggagccgtcccagcccagcatctatagaaagcctgactctcaagtctttcagagcaatgctgaccagacacacttctgcctgtccgatacccattgccttgaaaactacgagaccgtgggcgaggaaatcattgacgccatcaaaaagagcaaatgttgggagacagaatttacggagtacattcagttcaagcaatctgatggagtgcgctcctgccggatgaaagacagcggcgagtgtaccgtcacaaccaataagtggcccatcattctgtgcgataacgacaagttttattactccgaactccagaaagattatgacaaggatcaggacatcgggcacttctgtctgtctcctagatgcaatacaattcgccatcccatcaaccggaaacacatcagcaattgtacctggcaagtgtcccataacaatattgataagatcgaggttcacgaactggaggaccttgaacagtacaaaaaggctattacgcagaagctccagacatctctgaccctgtttaaatatagcaagaccaaaaacctcccgcacatcaagcctatgtacaaatatattacaatcgagggaaccgagacagccgaaggcatcgagtccgcctacattgaatctgagatccccgctctggcggggacgagcattggattcaagatcacctccaaaagcggcagacatcttctggatgtgattgggtacgtcaagtctgcctcctatagcgctgtgtacacaaagctctataccacaggccctaccatcggagttaatacgaaacacgacgaactgtgcaccggcccctgtcctgtgaacgtcccccatgggacaggatggctgacctttgccaaggagcgcacatcttcctggggctgcgaggagttcgggtgtcttgccatcagcgacggatgcgtgttcggctcttgccaagatattatcaaagacgaaattaccgtttaccggaaggaaacagaggaaaccacggatgtggagctctgtctgacatttgctgacaaaacctattgcaccaatctgaacgccatcacaccgattatcaccgatcagttcgaggtccagtttaagacggtggaagcgtactccctccctagaattatcgctgtgcggaaccacgagatcatggtcgggcagattaatgacatcggcgtttatagcaagggatgtggcaacgtgcaaaaagtgaataacacaaattacgggaacggagtccccaagttcgattacctgtgccatcttgcctcccgcaaagaagtgattgttagaaagtgttttgacaatgattatcaggcctgcaaattcctgcagacccccgctagctaccggctcgaggaggaaggcgggtctgtgacagtcatcgactataagaagattctgggaaccatcaaaatgaaggccatcctgggcgatgtgaaatacaagacatttgcggacaacgttgaccttaccgtggagggggtctgtacgggctgcgtgaattgtttcgaaaacattcactgcgagagcaccatccactccacagttgaagctagctgtcctgtggtcagctcctgcaccgtgtttcatgatcgcattctgatcacaccgaatgagcacaaatatgccattaaggtgatctgcaacgagaagcccggacctaccctccccttcaaaatctgttctgccaagacggacgctgccatgacactggctgatgccaaacctattctcgaactggcgcccgtcgaccagaccacatacatcaaggagaaagatgaaagatgcaagacctggatgtgtcgggttagagacgagggctttcaagtgattttcgaacctttcaagaatctttttgggagctatatcggaattttctacacctttatcatttccctgatggccatcttcatcgtgatttacatcgtcctccccatttgctttaaactgcgcgatacactgagacagcatgaggacgcttataagcgggagatgaaaatccgctga

SEQ ID NO: 14274 - RNA, 4323 nt, synthetic construct
  misc_feature 1..4323: note = derived and/or modified CDS sequence (opt5) from TAHV(4060)__GQ386840.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggagaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctattctgatcctcacatttgtgacccccatcaacgccatggtcgccggggacacacaggaaaccttcaaactggaggatcttcctgacgacatgctgagcatggctatgaaggtgaatatgtactatattatgtgcatgatcaactacgcggttacgtggtccttcattctctgtgccctgctgatcgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatgaagacgccgctgggctccagacccaccggaagacatacaactgcctggtgcagtataaatctaagtggcttaccaactttctgattgtctacatcattctcatgctgatcaaggattccgtgctgatcgtccatgccgacggaacagatttcgagaaatgtagcggcgaagcggacattacgtggaattgcaccgggccctttctcaacctgggaaattgtgagaagaaacaaaagaaagaatcttataacaatatcgctacacagcttaagggcctggatgccattagcgtgctcgacatccctatgatttccaagatccccgaggatatcgccggggctctgcgcttcattgaggaacagagatcttaccacgttcagctgaccgccgagtacgctatgcttacacggtattgcgactactatacccaatttacggacaacagcggatactcccagaccacatggagagtgtatctccgcagccatgatttcgaagcctgtatcctgtacccgaatcagcacttttgccggtgtgtcaaacacggcgacaagtgcagctccagcaactgggatttcgcgaatgagatgaaaaactattactctggcaagcagtccaaatttgacaaggatctgaatctcgccctgatgagccttcatcacgctttcagagggacctcctctttctacattgccaagctgctcaaagaaaagaaaaacgaggacctggtgacatatgctgagaagatcaaaggaaagtaccctggcaatgccctgcttaaagcgattatcgattatatcaagtacatgaaggacctcaccgaaatgaacaattttaaacatgatgagatgtgggacgatttcatttttgaagttccccctacgaagtctccctccgtgcgccggctggagtctagctatgacttcaaaacaaacgtcaactccaatcccagccacatctgtaagaacattaaaaccgtggtgtgcctgtctcctaagtccggggttagctacgattctatcattgcctgtggagaaccgtcccaacccagcatctatagaaagcctgactctcaggtctttcagagcaatgctgaccagacacacttctgcctctccgatacccattgcctggagaactacgagaccgtgggcgaagagatcattgacgccatcaaaaagagcaaatgttgggaaacagagtttacggagtacacccaattcaagcagtctgatggggtgcgctcctgccggatgaaagacagcggcgaatgtacagtcaccacaaatagatggcccattatcctttgcgataacgacaagttttattactccgagctgcagaaggattatgacaaagatcaggacattggacacttctgtctctctcctcgctgcaataccatccggcatcccattaacagaaagcacatcagcaattgtacgtggcaagtgtcccataacaatatcgataaaattgaagttcacgagctggaagacctggagcagtacaagaaagctatcacacagaaacttcaaacctctctcaccctgtttaagtatagcaagacaaagaacctgccgcacattaaacctatgtacaagtatatcaccattgagggcacagaaacggccgaggggatcgaatccgcctacatcgagtctgaaattcccgctctcgcgggaaccagcatcggcttcaaaattacatccaagagcgggaaacatctgcttgatgtgatcggatacgtcaagtctgcctcctatagcgctgtgtacaccaagctgtatacaaccggccctacgattggggttaataccaaacacgacgagctctgcacaggcccctgtcctgtgaacgtcccccatggaaccggctggctgacatttgccaaggagcgcacctcttcctgggggtgcgaagagttcggatgtctggccatcagcgacggctgcgtgttcgggtcttgccaggatatcattaaagacgaaatcacagtttaccggaaggagaccgaagagacgacagatgtggagctttgtctcacctttgctgacaaaacctattgcacaaatctgaacgccattaccccgatcattacggatcagttcgaagtccagtttaagacagtggaggcgtactccctgcctagaatcattgctgtgcggaaccacgaaatcatggtcggacaaatcaatgacattggcgtttatagcaaggggtgtggcaacgtgcagaaagtgaataacaccaattacggaaacggcgtccccaagttcgattacctctgccatctggcctcccgcaaagaggtgatcgttagaaagtgttttgacaatgattatcaggcctgcaaattccttcagacacccgctagctaccggctggaggaagaagggggatctgtgaccgtcattgactataagaagatcctcggcacaattaaaatgaaggccatcctgggggatgtgaaatacaagacctttgcggacaacgttgacctgacggtggaaggagtctgtaccggctgcatcaattgtttcgagaacattcactgcgaacttacaatccacagcaccgtggaggcttcctgtcctgttgtgtctagctgcacagtctttcatgatcgcattctgatcaccccgaatgagcacaaatatgccattaaggtgatctgcaacgaaaagcccgggcctacgctccccttcaaaatctgttccgccaagacagacgctgccatgaccctggctgatgccaaacctattctcgagctggcgcccgtggaccaaacaacctacatcaaggaaaaagatgagagatgcaagacctggatgtgtcgggtcagagacgaaggctttcaggttattttcgagcctttcaagaatctttttggatcttatatcggcattttctacacatttatcattagcctgatcgccatcttcattgtgatctacattgtgctccccatctgctttaaactgcgcgatacgctgagacagcatgaggacgcttataagcgggaaatgaaaattcgctga

SEQ ID NO: 14275 - RNA, 4323 nt, synthetic construct
  misc_feature 1..4323: note = derived and/or modified CDS sequence (opt5) from TAHV(5060)__GQ386841.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggaaaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcattatcaactacgcggtgacgtggtccttcattctctgtgccctgctgatcgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatgaagacgccgctgggctcctgacccaccggaagacatacaactgccttgtccagtataaatctaagtggctgaccaactttctcattgtgtacatcattctgatgctgatcaaggattccgtcctcatcgtgcatgccgacggaacagatttcgagaaatgtagcggcgaagcggacattacgtggaattgcaccgggccctttctgaaccttggaaattgtgagaagaaacagaagaaagaatcttataacaatatcgctacacaactgaagggcctcgatgccattagcgttctggacatccctatgatttccaagatccccgaggatatcgccggggctctgcgcttcattgaggaacagagatcttaccacgtgcagcttaccgccgagtacgctatgctcacacggtattgcgactactatacccagtttacggacaacagcggatactcccaaaccacatggagagtctatctgcgcagccatgatttcgaagcctgtatcctgtacccgaatcagcacttttgccggtgtgtgaaacacggcgacaagtgcagctccagcaactgggatttcgcgaatgagatgaaaaactattactctggcaagcagtccaaatttgacaaggatctcaatctggcccttatgagcctgcatcacgctttcagagggacctcctctttctacattgccaagctcctgaaagaaaagaaaaacggagacctggttacatatgctgagaagatcaaaggcaagtaccctgggaatgcccttctcaaagcgattatcgattatatcaagtacatgaaggacctgaccgagatgaacaattttaaacatgatgaaatgtgggacgatttcatttttgaggtgagccccacgaagtccccttctgtccgccggctggaaagctcctatgacttcaaaacaaacgtgaacagcaatccctctcacatctgtaagaacattaaaaccgtggtttgcctctcccccaagagcggagtctcttacgattccatcattgcctgtggcgagcctagccagccgtctatctatagaaagcccgacagccaagtgtttcagtccaatgctgaccagacacacttctgcctgagcgatacccattgccttgaaaactacgagaccgtgggggaggaaatcattgacgccatcaaaaagtctaaatgttgggagacagaatttacggagtacattcagttcaagcaatccgatggcgtccgcagctgccggatgaaagactccggagagtgtaccgtgacaaccaataagtggcctatcattctgtgcgataacgacaagttttattactctgaactccagaaagattatgacaaggatcaggacatcggccacttctgtctgagccccagatgcaatacaattcgccatcctatcaaccggaaacacatctccaattgtacctggcaggtttctcatagcaacattgataagatcgaggtgcacgaactggaggaccttgaacaatacaaaaaggctattacgcagaagctccagacatccctgaccctgtttaaatattctaagaccaaaaatctcccccacatcaagccgatttacaaatatatcacaatcgaggggaccgagacagccgaaggaattgagagcgcctacatcgaatccgagattcctgctctggcgggcacgagcatcgggttcaagattacctctaaatccggaaagcatcttctggatgtcatcggctacgtgaagtctgcctcttattccgctgtttacacaaaactctataccacagggcccaccatcggcgtgaacacgaagcacgacgaactgtgcaccggaccttgtcccgtcaatgtgcctcatggcacagggtggctgacctttgccaaagagagaacaagctcttggggatgcgaggagttcggctgtcttgccatttccgacgggtgcgttttcggaagctgccaagatatcattaaggacgaaatcaccgtgtaccgcaaagaaacagaggaaaccacggatgtcgagctctgtctgacatttgctgacaagacctattgcaccaacctgaatgccattacacccatcattaccgatcagttcgaggtgcagtttaagacggtggaagcgtactccctcccgcggatcatcgctgtcagaaaccacgagattatggttggccagatcaacgacattggggtgtatagcaaaggctgtggaaatgtgcaaaaggtcaacaatacaaactacggcaatggggtgcctaaattcgattacctgtgccatcttgcctctcggaaggaagttatcgtgcgcaaatgttttgacaacgattatcaggcctgcaagttcctgcagacccccgctagctacagactcgaggaggaaggaggctccgtcacagtgattgactataagaaaatcctggggaccatcaagatgaaagccattctgggagatgttaagtacaaaacatttgcggacaatgtggaccttaccgtcgagggcgtgtgtacggggtgcatcaactgtttcgaaaatattcactgcgagctgaccatccactctacagttgaagctagctgtcccgtggtctcctcttgcaccgtgtttcatgatcggattctcatcacacctaacgagcacaagtatgccatcaaggtgatttgcaatgagaaaccgggccccaccctgcctttcaagatctgtagcgccaaaacggacgctgccatgacactcgctgatgccaagcccattctggaacttgcgcctgtcgaccagaccacatacatcaaagagaaggatgaaagatgcaagacctggatgtgtcgcgttcgggacgagggatttcaagtgattttcgaacccttcaaaaacctgtttggctcctatatcgggattttctacacctttatcatctctctcatggccattttcatcgtgatttacatcgtcctgcctatttgctttaagctgagagatacacttcgccagcatgaggacgcttataaaagagagatgaagatccggtga

SEQ ID NO: 14276 - RNA, 4323 nt, synthetic construct
  misc_feature 1..4323: note = derived and/or modified CDS sequence (opt5) from TAHV(76)__GQ386824.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggaaaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatggggacgccgctggactcctgacccaccggaagacatacaactgccttgtccagtataaatctaagtggctgaccaactttctcatcgtgtacattatcctgatgctgattaaggattccgtcctcatcgtgcatgccgacggcacagatttcgaaaaatgtagcggggaggcggacatcacgtggaattgcaccggaccctttctgaaccttggcaattgtgaaaagaaacagaagaaagagtcttataacaatattgctacacaactgaaggggctcgatgccatcagcgttctggacattcctatgatctccaagattcccgaagatatcgccggagctctgcgcttcatcgaggagcagagatcttaccacgtgcagcttaccgccgaatacgctatgctcacacggtattgcgactactatacccagtttacggacaacagcggctactcccaaaccacatggagagtctatctgcgcagccatgatttcgaggcctgtattctgtacccgaatcagcacttttgccggtgtgtgaaacacggcgacaagtgcagctccagcaactgggatttcgcgaatgaaatgaaaaactattactctgggaagcagtccaaatttgacaaggatctcaatctggcccttatgagcctgcatcacgctttcagaggaacctcctctttctacatcgccaagctcctgaaagagaagaaaaacgaagacctggttacatatgctgagaagattaaaggcaagtaccctgggaatgcccttctcaaagcgatcattgattatatcaagtacatgaaggacctgaccgagatgaacaattttaaacatgatgaaatgtgggacgatttcatctttgaggtgccccctacgaagtctccctccgtccgccggctggaatctagctatgacttcaaaacaaacgtgaactccaatcccagccacatttgtaagaacatcaaaaccgtggtttgcctctctcctaagtccggagtcagctacgattctattatcgcctgtggcgagccgtcccagcccagcatttatagaaagcctgactctcaagtgtttcagagcaatgctgaccagacacacttctgcctgtccgatacccattgccttgaaaactacgaggccgtgggggaggaaatcatcgacgctattaaaaagagcaaatgttgggagaccgaatttacagagtacatccagttcaagcaatctgatggcgtccgctcctgccggatgaaagacagcggagagtgtacggtgaccacaaatagatggcccattatcctgtgcgataacgacaagttttattactccgaactccagaaggattatgacaaagatcaggacattggccacttctgtctgtctcctcgctgcaataccatccggcatcccattaacagaaagcacatcagcaattgtacatggcaggtttcccataacaatatcgataaaattgaggtgcacgaactggaggaccttgaacaatacaagaaagccatcacccagaagctccagacgtctctgacactgtttaagtatagcaaaaccaagaacctcccgcacattaaacctatgtacaagtatatcaccattgaggggacagagaccgccgaaggaatcgagtccgcttacatcgaatctgagattcccgcgctggccggcacaagcatcgggttcaaaattacgtccaagagcggaaaacatcttctggatgtcatctcttacgtgaagtccgctagctattctgccgtttacaccaagctctatacaaccggccctacaattggggtgaataccaaacacgacgaactgtgcacgggcccctgtcctgtcaacgtgccccatggaaccggctggatcacatttgccaaggagcgcacctccagctgggggtgcgaggagttcggatgtctggctatctctgacggctgcgttttcgggtcctgccaagatattatcaaagacgaaattacagtgtaccggaaggaaaccgaggaaacaaccgatgtcgagctttgtctcacgtttgccgacaaaacatattgcaccaatctgaacgcgatcaccccgattatcacagatcagttcgaggtgcagtttaagaccgtggaggcttacagcctgcctagaattatcgccgtccggaaccacgaaatcatggttggacagattaatgacatcggcgtgtattccaaggggtgtggcaacgtgcaaaaagtcaataacacgaattacggaaacggcgtgcccaagttcgattacctctgccatctggccagccgcaaagaagttattgtgagaaagtgttttgacaatgattatcaggcttgcaaattccttcagacacccgcctcttaccggctggaggaggaagggggaagcgtcaccgtgatcgactataagaagattctcggcacaatcaaaatgaaggcgatcctgggggatgttaaatacaagacctttgctgacaacgtggacctgacagtcgagggagtgtgtaccggctgcattaattgtttcgaaaacatccactgcgagcttacgattcactccaccgttgaagcctcttgtcctgtggtcagctcctgcacagtgtttcatgatagaatcctgattaccccgaatgagcacaaatatgccatcaaggtgatctgcaacgagaagcccgggcctacactccccttcaaaatttgttctgctaagaccgacgccgctatgacgctggccgatgcgaaacctatcctcgaactggcccccgtcgaccagacaacctacattaaggagaaagatgaacgctgcaagacatggatgtgtcgggttagagacgagggctttcaagtgatcttcgaacctttcaagaatctttttggaagctatattggcatcttctacacctttattatctccctgatggctatcttcattgtgatctacattgtcctccccatctgctttaaactgcgcgataccctgagacagcatgaggacgcctataagcgggagatgaaaattcgctga

SEQ ID NO: 14277 - RNA, 4323 nt, synthetic construct
  misc_feature 1..4323: note = derived and/or modified CDS sequence (opt5) from TAHV(83)__GQ386825.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggaaaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatgaagacgccgctgggctcctgacccaccggaagacatacaactgccttgtccagtataaatctaagtggctgaccaactttctcatcgtgtacattatcctgatgctgattaaggattccgtcctcatcgtgcatgccgacggaacagatttcgagaaatgtagcggcgaagcggacatcacgtggaattgcaccgggccctttctgaaccttggaaattgtgagaagaaacagaagaaagaatcttataacaatattgctacacaactgaagggcctcgatgccatcagcgttctggacattcctatgatctccaagattcccgaggatatcgccggggctctgcgcttcatcgaggaacagagatcttaccacgtgcagcttaccgccgagtacgctatgctcacacggtattgcgactactatacccagtttacggacaacagcggatactcccaaaccacatggagagtctatctgcgcagccatgatttcgaagtgtgtattctgtacccgaatcagcacttttgccggtgtgttaaacacggcgacaagtgcagctccagcaactgggatttcgccaatgagatgaaaaactattactctggcaagcagtccaaatttgacaaggatctcaatctggcgcttatgagcctgcatcacgccttcagagggacctcctctttctacatcgctaagctcctgaaagaaaagaaaaacgaggacctggtgacatatgccgagaagattaaaggaaagtaccctggcaatgcccttctcaaagctatcattgattatatcaagtacatgaaggggctgaccgaaatgaacaattttaaacatgacgaggtctgggatgacttcatctttgaagtgccccctacgaagtctccctccgtgcgccggctggagtctagctatgatttcaaaacaaacgttaactccaatcccagccacatttgtaagaacatcaaaaccgtcgtgtgcctctctcctaagtccggagtgagctacgactctattatcgcgtgtggcgaaccgtcccagcccagcatttatagaaagcctgattctcaagtctttcagagcaatgccgaccagacacacttctgcctgtccgacacccattgccttgagaactacgagaccgtgggggaagagatcatcgatgctattaaaaagagcaaatgttgggaaacagagtttacggagtacatccagttcaagcaatctgacggcgttcgctcctgccggatgaaagatagcggagaatgtaccgtgacaaccaatagatggcccattatcctgtgcgacaacgataagttttattactccgagctccagaaggactatgataaagaccaggatattggccacttctgtctgtctcctcgctgcaatacaatccggcatcccattaacagaaagcacatcagcaattgtacctggcaggtctcccataacaatatcgacaaaattgaagtgcacgagctggaagatcttgagcaatacaagaaagccatcacgcagaagctccagacatctctgaccctgtttaagtatagcaaaaccaagaacctcccgcacattaaacctatgtacaagtatatcacaattgaggggaccgaaacagctgagggaatcgaatccgcctacatcgagtctgaaattcccgccctggctggcacgagcatcgggttcaaaattacctccaagagcggaaaacatcttctggacgttatcggctacgtgaagtctgcgtcctatagcgccgtctacacaaagctctataccacagggcctaccattggcgtgaatacgaaacacgatgagctgtgcaccggaccctgtcctgttaacgtgccccatggcacagggtggctgacctttgctaaggagcgcacatcttcctggggatgcgaagagttcggctgtcttgccatcagcgacgggtgcgtcttcggatcttgccaagacatcattaaagatgaaatcaccgtgtaccggaaggagacagaagagaccacggacgtggagctctgtctgacatttgccgataaaacctattgcaccaatctgaacgctattacaccgatcattaccgaccagttcgaagtccagtttaagacggttgaggcctactccctccctagaatcattgcggtgcggaaccacgaaatcatggtgggccagatcaatgatattggggtctatagcaagggctgtggaaacgtgcaaaaagttaataacacaaattacggcaacggggtgcccaagttcgactacctgtgccatcttgcttcccgcaaagaggtcatcgtgagaaagtgttttgataatgactatcaggcctgcaaattcctgcagacccccgccagctaccggctcgaggaagagggaggctctgttacagtgattgattataagaagatcctggggaccattaaaatgaaggctatcctgggagacgtcaaatacaagacatttgccgataacgtggaccttaccgttgaaggcgtgtgtacggggtgcatcaattgtttcgagaacattcactgcgaactgaccatccacagcacagtcgaggcgtcctgtcctgtggtgtctagctgcaccgtctttcatgaccgcattctcatcacaccgaatgagcacaaatatgctattaaggttatctgcaacgaaaagcccggccctaccctgcccttcaaaatctgttccgccaagacggatgccgctatgacactcgccgacgctaaacctattctggagcttgcccccgtggatcagaccacatacatcaaggaaaaagacgagagatgcaagacctggatgtgtcgggtgagagatgaaggatttcaagtcattttcgagcctttcaagaatctgtttggctcttatatcgggattttctacacctttatcattagcctcatggcgatcttcatcgtgatttacatcgttctgcccatttgctttaaactgcgcgacacacttagacagcatgaggatgcctataagcgggaaatgaaaatccgctga

SEQ ID NO: 14278 - RNA, 4323 nt, synthetic construct
  misc_feature 1..4323: note = derived and/or modified CDS sequence (opt5) from TAHV(89)__GQ386826.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggaaaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatgaagacgccgctgggctcctgacccaccggaagacatacaactgccttgtccagtataaatctaagtggctgaccaactttctcatcggatacattatcctgatgctgattaaggattccgtgctcatcgtccatgccgacggcacagatttcgagaaatgtagcggggaagcggacatcacgtggaattgcaccggaccctttctgaaccttggcaattgtgagaagaaacagaagaaagaatcttataacaatattgctacacaactgaaggggctcgatgccatcagcgtgctggacattcctatgatctccaagattcccgaggatatcgccggagctctgcgcttcatcgaggaacagagatcttaccacgttcagcttaccgccgagtacgctatgctcacacggtattgcgactactatacccagtttacggacaacagcggctactcccaaaccacatggagagtgtatctgcgcagccatgatttcgaagcctgtattctgtacccgaatcagcacttttgccggtgtgtcaaacacggcgacaagtgcagctccagcaactgggatttcgcgaatgagatgaaaaactattactctgggaagcagtccaaatttgacaaggatctcaatctggcccttatgagcctgcatcacgctttcagaggaacctcctctttctacatcgccaagctcctgaaagaaaagaaaaacgaggacctggtgacatatgctgagaagattaaaggcaagtaccctgggaatgcccttctcaaagcgatcattgattatatcaagtacatgaagggactgaccgaaatgaacaattttaaacatgacgagatgtgggatgacttcatctttggcgttccccctacgaagtctccctccgtgcgccggctggaatctagctatgatttcaaaacaaacgtcaactccaatcccagccacatttgtaagaacatcaaaaccgtggtgtgcctctctcctaagtccggggttagctacgactctattatcgcctgtggcgagccgtcccagcccagcatttatagaaagcctgattctcaagtctttcagagcaatgctgaccagacacacttctgcctgtccgacacccattgccttgaaaactacgagaccgtgggagaggaaatcatcgatgccattaaaaagagcaaatgttgggagacagaatttacggagtacatccagttcaagcaatctgacggcgtgcgctcctgccggatgaaagatagcggggagtgtaccgtcacaaccaatagatggcccattatcctgtgcgacaacgataagttttattactccgaactccagaaggactatgataaagaccaggatattggacacttctgtctgtctcctcgctgcaatacaatccggcatcccattaacagaaagcacatcagcaattgtacctggcaagtgaaccataataacatcgacaaaattgaggttcacgaactggaggatcttgaacagtacaagaaagctatcacgcagaagctccagacatccctgaccctgtttaagtattctaaaaccaagaatctcccgcacattaaacctatgtacaagtatatcacaattgagggcaccgagacagccgaagggatcgagagcgcctacatcgaatccgagattcccgctctggcgggaacgtctatcggcttcaaaattaccagcaagtccgggaaacatcttctggacgtgatcggctacgtcaagagcgcctcttattccgctgtgtacacaaagctctataccacaggacctaccattggcgttaacacgaaacacgatgaactgtgcaccgggccctgtcctgtgaatgtcccccatagcacaggatggctgacctttgccaaggagcgcacatcttcctggggctgcgaggagttcgggtgtcttgccatcagcgacggatgcgtgttcggctcttgccaagacatcattaaagatgaaatcaccgtttaccggaaggaaacagaggaaaccacggacgtggagctctgtctgacatttgctgataaaacctattgcaccaacctgaacgccgtcacaccgattatcaccgaccagttcgaggtgcagtttaagacggtggaagcgtactccctccctagaattatcgctgtccggaatcacgagattatggttgggcagatcaacgatatcggcgtgtatagcaagggatgtggcaatgtgcaaaaagtcaacaatacaaactacgggaatggagtgcccaagttcgactacctgtgccatcttgcctcccgcaaagaagttattgtgagaaagtgttttgataacgactatcaggcctgcaaattcctgcagacccccgctagctaccggctcgaggaggaaggcgggtctgtcacagtgatcgattataagaagattctgggaaccatcaaaatgaaggccattctgggcgacgttaaatacaagacatttgcggataatgctgaccttaccgtggagggggtctgtacgggctgcatcaactgtttcgaaaatatccactgcgagctgaccattcacagcacagtggaagcctcctgtcctgttgtgtctagctgcaccgtctttcatgacagaatcctcattacaccgaacgagcacaaatatgccatcaaggtgatttgcaatgagaagcccggacctaccctgcccttcaaaatctgttccgctaagacggatgccgctatgacactcgccgacgcgaaacctatcctggaacttgcccccgtggatcagaccacatacattaaggagaaaggcgaacgctgcaagacctggatgtgtcgggtcagagacgaggggtttcaagttatcttcgaacctttcaagaacctgtttggatcttatattggcatcttctacacctttattatcagcctcatggctattttcatcgtgatctacattgtgctgcccatctgctttaaactgcgcgatacacttagacagcatgaggacgcctataagcgggagatgaaaattcgctga

SEQ ID NO: 14279 - RNA, 4323 nt, synthetic construct
  misc_feature 1..4323: note = derived and/or modified CDS sequence (opt5) from TAHV(90)__GQ386827.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtggctggaggccatatcaacgtcattgaggtgggggatgacctgacactccacaccgaagcctatgtttgtaatgcggattgcacaatcggagtggacaaggagaccgcccaggtccgcctgcaaacagataccacgaaccattttgaaatcgctggcaccacagtgaaatctgggtggttcaagagcaccacatacattacccttgaccagacgtgtgagcacctgaaagtgtcctgcggacccaagtctatccagtttcatgcctgtttcaatcagcacatgagctgcgtcagatttctccaccggacaattctgcctggctccatcgctagctctatttgtcaaaacgttgagatcattatcctgaccgtgctcacactgcttatcttcattctgctctccatcctgagcaaaacctatatttgctacatccttatgcccatttttatccctctggcctatatctacggcgtgatttacaataagtcttgtaagaaatgcaagctctgcgggctggtctatcatcccttcaccgaatgtggaacacactgcgtgtgtggcgcgcgctacgagacgtccgatagaatgaaactgcatcgggccagcgggctctgccctggatataagtctctgcgcgctgccagagttatgtgtaaatccaagggcccggctagcatcctttccattatcaccgccgtgctgattctcacatttgtcacccccatcaacgccatggtggctggggacacacaggaaaccttcaaactggaggatcttcctgacgacatgctgtctatggcgatgaaggttaatatgtactatatcatgtgcatgattaactacgccgtgacgtggagcttcatcctctgtgctctgctgattgccctcctgtttaagaaatatcagcaccggttccttaatttttacgccatgtactgccacgagtgtgatatgtatcatgaccgctccggactgaagtacaacggcgatttcacaaataaatgcagacagtgtacctgcggccaatatgaagacgctgccgggctcctgacccaccggaagacatacaactgccttgtccagtataaaagcaagtggctgaccaactttctcatcggatacattatcctgatgctgattaaggattctgtgctcatcgtccatgcggacggcacagatttcgagaaatgttccggggaagctgacatcacgtggaattgcaccggaccctttctgaaccttggcaattgtgagaagaaacagaagaaagaaagctataacaatattgccacacaactgaaggggctcgatgccatctctgtgctggacattcctatgatcagcaagattcccgaggatatcgctggagccctgcgcttcatcgaggaacagagatcctaccacgttcagcttaccgctgagtacgccatgctcacacggtattgcgactactatacccagtttacggacaactctggctacagccaaaccacatggagagtgtatctgcgctcccatgatttcgaagcgtgtattctgtacccgaatcagcacttttgccggtgtgtcaaacacggcgacaagtgctctagctccaactgggatttcgccaatgagatgaaaaactattacagcgggaagcagtctaaatttgacaaggatctcaatctggctcttatgtccctgcatcacgccttcagaggaaccagctccttctacatcgctaagctcctgaaagaaaagaaaaacgaggacctggtgacatatgccgagaagattaaaggcaagtaccctgggaatgcgcttctcaaagccatcattgattatatcaagtacatgaagggactgaccgaaatgaacaattttaaacatgacgagatgtgggatgacttcatctttgaagttccccctacgaagtctcccagcgtgcgccggctggagtcctcttatgatttcaaaacagacgtcaacagcaacccctcccacatttgtaagaatatcaaaaccgtggtgtgcctcagccctaagtctggcgtttcctacgatagcattatcgcttgtggggaaccgtctcagccctccatttatagaaagcctgacagccaagtctttcagtctaacgccgaccagacacacttctgcctgagcgatacccattgccttgagaattacgagaccgtgggcgaagagatcatcgacgctattaaaaagtccaaatgttgggaaacagagtttacggagtacatccagttcaagcaaagcgatggagtgcgctcttgccggatgaaagactccggcgaatgtaccgtcacaaccaacagatggcccattatcctgtgcgataataacaagttttattacagcgagctccagaaggactatgataaagaccaggatattgggcacttctgtctgtcccctcgctgcaatacaatccggcatcccattaacagaaagcacatctctaattgtacctggcaagtgaaccataataacatcgacaaaattgaagttcacgagctggaagatcttgagcagtacaagaaagccatcacgcagaagctccagacaagcctgaccctgtttaagtattccaaaaccaagaatctcccgcacattaaacctatgtacaagtatatcacaattgagggaaccgaaacagccgagggcatcgaatctgcttacatcgagagcgaaattcccgcgctggccgggacgtccatcggattcaaaattacctctaagagcggcaaacatcttctggacgtgatcgggtacgtcaagtccgctagctattctgccgtgtacacaaagctctataccacaggccctaccattggagttaacacgaaacacgatgagctgtgcaccggcccctgtcctgtgaatgtcccccatgggacaggatggctgacctttgccaaggagcgcacatccagctggggctgcgaagagttcgggtgtcttgctatctctgacggatgcgtgttcggctcctgccaagacatcattaaagatgaaatcaccgtttaccggaaggagacagaagagaccacggacgtggagctctgtctgacatttgccgataaaacctattgcaccaacctgaacgcggtcacaccgattatcaccgaccagttcgaagtgcagtttaagacggtggaggcttacagcctccctagaattatcgccgtccggaatcacgaaattatggttgggcagatcaacgatatcggcgtgtattctaagggatgtggcaatgtgcaaaaagtcaacaatacaaactacgggaatggagtgcccaagttcgactacctgtgccatcttgcctcccgcaaagaggttattgtgagaaagtgttttgataacgactatcaggcttgcaaattcctgcagacccccgccagctaccggctcgaggaagagggcgggtccgtcacagtgatcgattataagaagattctgggaaccatcaaaatgaaggcgattctgggcgacgttaaatacaagacatttgctgataatgtggaccttaccgtcgaaggggtgtgtacgggctgcatcaactgtttcgagaatatccactgcgaactgaccattcacagcacagttgaggcctcttgtcctgtggtcagctcctgcaccgcctttcatgacagaatcctcattacaccgaacgagcacaaatatgctatcaaggtgatttgcaatgaaaagcccggacctaccctgcccttcaaaatctgttctgccaagacggatgctgccatgacactcgcggacgccaaacctatcctggagcttgctcccgtggatcagaccacatacattaaggaaaaagacgagcgctgcaagacctggatgtgtcgggtcagagatgaaggctttcaagttatcttcgagcctttcaagaacctgtttgggagctatattggaatcttctacacctttattatctccctcatggccattttcatcgtgatctacattgtgctgcccatctgctttaaactgcgcgacacacttagacagcatgaggatgcttataagcgggaaatgaaaattcgctga

SEQ ID NO: 14280 - RNA, 4323 nt, synthetic construct
  misc_feature 1..4323: note = derived and/or modified CDS sequence (opt5) from TAHV(94)__GQ386828.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggaaaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatgaagacgccgctgccctcctgacccaccggaagacatacaactgccttgtccagtataaatctaagtggctgaccaactttctcatcgtgtacattatcctgatgctgattaaggattccgtcctcatcgtgcatgcggacgggacagatttcgagaaatgtagcggagaagctgacatcacgtggaattgcaccggcccctttctgaaccttgggaattgtgagaagaaacagaagaaagaatcttataacaatattgccacacaactgaagggactcgatgccatcagcgttctggacattcctatgatctccaagattcccgaggatatcgctggcgccctgcgcttcatcgaggaacagagatcttaccacgtgcagcttaccgctgagtacgccatgctcacacggtattgcgactactatacccagtttacggacaacagcgggtactcccaaaccacatggagagtctatctgcgcagccatgatttcgaagtgtgtattctgtacccgaatcagcacttttgccggtgtgttaaacacggagacaagtgcagctccagcaactgggatttcgcgaatgagatgaaaaactattactctggcaagcagtccaaatttgacaaggatctcaatctggcccttatgagcctgcatcacgctttcagaggcacctcctctttctacatcgccaagctcctgaaagaaaagaaaaacgaggacctggtgacatatgctgagaagattaaagggaagtaccctggaaatgcccttctcaaagcgatcattgattatgtcaagtacatgaaggacctgaccgaaatgaacaattttaaacatgatgagatgtgggacgatttcatctttgaagtgccccctacgaagtctccctccgtgcgccggctggagtctagctatgacttcaaaacaaacgttaactccaatcccagccacatctgtaagaacattaaaaccgtcgtgtgcctctctcctaagtccggcgtgagctacgattctatcattgcctgtggggaaccgtcccagcccagcatctatagaaagcctgactctcaagtctttcagagcaatgctgaccagacacacttctgcctgtccgatacccattgccttgagaactacgagaccgtgggagaagagattatcgacgccatcaaaaagagcaaatgttgggaaacagagtttacggagtacattcagttcaagcaatctgatggcgttcgctcctgccggatgaaagacagcggggaatgtaccgtgacaaccaatagatggcccatcattctgtgcgataacgacaagttttattactccgagctccagaaggattatgacaaagatcaggacatcggccacttctgtctgtctcctcgctgcaatacaattcggcatcccatcaacagaaagcacattagcaattgtacctggcaggtctcccataacaatatcgataaaatcgaagtgcacgagctggaagaccttgagcaatacaagaaagctattacgcagaagctccagacatctctgaccctgtttaagtatagcaaaaccaagaacctcccgcacatcaaacctatgtacaagtatattacaatcgagggaaccgaaacagccgagggcattgaatccgcctacatcgagtctgaaatccccgctctggcggggacgagcattggattcaaaatcacctccaagagcggcaaacatcttctggatgttattgggtacgtgaagtctgcctcctatagcgctgtctacacaaagctctataccacaggacctaccatcggcgtgaatacgaaacacgacgagctgtgcaccgggccctgtcctgttaacgtgccccatggcacaggatggctgacctttgccaaggagcgcacatcttcctggggctgcgaagagttcgggtgtcttgccattagcgacggatgcgtcttcggctcttgccaagatatcatcaaagacgaaattaccgtgtaccggaaggagacagaagagaccacggatgtggagctctgtctgacatttgctgacaaaacctattgcaccaatctgaacgccatcacaccgattatcaccgatcagttcgaagtccagtttaagacggttgaggcgtactccctccctagaattatcgctgtgcggaaccacgaaattatggtggggcagatcaatgacatcggagtctatagcaagggctgtgggaacgtgcaaaaagttaataacacaaattacggcaacggagtgcccaagttcgattacctgtgccatcttgcctcccgcaaagaggtcattgtgagaaagtgttttgacaatgattatcaggcctgcaaattcctgcagacccccgctagctaccggctcgaggaagagggcgggtctgttacagtgatcgactataagaagattctgggaaccatcaaaatgaaggccattctgggcgatgtcaaatacaagacatttgcggacaacgtggaccttaccgttgaaggggtgtgtacgggatgcgtcaattgtttcgagaacatccactgcgaaagcaccatccactccacagtggaggcttcttgtcctgtgattagctcctgcaccgtctttcatgatagaatcctgattacaccgaatgagcacaaatatgccatcaaggttatttgcaacgaaaagcccggccctaccctccccttcaaaatctgttctgccaagacggacgctgccatgacactggctgatgccaaacctatcctcgagctggcgcccgtggaccagaccacatacattaaggaaaaagatgagcgctgcaagacctggatgtgtcgggtgagagacgaagggtttcaagtcatcttcgagcctttcaagaatctttttggcagctatattggaatcttctacacctttattatctccctgatggccattttcatcgtgatctacattgttctccccatctgctttaaactgcgcgatacactgagacagcatgaggacgcttataagcgggaaatgaaaattcgctga

SEQ ID NO: 14281 - RNA, 4323 nt, synthetic construct
  misc_feature 1..4323: note = derived and/or modified CDS sequence (opt5) from TAHV(XJ0625)__EU622819.2__GP
  source 1..4323: mol_type = other RNA
atgatgttcgtgctgtttttcatcgccctcagcaccgcttcccccgtctaccagagatgctttcaagacggcgccattgttaagcagaacccttctaaacaggcggtgacagaggtgtgtctgaaggatgacgtcagcatgatcaaaacggaagctcggtatttcaagaatgccaccgggacatacgccaacaatgtggctattcgcaaatggcttgtttccgattggcacgactgcagaccgaagaaggtggccggaggccatatcaacgtcattgaggtgggggatgacctgaccctccacacagaggcttatgtttgtaatgccgattgcaccatcggagtggacaaagaaacagcgcaggtccggctgcaaaccgatacgaccaaccattttgaaatcgccggcacaaccgtgaagtctgggtggttcaaaagcacaacctacattacgcttgaccagacatgtgagcacctgaaggtgtcctgcggacccaaatctgtccagtttcatgcttgtttcaatcagcacatgagctgcgttcgctttctccacagaaccatcctgcctggctccattgccagctctatctgtcaaaacgtggagattatcattctgacagtgctcaccctgcttatcttcatcctgctctccattctgagcaagacctatatctgctaccttctgatgcccatttttatccctctcgcttatgtctacggcgtgatttacaataagtcttgtaaaaagtgcaaactgtgcgggctggtttatcatcccttcacagaatgtggaacgcactgcgtgtgtggcgcccggtacgagacctccgatcgcatgaagctccatagagcgagcgggctgtgccctggatataaatctcttcgggccgctcgcgtcatgtgtaagtccaaaggcccggccagcatcctgtccgtgatcacagctgttctcattctgacctttgtgacacccatcaacgccatggtcgccggggacacccaggaaacgttcaaacttgaggatctgcctgacgacatgctctctatggctatgaagattcagatgtactatatcatgtgcattgtgaattacatcgtcacatggagcttcatcgtgtgtgcgctgattatcgccctgatttttaaaaagtatcagcacagattcctcaacttttacgctatgtactgccacgagtgtgatatgtatcatgaccggtccggactgaaatacaatggcgatttcaccaacaagtgccgccaatgtacctgcggccagtatgaagacgccgccgggcttctgacacacagaaaaacctacaattgcctcgttcagtataagagcaagtggctggtgaactttcttatcatttacatcctgctcatgctggtcaaagattctgtgctgattgttcaagctgagggaacagacttcgaaaagtgttccggcgagatcaacatcacgtggaattgcaccgggccctttctcaacctgggaaattgtgaaaagaagcagaaaaaggagccttatagcaacattgccacacagcttaagggcctggatgcgatctctattctcgacatccccatgattagccggatcccggaggatatcgctggggccctgcgcttcattgaggaacaaaattcctaccatgtgcagctgaccgccgaatacgctatgcttacaagatattgcgactactatacccagttttctgataacagcggatactcccagaaaacgtggcgggtctatctcagaagccacgacttcgaggcctgtatcctgtaccctaatcagcatttttgccgctgtgtgaagcacggcgacaaatgttcttccagcaactgggatttcgcttctgaaatgaagaattattacaccggcaaacaactgaagtttaacaaggacctcaatctggcccttatgtccttccaccatgcgttccgggggacaagctccttttacgtggccaaactgctcagagagaagaacaatgaggaactggttaactataccgagaaaattaaggataaataccccggaaatgctctgcttaaggccatcattgactatatcaaatacatgaagaacctctctgaaatgacaaacttcaagcacgatgagatgtgggacgattttgtcttcaatagccctcccaccaaatccccctctgtgcgccggagcgactccgcttatgattttaagaacaatatcaacagcaatccttctcatatttgccagaacatcaaaacggtgatttgcctgtcccccaagagcggcgtctcttacgactccatcattgcctgtggggaacccagccagcctacaatctataaaaagcccgagtctagagtgttccagagcaatgcggatcaaacccacttttgcctggccgacacacactgcctcgagaactacgaaaccgttggagaggaaatcctggatgctattaagaaatccaagtgttgggagaccgacttcacagagtacatccagtttaaacagagcgacggcgtgcgctcttgccggatgaaggattccggggaatgtacggtcaccacacatagatggcctattatcctttgcgacaataacaaattctattacagcgagctgcagaaggattatgacaaggatcaagacattggccacttttgtctctccccgcgctgcaataccatccggcatccgattaaccagaaacacatctctaattgtacatggcaagtgagccataacaatatcgaaaagattgaggttcacgaactggagaacctggagcagtacaaaaaggccatcacccagaaacttcagacgtccctcacactgttcaagtattctaagaccaaaaacctgcctcacattaagcccatgtacaaatatatcaccattgaaggaacagagaccgctgaaggcatcgagagcgcctacatcgaatccgagattcctgccctcgctgggacatctatcggatttaagattacgagcaaatccggcaagcatctgcttgatgtgatcgggtacgtcaaaagcgcgtcttattccgccgtgtacaccaagctgtatacaaccggacccacaattggcgttaataccaagcacgacgagctctgcacggggccttgtcccgtgaacgtcccgcatggcaccggatggctgacattcgctaaagaaagaaccagctcttggggctgcgaggagttcgggtgtctggccatctccgatggatgcgtgtttggcagctgccaggacatcattaaggaagaacttgccgtgtaccgcaaagagacagaggaaaccacagatgtcgagctctgtctgaccttcgctgacaagacgtattgcacaaatctgaacgccatcacccctattatcaccgatcaatttgaagttcagttcaaaacagtggagtcttactccctcccccggattatcgcggtgagaaatcacgagattatggtcgggcagatcaacgacatcggagtgtatagcaagggctgtgggaatgttcagaaggtgaacaataccaactacggcaatggagtccccaaatttgactacctgtgccatcttgcttcccggaaggaagtgattgttcgcaaatgtttcgataacgactatcaagcctgcaagtttctgcagacgcctgccagctacagactcgaggaagagggcgggtctgtgacagtcatcgattataaaaagattctgggaaccatcaagatgaaagctattctgggcgacgtgaagtacaaaacattcgccgataatgttgaccttaccgtggaaggggtctgtacaggatgcatcaactgttttgagaatatccactgcgagctgaccattcacagcacggtggaagcgtcctgtccggtgacctctagctgcacagtcttccatgatcggatcctcattacccccaacgagcacaagtatgctatcaaagttatttgcgccgaaaagcctggcccctccctgcagtttaagatctgtaacgccaaaacagacgctgccatgaccctcgctgatgccaagcctatcctggagcttgcgcccgtggaccagacgacatacattaaagaaaaggatgtgagatgcaaaacctggatgtgtcgcgtccgggacgaggggctgcaagtgatcttcgagcctttcaagaatctctttggctcttatattggaatcttctacacatttctgattaccctgatcgccgttttcgtggtcatttacatcgtgcttcccatctgctttaagctgagagacaccctccgccagcatgaagatgcttataaaagagagatgaagattcggtga

SEQ ID NO: 14282 - RNA, 4323 nt, synthetic construct
  misc_feature 1..4323: note = derived and/or modified CDS sequence (opt5) from TAHV(XJ0708)__HM243138.1__GP
  source 1..4323: mol_type = other RNA
atgatcctggtgctcgtcttcgttgccctgagcgctgcctcccccgtgtaccagagatgctttcaagacggcgcgattgtgaagcagtctcctagcaaacaggctgtcaccgaggtgtgtcttaaggatgacgtttccatgatcaaaacagaagcccggtatttcaagaacgccacggggacctacgctaataacgtggccattcgcaaatggctggtctctgattggcacgactgcagaccgaagaagatcagcggaggccatattaatgtgatcgaggttggggatgacctcacactgcacaccgaagcgtatgtgtgtaacgccgattgcatcattggagtcgacaaagagacagctcaggtgcggcttcaaaccgatacaaccaatcattttgaaatcgccggcacgaccgtgaagtccgggtggttcaaatctacaacctacattacactggaccagacctgtgagcacctcaaggtcagctgcggacccaaatccatccagtttcatgcttgtttcaaccagcacatgagctgcgttcgctttctgcacagaacgattctgcctggctctatcgcctccagcatttgtcaaaatgtggagatcatcattctcacagtgctgacccttctgatcttcattctcctgtctatcctttccaagacatatatttgctacatcctgatgcccatctttattcctctcgcttatgtctacggcgtgatctacaacaagagctgtaaaaagtgcaaactgtgcgggctggtttatcatcccttcaccgaatgtggaacccactgcgtgtgtggcgcccggtacgagacatctgatcgcatgaagctccatagagcgtccgggctgtgccctggatataaaagccttcgggccgctcgcgtcatgtgtaagtccaaaggcccggcctctattctgagcatcattacggctgtgctcatcctgacctttgttacacccatcaatgccatgattgccggggaaacccaggagacattcaaacttgaggacctgcctgatgacatgctctccatggctatgaagctgaacatgtactatctgatgtgcatcgtgaattacattgtcacctggagctttatcatttgtgcgctcatcattgccctgatcttcaaaaagtatcagcacagattccttaacttttacgctatgtactgccacgaatgtgacatgtatcatgatcggtctggactgaaatacaatggcgacttcacgaacaagtgccgccagtgtacatgcggccaatatgaggatgccgccgggctcctgacccacagaaaaacctacaattgccttgtgcagtataagtccaagtggctggtcaactttctcatcgtgtacattctgctgatgctcgttaaagacagcatcctgattgtgcaggctgaaggaacagatttcgacaagtgttctggcgaggccgggatcatttggaactgcaccggaccctttcttaatctgggcaactgtgaaaagaagcagaaaaaggagagctataataacatcgcgacacaactcaaggggctgaatgctatctccgtcctggatattcctatgatctctcggattcccgaggacatcgccggagcccttcgcttcattgaagatcagaacagctaccatgtgcagctcacggctgagtacgccatgctgaccagatattgcgactactatacacaattttccgataatagcggctactctcagaccacatggcgggtttatctgagatcccacaacttcgaggcttgtatcctctacagcaatcagcatttttgccgctgtgtgaaacacggcgacaagtgttcttccagcaactgggacttcgccaatgagatgaaaaactattactccgggaagcagtctaaatttaataaggatctgaaccttgcgctgatgagcctccaccatgccttccggggaacctcctctttttacatcgctaagctgctgagagaaaagaagaatgaggagcttattaactatgtcgaagagatcaaaaagaaatacccgggcaacgccctcctgaaggctgtgattgactatatcaaatacatgaagaatctgacggaaatggccagcttcaagcacgatgagatgtgggacgagttcgtgtatgaatcccctcccacccgcagcccttctgcgcggagatccgagagcgaatacgattttaaaacaaacgttaattctaagcccacccatgtctgcaaaaacattaagacagtggtgtgcctctcccccaaaagcggggtctcttatgacagcatcatcgcctgtggagagcctggccaaccgtccgtgtaccgcaagcccgaacagcaggttttccagagcaatgctgatcaaacccacttttgcctgcttgacacgcactgcctggagaactacacaaccgtgaatgatgagattctcgacgccatcaagaaatctcggtgttgggaaacagagttcaccgaatatattcagtttaagcagggggatggcgtcagatcctgccgcatgaaagacagcggagagtgtgctgtggccgccaaccggtggcctatcattctgtgcgataataacaagttctactattccgaactgcagaaagactacgacaaggatcaagacatcggccatttttgtctttctcccagatgcaataccattcgccaccctatcaaccagaagcatatcagcaattgtacatggcaggtttcccacaacaatattgagaaaatcgaggtgcatgaactcgagaacctggaacaatataagaaagctattacgcagaagctgcagacctctctcacactgttcaaatacagcaagaccaagaaccttccccacatcaaaccgatgtataagtacattacaatcgaggggaccgaaacggcggagggaatcgagtccgcctacattgaatctgagatccctgctctggccggcacaagcattgggtttaaaatcacctccaagagcggaaaacacctcctggatgtcattggctatgtgaagtctgcctcctacagctctgtttatacccggctgtacacaaccgggcccacaatcggcatcaatacgagacatgacgaactttgcaccggaccttgtcccgtgaacgtccctcacaatacaggctggctcaccttcgctaaagagcggacatccagctgggggtgcgaagagtttggatgtctggccatttctgatggctgcgtgttcgggtcctgccaggacatcattaaggaggaactgaccgtgtatcgcaaggagacggaagagaccacagatgtcgagctctgtctgacctttgcggacaaaacatactgcaccaaccttaatgctatcacacccattatcaccgatcaattcgaagttcagttcaagacggtggaggcctatagcctgccgagaattatcgccgtgcggaaccatgaaatcctcgtcggacagattaatgacctgggcgtgtactccaaagggtgtggcaacgttcagaaggtgaataaaacaaactacggaaatggcgtccctaagtttgattatctgtgccaccttgctagcagaaaggaggtgatcgttcgcaaatgtttcgacaacgattaccaagcctgcaagtttctgcagacccccgcgtcttatcggctcgaagaggaagggggaaccgtgacagtcattgactacaaaaagatcctgggcaccattaaaatgaaggctatcctcggggacgtgaagtataaaacgttcgccgataatgttgacctgacaatcgaaggagtgtgtaccggctgcattaactgttttgagaatatccattgcgaacttacaattcacagcaccgtcgaggcctcctgtcccatcatttctagctgcacagtgttccacgatagaatcctgatcacccctaacgaacataagtacgctattaaagtgatctgcaacgagaagccggggtcctctctcagctttcgcgtctgtaatacgaaaaccgacgccgctatgacactgaccgatgccaagcccattctggagcttgcgcctgttgaccagacagcctatatcaaggaaaaagatgagagatgcaagacctggatgtgtcgggtgcgcgacgaaggcctccaggtgattttcgagccctttaaaaacctgttcggatcctacatcggcatcttttacacgttcattctgtctctcatcgctattttcatcattatctatattgtcctgcctatctgctttaaacttagagatacactgcggcaacacgaagacgcctacaaacgcgagatgaagatcagatga

SEQ ID NO: 14283 - RNA, 4323 nt, synthetic construct
  misc_feature 1..4323: note = derived and/or modified CDS sequence (opt5) from TAHV(XJ0710)__HM243141.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttcaagaatgccacggggacctacgctaacaatgtggccattcgcaaatggcttgtttccgattggcacgactgcagaccgaagaaggtggctggaggccatatcaacgtcattgaggtgggggatgacctgacactccacaccgaagcctatgtttgtaatgcggattgcacaatcggagtggacaaagagaccgcccaggtccggctgcaaacagataccacgaaccattttgaaatcgctggcaccacagtgaagtctgggtggttcaaaagcaccacatacattacccttgaccagacgtgtgagcacctgaaggtgtcctgcggacccaaatctgtccagtttcatgcctgtttcaatcagcacatgagctgcgttcgctttctccacagaacaatcctgcctggctccattgctagctctatctgtcaaaacgtggagattatcattctgaccgtgctcacactgcttatcttcatcctgctctccattctgagcaagacctatatctgctaccttctgatgcccatttttatccctctcgcctatgtctacggcgtgatttacaataagtcttgtaaaaagtgcaaactgtgcgggctggtttatcatcccttcaccgaatgtggaacacactgcgtgtgtggcgcgcggtacgagacgtccgatcgcatgaagctccatagagccagcgggctgtgccctggatataaatctcttcgggctgcccgcgtcatgtgtaagtccaaaggcccggctagcatcctgtccatcattaccgccgtgctcatcctgacatttgttacccccattaacgccatggtggctggggacacacaggaaaccttcaaacttgaggatctgcctgacgacatgctctctatggcgatgaagatccagatgtactatattatgtgcatcgtcaattacatcgtgacgtggagcttcattgtctgtgccctgatcattgctctgatctttaaaaagtatcagcacagattcctcaacttttacgccatgtactgccacgagtgtgatatgtatcatgaccggtccggactgaaatacaatggcgatttcacaaacaagtgccgccaatgtacctgcggccagtatgaagacgccgctgggcttctgacccacagaaaaacatacaattgcctcgtgcagtataagagcaagtggctggttaactttcttattatctacattctgctcatgctggtgaaagattctgtcctgatcgtgcaagccgagggaatcgacttcgaaaagtgttccggcgagattaacatcacctggaattgcacagggccctttctcaacctgggaaattgtgaaaagaagcagaaaaaggagccttatagcaacattgcgacgcagcttaagggcctggatgctatctctattctcgacatccccatgatcagccggattccggaggatatcgccggggccctgcgcttcattgaggaacaaaattcctaccatgttcagctgaccgctgaatacgccatgcttacaagatattgcgactactatacccagttttctgataacagcggatactcccagacaacctggcgggtgtatctcagaagccacgacttcgaggcttgtatcctgtaccctaatcagcatttttgccgctgtgtcaaacacggcgacaagtgttcttccagcaactgggatttcgcctctaaaatgaagaattattacacgggcaaacaactgaagtttaacaaggacctcaatctggcgcttatgtccttccaccatgccttccgggggaccagctccttttacgtggctaaactgctcagagaaaagaacaatgatgagctggtgaactatacagagaaaattaagaataaataccccggaaacgccctgcttaaggctatcatcgactatattaaatacatgaagtctctcagcgaaatgaccaacttcaagcacgatgagatgtgggacgattttgttttcaattcccctcccacaaaatctcccagcgtccgccggtccgacagcgcctatgattttaagaacaatatcaactctaatccttcccatatttgcaaaaacatcaagaccgtggtgtgcctgagcccgaaatctggcgtctcctacgacagcattatcgcgtgtggggaaccctctcagcctacgatctataagaagcccgagagcagagtgttccagtccaatgccgatcagacacacttttgcctggctgacacccactgcctcgaaaactacgagacagttggagaggaaattctggatgccatcaaaaagagcaaatgttgggagaccgacttcaccgaatacattcaatttaagcagtctgacggcgtgcgctcctgccggatgaaagatagcggggagtgtacagtcacgaccaatagatggcctatcattctttgcgacaacaataagttctattactccgagctgcagaaggattatgacaaagatcaggacatcggccatttttgtctctctccccgctgcaacacaattcggcacccgatcaatcaaaagcatatcagcaactgtacctggcaagtgtcccacaataacattgaaaagatcgaggttcatgaactggagaacctggaacagtacaagaaagctattacacagaaacttcagacctctctcacgctgttcaagtatagcaaaacaaagaatctgcctcacatcaaacccatgtacaagtatattaccatcgagggaaccgagacagccgaaggcatcgagtccgcctacattgaatctgagatccctgctctcgcggggaccagcattggatttaaaatcacatccaagagcggcaaacatctgcttgatgtgattgggtacgtcaagtctgcctcctatagcgctgtgtacacgaagctgtataccacaggacccaccatcggcgttaacacaaaacacgacgaactctgcaccgggccttgtcccgtgaatgtcccgcacggcacgggatggctgaccttcgccaaggagagaacatcttcctggggctgcgaggagttcgggtgtctggccatcagcgatggatgcgtgtttggctcttgccaggacattatcaaagaagaacttgctgtgtaccgcaaggagaccgaagaggccacagatgtcgagctctgtctgaccttcgcggacaaaacatattgcaccaacctgaatgctattacgcctatcattacagatcagtttgaagttcaattcaagaccgtggagtcctacagcctcccccggatcattgccgtgagaaaccatgaaatcatggtcgggcagatcaatgacattggagtgtattccaagggctgtgggaacgttcagaaagtgaataacaccaattacggcaacggagtccccaagtttgactacctgtgccaccttgccagccggaaagaggtgatcgttcgcaagtgtttcgataatgactatcaggcttgcaaatttctgcaaacccctgcctcttacagactcgaggaagagggcgggagcgtgacagtcattgattataagaagatcctgggaacgattaaaatgaaggcgatcctgggcgacgtgaaatacaagacattcgctgataacgttgaccttaccgtggaaggggtctgtacaggatgcatcaattgttttgagaacattcattgcgaactgaccatccactccacagtggaggcctcttgtccggtgaccagctcctgcacggtcttccacgatcggattctcatcacccccaacgagcataaatatgccattaaggttatctgcgctgaaaagcctggcccctctctgcagtttaaaatctgtaatgccaagacagacgctgccatgaccctcgcggatgccaaacctattctggagcttgctcccgtggaccagacaacctacatcaaggaaaaagatgagagatgcaagacgtggatgtgtcgcgtgcgggacgaagggctgcaggtcattttcgagcctttcaagaacctctttggcagctatatcggaattttctacacatttctgatcaccctgattgccgtgttcatcgttatctacattgtgcttcccatctgctttaaactgagagacacactccgccaacacgaggatgcttataagagagaaatgaaaattcggtga

SEQ ID NO: 14284 - RNA, 4326 nt, synthetic construct
  misc_feature 1..4326: note = derived and/or modified CDS sequence (opt5) from TVTV__AF123491.1__GP
  source 1..4326: mol_type = other RNA
atgatcgtgttcgccctgctcaccattgtcgctgccagccccgtttacaagagatgctttcaggacggcgcgatcgtgcggcaagagtattccaaaaacgctgtgacagaagtctgtctgaaggatgacgtgtctatgattaaaacggaggccgaatacttcaagaatagcaccggggtgttttccaaaaacatcgcctatcgcaagtggcttgtgtctgattggaatgagtgcagacctcaaaagagcgctaacggacacattaatgtcatcgaagtgcagccggacctgtccctccagacaaactcttacgtttgtgccgctacctgcgtgatcagcattgataaagagacagcccaagtccggctgcagaccgacacaaccaatcatttcgagatctccggcacgaccgttaagagcgggtggtttaaatctacaacctatcttacactggatcagacctgtgaacacctcaagatttcctgcggaagcaaatctgtgcagctgcatgcgtgtttcaaccaacacatgtcctgcgtccgctttctgcatagaacgatcctccccggcaagcaccgcaagagcatttgtcagaatatcgagattatcatcctgacatctctttccctgttcatttttctcttcctgaccatcattagcaaaacatacatctgctatgttcttattcctatctttatccccattgcctacgtgtacgggttcatctataacaagtcctgtaaaaagtgcaaactgtgcggactcgtgtaccacccttttaccgaatgtggctctcattgcgtctgtggcgctaagtatgacaccagcgatcggatgaaaatgcacagatccagcgggctgtgccccggatacaagtctctgcgggccgctcgctccatgtgtaagagcaaaggccctgccccgattctctctctgcttagcgcggtgctgatcctcacattcgttacgcccattaccgccatctccctgaaggacgaggagaaagaaacatataaacttcctgagctgcccgatgacaaagtgaatctcgaaaccaagatcgatctgtacttccagatgtgcctgattaactatgctacaacctgggccctcatcttttgtgtcctgattacggcttgccttttcaagaaactgcagcataagtttctcgactactacgccgtgtattgtcacgagtgcgacatgtaccacgaaaagacatctctgaagtataatggggatttcagcaacaaatgtagacaatgtacctgcgagcagtacgaggacgccaccggacttctgacacatcggaagtcctataatcgcctcgttcagtacaaggctaaatggaccctgaactttctgatcacatatgcgattctcgtgatcattaaggatagcgtcatgatcgtgggcgcctctaacacggacgtcaaagattgcctggaccaagaagagatcacctggaattgcacagggcctttccttaacatgggaagatgtacccggccccagaagaaagaaaattacggcaacattgctacacagctgaagggcctcgatgtgctgtccgccctggacatgccggccgttgggaagatccctgaggatattgctggagcccttagctacatcgaatctaaaaagacctatcacgagcagctcacgctggagtttgcgatgctgacccgctactgcgacttctataaacaatacgctgataattccggctatagccagacaacctggagagcctacattcggtcccatgactttggggtgtgtatcatgtatcccaaccagcacttctgcagatgtgtcaagatgggagaaaaatgcacatctagcaattgggactttgccaaccagatggctaattactacaacggcaagcaaaatcgcttcaacaaagatctcaatctggccctttataccatgcatcacgcttttcgggggtccacgtcttacctgatcagcaaggtgctccacgagaagaaatatgaccagctgacaaacctgcttacccagctcaagacaaaataccctggaaatgccctgctgaaggcgctcattggctatcagatctacctgaaatcccttagcgaaatgtcttccttcacccccgatgagctgtgggacgatctccaatatgttcccgcccctaccttcaagccgaacctgggcagaagcggggacaacgaatacaagtttgataaatctcgcattgtggacccccagacaacgtgtacctccctgaagggagtcaattgccttagccctcggtctagagctagcgtgtccgatatcattgcctgtggccaggctacacagcccgccctcttctacgtgcctaacgacaaaatccatcaaagcaataccgatcagaaccagtattgcatcggggactctcactgcctgacaaagtttacccccattacggaggagctgctcgcggccgttaaaaagtccaagtgtcaggctttcgatctggacaatatcgtcaaaacaagcacctccaccggagtgcgctcttgccttgtgaagaaatttggcaactgtaatacaaccaaccaggtctggccgattacaatctgcagcgacgatcagtactattacacggacaccaagcagtcctatgattcttaccaagacattgggcatttctgtctgagccctcggtgctccacaatcagatatcccgtgaatcctaaacacctctctgcctgtacctggacagaagagtacacccccgttgataagatcagcgtgacgaacattgaagagatcgagcagtacaagaaagctctgctgcagaaacttcagaccggcctcaatatttttaagtatcgcaagacatccaacctgcctcacatcaaaagcatgtacaagtatattaccgtccaaggaacaggcaccgccgaaggggtggagaatgcctacatcgaatctgagatgcccgctctggcgggatccagctctggcttcaaagttctctccaaggaagggaaccatctgtttgacgtggtcgcctatattaagagcgcttcttactccagcgtgtataataaactttactccacaggaccgaccctgggcatcaacgttaagcacgatgagaaatgcacggggccttgtcccgccaacatcccccataagacaggctggctcaccttcgcccgggagagaaccagcacatggggacgcgaagagtacggctgcctggctatttctgacgggtgtgtgtttggaagctgccaggatatcattaaacctgaaatgaccgtctatcggaagcagacggacgagatcgtgacagtggaactgtgccttaccttcgtcgataagacatactgtaccgagctgaatgccgttacaccgattatctccgacctctttgaggtgcagttcaaaaccgtggaatcttatagcctgcccaagatcgtcgcgattaaaaaccaccaaatcttcgtgggccagattaatgttatcgggacgaactccaagggatgcggcaatgtgcaggtctttaacgggaccaattacggctctggaacacctagattcgattatctctgtcatctggctagccggcgcgaggtgattatgagaaaatgctttgacaacgactaccaagcctgtaagttccttcagcagccctcctcttttcggctggaagaggaaggcgagaccgttacaatcatcgattataagaaaattctcgggaccatcaagatgaaagccattttcggagacgtgaagtacagaacgtttagcgagaaagtcgatatcaatgctgaaggcgtgtgcgccgggtgtattaactgcttcgagcgcatcaattgtgaatttacaattcactccaccgttgagacaagctgccctctggtggcggactgtcagctgttccacgatcggcttctgatcacccccaacgagcataagtacgctatcaaggccatttgcaaagacaagccttctaataccctcagattttccatctgcaacacaaaagtcgaagccacggtgaccattatcgatgctaagcccattctggagctcgccccggtggaccaaacagcttatatcaaagaaaaggatgagcgctgtaagacctggctgtgcagagtcaaagacgaaggagttgccgtgcttctggagcctttcaagaatctcttcggcagctacatcgggatcttttatggcattattctggtggtcctggcgatccttgtgtgtatttacatcgttctgcccgtgtgcttcaaaatcaaggatacactcaaaaagcacgaggacgcctataaacgggaaatgaagattcgctga

SEQ ID NO: 14285 - RNA, 4335 nt, synthetic construct
  misc_feature 1..4335: note = derived and/or modified CDS sequence (opt5) from TVTV(AR42)__KX891322.1__GP
  source 1..4335: mol_type = other RNA
atgagaaacatgatcgtgttcgccctgctcaccattgtcgctgccagccccgtttacaagcggtgctttcaggacggcgcgatcgtgcgccaagagtattccaaaaatgctgtgacagaagtctgtctgaaggatgacgtgtctatgattaaaacggaggccgaatacttcaagaacagcaccggggtgttttccaaaaatatcgcctatagaaagtggcttgtgtctgattggaacgagtgccggcctcaaaagagcgctaatggacacattaacgtcatcgaagtgcagccggacctgtccctccagacaaattcttacgtttgtgccgctacctgcgtgatcagcattgataaagagacagcccaagtccgcctgcagaccgacacaaccaaccatttcgagatctccggcacgaccgttaagagcgggtggtttaaatctacaacctatcttacactggatcagacctgtgaacacctcaagatttcctgcggaagcaaatctgtgcagctgcatgcgtgtttcaatcaacacatgtcctgcgtcagatttctgcatcggacgatcctccccggcaacattgccaatagcatctgtcagaacattgagatcatcattctgacatctctttccctgttcatctttctcttcctgaccattatcagcaagacatacatttgctatgttcttatccctatctttattcccatcgcttacgtgtacgggttcatttataataagtcctgtaaaaagtgcaaactgtgcggactcgtgtaccacccttttaccgaatgtggctctcactgcgtctgtggcgccaagtatgacaccagcgatcgcatgaaaatgcatagatccagcgggctgtgccccggatacaagtctctgcgggctgcccgctccatgtgtaaaagcaagggccctgcgtctatcctcagcctgctttccgccgtgctgattctcacattcgttacgccgatcaccgctatctctctgaaggacgaggagaaagaaacatataaacttagcgagctgcccgatgacatggtgaacctcgaaaataaaattgatctgtacttccagatgtgcctgatcaactatgccaccacatgggctctcatcttttgtgccctgattaccgcctgccttttcaagaaactgcagcacaagtttctcgactactacgctgtctattgtcatgagtgcgacatgtaccacgaaagacgggggctgaagtataacggagatttctccaataaatgtcgccaatgcacgtgcggccagtacgaggacgcgacagggcttctgacccacagaaagagctataactgtctcgtgcagtacaaagccaagtggatgctgaattttctgattacctatgctatcctcgttattatcaaagattctgtgatgatcgtcggagcctccgacacagatgtgaaggactgcctggatcaagaggaaattacctggaactgtacaggccctttccttaatatgggcagctgcacgcggccccagaagaaagagaactacgggaatatcgccacccagctgaagggactcgacgtcctgtctgctctggatatgcctgccgtgggcaaaattcccgaagacatcgcgggggctctttcctacattgagagcaagaaaacatatcatgaacagctcaccctggagtttgccatgctgacacgctactgtgatttctataagcaatacgccgacaactccggatattctcagaccacgtggagagcttacatccggagccacgactttggcgtttgcatcatgtatccgaatcagcatttctgtagatgcgtgaagatgggggagaaatgtacctcctctaactgggattttgccaatcagatggctaactactacaatggaaagcaaaaccgcttcaataaagacctcaacctggccctttatacaatgcaccatgcgtttcggggcagcacctcctacctgattagcaaggtcctccacgaaaagaagtatgatcagctgacaaacctgcttacccagctcaaaacgaagtaccctggcaatgccctgctgaaggctctcatcgactatcagatttacctgaaatctctttccgagatgagctctttcacacccgatgaactgtgggacgatctccaatatgtgcctgcccccaccttcaagcccaacctggggagatccgaggacaatgaatacaaatttgataagagccgcatcgttgaccctcagacaacctgcacctctctgaaaggagtgaactgtcttagcccgcggtccagagctagcgtctctgatattatcgcctgcggccaggcgacacagcccgccctcttctacgtgcctaatgacaagatccaccaatccaacacggatcagaatcagtattgcattggggacagccattgtctgaccaagtttacacccatcaccgaggagctgctcgctgccgtgaaaaagtccaaatgccaggctttcgacctggatgacattgttaagacatctcctagcaccggagtccgctcctgtcttgtgaaaaagtttggcaactgcaatacgacaaaccaggtgtggcccatcaccatttgttctgatgaccagtactattacaccgatacaaagcagagctatgactccaatcaagatatcgggcacttctgcctgtctccgcggtgtagcaccatcagataccctgtcaaccccaaacatctctccgcctgcacatggacggaagagtatacccctgtggacaagattagcgttacaaatatcgaagagattgagcagtacaaaaaggccctgctgcagaaacttcagaccggcctcaacatctttaagtacaagaaaacatctaatctgccccacattaagcctatgtataaatacatcaccgtgcaaggaacggaaaccgctgagggcgtcgaaaacgcgtatattgagtccgaaatgcccgccctggctgggtctagctccggattcaaggtgctcagcaaagagggcaaccacctgtttgatgttgtggcctacatcaagtctgcctcctatagctccgtctacaataaactttatagcacagggccgaccctgggaatcaacgtgaagcatgacgagaagtgtacaggcccttgccccgctaatattccccacaaaaccgggtggctcacattcgcccgcgaacggacctctacgtggggctgtgaggaatacggatgcctggcgatcagcgatggctgcgtttttgggtcctgtcaggacattatcaagcctgagatgacagtgtacagaaaacagaccgatgaaattgtcaccgtggagctgtgccttacattcgtggacaagacctattgtacggagctgaacgctgtcacaccgatcatctctgacctctttgaagttcagttcaaaaccgtggagagctactccctgcccaagattgtggccatcaagaatcatcaaattttcgtcggacagatcaacgatattggcacatattctaaagggtgcggaaatgtgcaggtttttaacggcaccaattacgggagcggcacacctcgcttcgactatctctgtcacctggcctcccggaaggaagtgatcatgagaaaatgctttgataacgactaccaggcttgtaagttccttcaacagccctctagctttcggctggaggaagagggagagaccgtcacgatcattgattataaaaagatcctcggcaccattaagatgaaagccatcttcggggacgtgaagtacaaaacattttccgaaaaggttgatattaatgcggagggagtgtgcgctggctgtatcaactgcttcgaaagcattaattgtgagtttaccatccattctacagtcgagacctcctgccctctggtggccgactgccagctgttccacgatcgccttctgatcacgcccaacgaacacaaatacgccattaaggctatctgtaaggacaaacctagcaatacactcagattttctatttgcaacaccaaggttgaggccacagtgaccatcattgatgctaaacccatcctggaactcgccccggtcgaccaaaccgcgtatatcaaggagaaagacgaacggtgtaagacatggctgtgcagagtgaaggatgagggggtggccgtccttctggagcctttcaaaaacctcttcggatcctacattggcatcttttatgggattatcctggttgtgctggctattcttgtgtgtatctacatcgtcctgcccgtgtgcttcaagattcgcgacacgctcaaaaagcatgaagatgcctataaacgggagatgaagatcagatga

SEQ ID NO: 14286 - RNA, 4335 nt, synthetic construct
  misc_feature 1..4335: note = derived and/or modified CDS sequence (opt5) from TVTV(Eklund)__KR149248.1__GP
  source 1..4335: mol_type = other RNA
atgagaaacatgatcgtgttcgccctgctcaccattgtcgctgccagccccgtttacaagcggtgctttcaggacggcgcgatcgtgcgccaagagtattccaaaaatgctgtgacagaagtctgtctgaaggatgacgtgtctatgattaaaacggaggccgaatacttcaagaacagcaccggggtgttttccaaaaatatcgcctatagaaagtggcttgtgtctgattggaacgagtgccggcctcaaaagagcgctaatggacacattaacgtcatcgaagtgcagccggacctgtccctccagacaaattcttacgtttgtgccgctacctgcgtgatcagcattgataaagagacagcccaagtccgcctgcagaccgacacaaccaaccatttcgagatctccggcacgaccgttaagagcgggtggtttaaatctacaacctatcttacactggatcagacctgtgaacacctcaagatttcctgcggaagcaaatctgtgcagctgcatgcgtgtttcaatcaacacatgtcctgcgtcagatttctgcatcggacgatcctccccggcaacattgccaatagcatctgtcagaacattgagatcatcattctgacatctctttccctgttcatctttctcttcctgaccattatcagcaagacatacatttgctatgttcttatccctatctttattcccatcgcttacgtgtacgggttcatttataataagtcctgtaaaaagtgcaaactgtgcggactcgtgtaccacccttttaccgaatgtggctctcactgcgtctgtggcgccaagtatgacaccagcgatcgcatgaaaatgcatagatccagcgggctgtgccccggatacaagtctctgcgggctgcccgctccatgtgtaaaagcaagggccctgcgtctatcctcagcctgctttccgccgtgctgattctcacattcgttacgccgatcaccgctatctctctgaaggacgaggagaaagaaacatataaacttagcgagctgcccgatgacatggtgaacctcgaaaccaaaattgatctgtacttccagatgtgcctgatcaattatgccacaacctgggctctcatcttttgtgccctgattacggcctgccttttcaagaaactgcagcacaagtttctcgactactacgctgtctattgtcatgagtgcgacatgtaccacgaaagacgggggctgaagtataacggagatttctccaacaaatgtcgccaatgcacatgcggccagtacgaggacgcgaccgggcttctgacccacagaaagagctataattgtctcgtgcagtacaaagccaagtggatgctgaactttctgattacatatgctatcctcgttattatcaaagattctgtgatgatcgtcggagcctccaataccgacgtgaaggattgcctggaccaagaggaaattacatggaactgtacgggccctttccttaatatgggccggtgcacccgcccccagaagaaagagaactacgggaatatcgccacacagctgaagggactcgatgtcctgagcgctctggacatgcctgccgtgggcaaaattcccgaagatatcgcgggggctctttcttacattgagtccaagaaaacctatcatgaacagctcacactggagtttgccatgctgaccagatactgtgacttctataagcaatacgccgataacagcggatattcccagacgacctggcgggcttacatcagatctcacgactttggcgtttgcatcatgtatccgaatcagcatttctgtcgctgcgtgaagatgggggagaaatgtacaagctccaactgggactttgccaatcagatggctaactactacaatggaaagcaaaaccggttcaataaagatctcaacctggccctttataccatgcaccatgcgtttagaggctctacaagctacctgatttccaaggtcctccacgaaaagaagtatgaccagctgaccaacctgcttacgcagctcaaaacaaagtaccctggcaatgccctgctgaaggctctcatcgattatcagatttacctgaaaagcctttctgagatgtccagcttcacccccgacgaactgtgggatgacctccaatatgtgcctgcccccacattcaagcccaacctggggcgctctgaggataatgaatacaaatttgacaagtcccggatcgttgatcctcagacaacctgcaccagcctgaaaggagtgaactgtctttctccgagaagccgcgcttccgtcagcgacattatcgcctgcggccaggcgacgcagcccgccctcttctacgtgcctaatgataagatccaccaatctaacaccgaccagaatcagtattgcattggggattcccattgtctgacaaagtttacccccatcacagaggagctgctcgctgccgtgaaaaagagcaaatgccaggctttcgacctggacaacattgttaagacctccccttctacgggagtccggagctgtcttgtgaaaaagtttggcaattgcaacacaaccaatcaggtgtggcccatcaccatttgttccgatgaccagtactattacacagataccaagcagtcttatgacagctaccaagatatcgggcacttctgcctgtccccgagatgttctacaatccgctatcctgtcaaccccaaacatctcagcgcctgcacgtggaccgaagagtacacacctgtggacaagatttccgttaccaatatcgaagagattgagcagtacaaaaaggccctgctgcagaaacttcagacaggcctcaacatctttaagtatcggaagaccagcaatctgccccacattaaacctatgtacaagtatatcacggtgcaaggaaccgaaacagctgagggcgtcgaaaacgcgtacattgagtctgaaatgcccgccctggctgggtccagctctggattcaaagtgctctccaaggagggcaaccacctgtttgatgttgtggcctatatcaaaagcgcctcttactccagcgtctataataaactttactccaccgggccgacactgggaatcaacgtgaagcatgacgagaagtgtaccggcccttgccccgctaatattccccacaagacagggtggctcaccttcgccagagaacgcacgagcacatggggctgtgaggaatacggatgcctggcgatctctgatggctgcgtttttgggagctgtcaggacattatcaaacctgagatgaccgtgtatcggaagcagaccgatgaaattgtcacagtggagctgtgccttaccttcgtggacaaaacgtactgtacagagctgaacgctgtcaccccgatcatctccgatctctttgaagttcagttcaagacagtggagtcttatagcctgcccaaaattgtggccatcaagaatcatcaaattttcgtcggacagatcaacgacattggcacctactccaaggggtgcggaaatgtgcaggtttttaacggcacaaattatgggtctggcacccctagattcgactacctctgtcacctggccagccggaaagaagtgatcatgcgcaagtgctttgataacgactatcaggcttgtaaattccttcaacagccctcctcttttagactggaggaagagggagagacggtcaccatcattgattacaagaaaatcctcggcacaattaagatgaaggccatcttcggggacgtgaaatacaagacctttagcgaaaaagttgatattaatgcggagggagtgtgcgctggctgtatcaactgcttcgaatccattaattgtgagtttacaatccatagcaccgtcgagacgtcttgccctctggtggccgactgccagctgttccacgatcggcttctgatcacacccaacgaacacaagtatgccattaaagctatctgtaaggacaagccttccaataccctcagatttagcatttgcaacacaaaagttgaggccaccgtgaccatcattgatgctaagcccatcctggaactcgccccggtcgaccaaacagcgtacatcaaagagaaggatgaacgctgtaaaacgtggctgtgccgggtgaaggacgagggggtggccgtccttctggagcctttcaagaacctcttcggatcttatattggcatcttttacgggattatcctggttgtgctggctattcttgtgtgtatctatatcgtcctgcccgtgtgcttcaaaattaaggacaccctcaaaaagcatgaagatgcctacaaaagagagatgaagatccgctga

SEQ ID NO: 14287 - RNA, 4335 nt, synthetic construct
  misc_feature 1..4335: note = derived and/or modified CDS sequence (opt5) from JCV(3324-04)__HM007357.1__GP
  source 1..4335: mol_type = other RNA
atggaggtgctgaacctcatctggctgcttaccctgtgcctcgccagccccgtcttccagagatgttttcaagacggcgctattgttaagcagaatccttccaaagaagccgtgacagaggtgtgcctgaaggatgacgtctctatgatcaaaacggaagcgaagtacgtgaaaaacaccacagggaccttcgctaataacattgccatgcggaagtggcttgttgccgattggcacgactgtcgcccgcagaaaagctccggaggccatatcaatgtgattgaggtcggggatgacctgtctctccacacagaaagctatatctgctccgctgattgtgtgatcaccgttgacaaagagacagcccagattagactgcaaaccgataacacgaatcattttgaggtggctggaaccacagtcaagtctggctggttcaaaagcaccacatacatcaccctggaccagacgtgcgaacacctcaaggtgtcctgtgggcccaaaagcattcagtttcatgcctgcttcaaccagcacatgtcttgtgtgcggtttctgcaccgcacaatccttcctggatccattgcgaatagcatctgccaaaacattgagatcatcattctggtcaccctctctctggttatcttcatttttcttacaatcgtgtccaagacctatatttgttacctgctcatgcccatcttcatccctattgcctttatctatggctggatttacaataagagctgcaaaaagtgcaaactgtgtggcctggtgtatcatcccttcaccgaatgcgggacacactgtgtctgcggagctagatacgagacgtctgatcggatgaagctccatcgcgcctccggcctgtgtcctgggtacaaaagccttagagctgcccgggtgatgtgcaagtccaaaggaccggcgtctgttctgagcatcatgaccgccgtgctcattctgacatttgtcacccccatctccgctatggtgatcggcgagagctctgaaatttatacacttgaggacctgcctgatgacatggttcagatggccgaacgcatcaacatttactatcagatcattatcattaattacgggatcacctgggctttcctcctgctgggactcctgcttgcctatttctttagaaagtaccagcaccggttcctggacttttatgccatgtactgtgaggaatgcgatatgtaccacgagaaggctggcctcacgcattggggcgacttcacaaacaaatgtcgccaatgcacctgtgggcagtatgaggatatcaccggactgatggtgcacaagaaatcctacaattgccttgtcaagtataaagcgaagtggattagagacatcctgattacatacctcgtgatcattctggtcaaggatagcctgctctttgtgggcgccaccgggacagacttcgctacgtgcatcgatgaaaagaccgttacatggaactgtaccggaccctttctgaaccttggccggtgcgacaagtctcagaaaaagacaaattatgccgatatcgccaaccaactgaaagggctcggagtgattagcgtcctggacatccctatgattaagaagatgcccgatgagatctccggctctctgaaatacattgacaatcttgaaacctatcatgagcagctcacggctgaatacgccttcctgacccgctactgtgactattacacacagtataccgataacagcggctactcccagacagtgtggagaacctatctgcggagccacgactttggggcgtgcgttgtgtacccgaatcaacatttctgtagatgcgtcaagtatggagataaatgtaactctgctaagtgggactttgccaatgagatgaaaacgttctacacaggccagaaggccaagtttaacaaagatctcaatctggcccttctggtgctccacaaggctttccgcgggaccggaacagcttacatcgccgaggcgatggcccggaaagacaacggctccatggctcacttcgccctggaagtgagaaagaaatttcctaccaatgctctgcttgccgcgctcatcgattatattgtttacctgcagagcctggccgagatctctaccttcgaactcgacgaggattgggaagactttaagtataaacccgagcctacagagtccacgattcaggctcgcagccatcgggatgaccaatacaacttcaagaatgccgcttccgggtctaacgtcaaggtgtgcaaaaatatccagaaggtgctgtgtattagccccagatcccgcgccaaatttgaaaacatcatcgcctgcggcgagcacgctaacccctctgtctatatgatgcctaatgtgagcatttaccagtccagctctgaacggtcccattattgtatcgcggatagccactgccttgaggagtacgaagttgtggagaccgaactgctcaacgccctgaagaaatctaagtgctgggtcaaggagatggacgacgtgattctgcacaaacagtccgatggacttagaagctgtcgcatgaaggacacaggcaattgcaacgttcaagaaaatgattggaacatcgtgctctgtgagaatgggaactactattactctgagattcataaagactatgataaggaccaggatgtcggacacttctgcctgagcccgcggtgtaataccatcagataccccatttccaaacgccatatccggagctgcaactggcagatctctcactccacaattgacaagatcgctgtgcaggaactggccgatattgagcaatataagaaagccatcagccagaagctccagacctccctgtctatttttaaatacatcaagacgaaaaatcttcctcatatcaagcccgcttataagtacattacagttgaaggcgtggagaccgtcgaagggatcgagaacgccttcattgagagcgaaatccctgcgctggctggaaccgccattggctttaaaatcaattccagagaggggaactacctcatggacgtgatcggctatgtgaagtctgccagctactccgctacatataccaaactgtacacaacgggacccaccattggcatcaatacacggcacgatgaaaagtgtaccgggccgtgccctgccgtcattgaccacaaagatggatggctgacattctctaaggagcgcaccagcacgtggggctgtgaagagtttgggtgccttgcggtttccgacggatgtgtgttcggcagctgccaagacatcattaaagatgagctcgctgtgtatagaaagaccacagaagaactgaccacagtcgaactgtgcctcaccttttctgacaagacatactgtaccaacctgaacgccatcacgcccattatcacagataaattcgaggtgcagttcaagaccgttgaggcctatacccttcctcggatcattgctgtgaaaaatcatgaaatcaaggtcgggcagattaacgacctgggcgtgtactccaaaggatgcggcaatgttcagaaggtgaacgggacaaattacggaaacggcgcccccagatttgattatctctgtcacctggctagccgcaaggaggtcatcctgcggaaatgcttcgacaatgattaccaagcctgtaagtttcttcagtctccttccagctatagactggaggagcatcaggggaccgtgacggttattgactacaaaaagatcctcggaacaatcaaaatgaaggcgattctgggcgatgtgaagtataaaaacttccagtctaatatcgaaattaacgccgaggggacctgcgctggctgtatcaattgctttgagaacattcactgtgagttcacaatccataccacagtcgaaacctcctgccccatcgtgacggactgtgtgagctttcacgatcgcattctcatcaccccggacgaacacaagtacgccctgaaagtcgtttgccaagacaagcctaaagtgtcccttaagttcaagatttgcaatacaaacatcgatgctagcatgaccattgtggactctaaacccatcctggagctcgcccccgtcgatcagacagcctatattagagaaaaggacgagcggtgtaaaacctggatgtgccgcgtgagagatgagggatttcaggttatcctggaacctttcaagaatctgtttggcagctacatcgggattttctacacgggaatcctttccattatctgtctgctcattgtgatctatatcattctgccgatctgcttcaaactccgggacacactgcgccagcatgaggatgcttacaagaaggaaatgaaaattagatga

SEQ ID NO: 14288 - RNA, 4335 nt, synthetic construct
  misc_feature 1..4335: note = derived and/or modified CDS sequence (opt5) from JCV(61V2235)__U88058.1__GP
  source 1..4335: mol_type = other RNA
atggaggtgctgaacctcatctggctgcttgccctgtgcagcgcttcccccgtcttccagagatgttttcaagacggcgccattgttaagcagaatccttctaaagaagcggtgaccgaggtgtgcctcaaggatgacgtcagcatgatcaaaacagaagctaagtacgtgaaaaacacgaccgggacattcgccaataacattgccatgcggaagtggctggttgctgattggcacgactgtcgcccgcagaagtcctctggaggccatatcaatgtgattgaggtcggggatgaccttagcctgcacaccgaatcctatatctgctctgccgattgtgtgatcacagttgacaaagagaccgctcagattagactccaaacagataacaccaatcattttgaggtggccggaacgaccgtcaagagcggctggttcaaatccacaacctacatcacactggaccagacctgcgaacacctgaaggtgagctgtgggcccaaatctattcagtttcatgcgtgcttcaaccagcacatgtcctgtgtgcggtttctccaccgcacgatcctgcctggaagcattgccaattctatctgccaaaacattgagatcatcattcttgtcacactgtccctcgttatcttcatttttctgagcatcgtgtctaagacctatgtgtgttaccttctgatgcccattttcacacctatcgcttttatctatggctgggtctacaataagtcctgcaaaaagtgcaaactctgtggcctggtgtatcatcccttcaccgaatgcgggacccactgtgtttgcggagccagatacgagaacagcgatcggatgaagctgcatcgcgcttccggcctctgtcctgggtacaaatctctgagagccgcgcgggtgatgtgcaagagcaaaggaccggcctccattcttagcatcatgacagctattctgatcctcacgtttgtcacccccatttctgccatggtgatcggcgagtccagcgaactgtatacacttgacgatctgcctaatgacatggttcagatggctgagcgcgtgaacatctactatcagattaccatcattaattacggggtcacatgggccttcttctgtctcggactgatcctggcctactttttcaagaagtatcagcacaaatttctcgacttctatgctatgtactgcgaagagtgtgatatgtaccacgaaaagtctggcctgacccattggggcgactttacgaacaaatgcagacaatgtacatgcgggcagttcgaggatgtggcgggacttatgattcacaagaaaagctataactgcctggtcaagtacaaggccaaatggatccgggacattctcatcatctatctggctatgattcttatcaaggattccctgctctttgtgggcgcctctgggaccgacttcgccgcttgtattgatgagaaagttgtgacctggaattgcacaggaccctttctgaacctgggccgctgtgacaagagccagaaaaaggcctcctacgcggggatcgctgatcaactcaagggactgggcgtcattagcgtgcttgacatccctatgatcaaaaatatgcccgatgaaatttctggctccctgaagtatatcgacagcctcgagacctaccatgaacagctgacagccgagtatgccttcctgacgagatactgcgactactatacccagtacacagataaatctgggtattcccagaccgtttggcggacataccttcgcagccacgactttggagcttgtgtggtctatccgaaccaacatttctgcagatgtgtgaagtacggcgataaatgcaattccgccaagtgggactttgctaacgaaatgaagaccttctatacggggcagaaagtgaagttcaataaagatctcaacctggccctgctcgttctgcacaaggcgtttcggggaaccggcacagcctacgtcgctgaggccatggctagagaggacaatgggtctatggcccacttcgcgcttgaaattcgcaaaaagtttcctaccaacgccctgctcgctgccctgatcgattacattgtgtatctgcagagccttggcgagatcgctacattcgaactcgacgaggattgggaagactttaaatacaagcccgagcctaccgagtccacgccccaggtgcggtctcatagaaatgatcaatataacttcaagaatgccgaaagcaactccgacacaaaagtctgtaagaatgtgcagaaagttctgtgcatcagcccccgctctaaggccaaatttgagaacattatcgcttgtggagaacacgcgaacccttccgtgtacatgatgccgaatgtcagcatttatcagtctaactccgagcggagccattactgcatcgccggctctcactgcctggagaagtatgaagtggttgagaccgaactcctgaatgctcttaagaaaagcaagtgttgggccaaagagatggatgacattatcctgcacaagcagtccgacgggctcagaagctgccgcatcaaagatacaggaaactgtaatgtgcaagaaaacgactggaccattgtcctgtgcgagaatggcaactactactattctgaggtgcataaggattacgacaaggatcaggacgttgggcacttctgtctgtcccccagatgcaccacaatcagatatcctattagcaaacgccatatcaagaaatgtgaatggcagatttcccactctacgatcgataagattagcgtgcaggagcttgccgacatcgaacaatacaaaaaggctatctcccagaagctccagacctctctgagcatttttaaatatgtccggacaaagaatctgccccatatcaaacctgcctacaagtatattaccgtggagggagtggaaacaatcgagggcattgagaacgcgttcatcgaatccgagatccccgctctcgccgggaccgccattggctttaaaatcaattctagagaaggaaactacctgatggatgtcattggctacgttaagagcgcttcctatagcgccgtgtacacgaaactttatacaaccgggccgaccatcggaattaatacaaagcacgacgagaagtgcaccggcccttgtcccgcgatcatcgatcacaaagacgggtggctgacattctctaaggaacgcacgtccacctggggatgcgaggagtttggctgtctcgctgtgagcgatgggtgcgtcttcggctcttgccaagacattatcaaagacgaactggccgtgtaccggaagacaaccgaggaactgacaaccgttgagctttgtctcacgttctccgataaaacctattgcacaaacctgaatgccattacccctatcattacagacaagtttgaggtgcagttcaagaccgtcgaaagctacacactgcccagagtgatcgctattaaaaaccatgagatcaaggttggacagatcaacgatctcggcgtgtattctaaagggtgtggaaatgtccagaaggtgaacggcaccaattacgggaacggatcccctcggtttgactacctgtgccaccttgccagccgcaaagaagttattctgagaaagtgtttcgataatgactatcaggcttgcaagtttctccaatcccccagctcttaccggctggaggaacatcagggcacggtgacagtcatcgattataaaaagattctggggaccatcaaaatgaaggccattcttggcgacgtgaaatacaagaactatcagaataacatcgagatcagcgcggagggaacctgtgccggctgcattgattgtttcgaaaatatccactgcgagtttacaattcataccacggtggaggcttcctgtccgatcacaaccgaatgcgtctctttccacgaccggattctgatcacacctgatgaacacaagtacgccctcaaaatcgtttgccatgacaagcccaaagtgagcctgaagtttaaaatttgtaacacccacgtggacgctgccatgacaatcgtcgattccaagcccattctcgagctggcccctgtggaccaaaccacgtatatccgcgagaaggatgaacggtgcaaaacctggatgtgtagagttcgcgacgaggggttccaggtgattcttgaaccgtttaagaatctgttcggatcttacatcggcattttctacacagggatcctcagcatcatttgcctgctgatcgtcgtgtatattatccttcccatttgttttaaactgagagataccctccggcagcatgaggacgcttacaagaaagaaatgaagatccgctga

SEQ ID NO: 14289 - RNA, 4335 nt, synthetic construct
  misc_feature 1..4335: note = derived and/or modified CDS sequence (opt5) from JCV(61V2235)__HM007351.1__GP
  source 1..4335: mol_type = other RNA
atggaggtgctgaacctcatctggctgcttgccctgtgcagcgcttcccccgtcttccagagatgttttcaagacggcgccattgttaagcagaatccttctaaagaagcggtgaccgaggtgtgcctcaaggatgacgtcagcatgatcaaaacagaagctaagtacgtgaaaaacacgaccgggacattcgccaataacattgccatgcggaagtggctggttgctgattggcacgactgtcgcccgcagaagtcctctggaggccatatcaatgtgattgaggtcggggatgaccttagcctgcacaccgaatcctatatctgctctgccgattgtgtgatcacagttgacaaagagaccgctcagattagactccaaacagataacaccaatcattttgaggtggccggaacgaccgtcaagagcggctggttcaaatccacaacctacatcacactggaccagacctgcgaacacctgaaggtgagctgtgggcccaaatctattcagtttcatgcgtgcttcaaccagcacatgtcctgtgtgcggtttctccaccgcacgatcctgcctggaagcattgccaattctatctgccaaaacattgagatcatcattcttgtcacactgtccctcgttatcttcatttttctgagcatcgtgtctaagacctatgtgtgttaccttctgatgcccattttcatccctatcgcttttatttatggctgggtctacaataagtcctgcaaaaagtgcaaactctgtggcctggtgtatcatcccttcacagaatgcgggacccactgtgtttgcggagccagatacgagaccagcgatcggatgaagctgcatcgcgcttccggcctctgtcctgggtacaaatctctgagagccgcgcgggtgatgtgcaagagcaaaggaccggcctccatccttagcattatgacagctatcctgattctcacgtttgtcacccccatctctgccatggtgatcggcgagtccagcgaagtttatacactggacgatcttcctaacgacatggtgcagatggctgagcgcgtcaatatttactatcagatcattatcattaactacggggtgacctgggccttcctgctcctgggactgatcctcgcctatttctttaagaagtaccagcacaaattcctggacttttatgctatgtactgtgaagagtgcgatatgtaccacgaaaagtctggccttacacattggggcgacttcaccaataaatgtagacaatgcacgtgtgggcagtttgaggatgtcgcgggactgatgattcacaagaaaagctataactgcctcgtgaagtacaaggccaaatggatccgggacatcctgattatctatcttgctatgattctgatcaaggattccctcctgttcgttggcgcctctgggacagactttgccgcttgcattgatgagaaagtggtcacctggaactgtaccggacccttcctgaatctcggccgctgcgacaagagccagaaaaaggcctcctacgcggggatcgctgatcaactgaagggacttggcgtgatcagcgttctggacattcctatgatcaaaaacatgcccgatgaaatttctggctccctcaagtatatcgacagcctggagacataccatgaacagctgaccgccgagtatgcctttcttacaagatactgtgactactatacgcagtacaccgataattctgggtattcccagacagtgtggcggacctacctccgcagccacgacttcggagcttgcgtcgtgtatccgaaccaacatttttgtagatgcgtgaaatacggcgataagtgtaattccgccaaatgggacttcgctaacgaaatgaagacattttataccgggcagaaggttaaattcaataaggatctgaacctggccctcctggtccttcacaaagcgttccggggaacgggcaccgcctacgtggctgaggccatggctagaaaggacaatgggtctatggcccactttgcgctggagattcgcaaaaagttccctacaaacgccctcctggctgccctgatcgattacatcgtgtatcttcagagcctcggcgaaattgctacctttgagctggacgaagattgggaggacttcaaatacaagcccgaacctacagagtccacgccccaggtccggtctcatagaaatgatcaatataactttaagaatgccgagagcaactccgacaccaaagtgtgcaagaatgttcagaaagtgctgtgtatcagcccccgctctaaggccaaattcgaaaacattatcgcttgcggagagcacgcgaacccttccgtctacatgatgccgaatgtgagcatttatcagtctaactccgaacggagccattactgtatcgccgattctcactgcctcgagaagtatgaggttgtggaaacagagctgcttaatgctctgaagaaaagcaagtgctgggccaaagaaatggacgacatcattctccacaagcagtccgatggcctgagaagctgtcgcatcaaagacaccgggaactgcaatgtccaagagaacgattggacaattgtgctgtgtgaaaatggaaactactactattctgaggttcataaggactacgataaggaccaggatgtgggccacttttgccttagcccccggtgtaccaccatcagatatcctattagcaaacgccatatcaagaaatgcgagtggcagatttcccactctacaatcgacaagatcagcgtccaggaactcgccgatattgagcaatacaaaaaggctatctcccagaagctgcagacgtctctgagcattttcaaatatgtgcggaccaagaatctcccccatatcaaacctgcctacaagtatattacagtggaaggggtcgagaccatcgaaggaatcgagaacgcgtttattgagtccgaaatccccgctctggccggcacagccattgggttcaaaatcaattctagagagggcaactaccttatggacgttattggatacgtgaagtccgcttcctatagcgccgtgtacaccaaactgtatacgacaggcccgaccatcgggatcaataccaagcacgatgaaaagtgtacaggaccttgccccgcgattatcgaccacaaagatggctggctcaccttttctaaggagcgcacatccacgtgggggtgtgaagagttcggatgcctggctgtcagcgacggctgtgtgtttgggtcttgccaagacattatcaaagatgagctggccgtttaccggaagaccacagaagaacttaccacagtggaactctgcctgaccttctccgacaaaacgtattgtaccaacctgaatgccattacacctatcattaccgataagttcgaggtccagtttaagacagtggagagctacaccctccccagagttatcgctatcaaaaaccatgaaattaaggtgggccagatcaacgacctgggagtctattctaaaggctgcgggaatgtgcagaaggttaacggaacaaattacggcaacgggtcccctcggttcgattacctttgtcacctggccagccgcaaagaggtgattctcagaaagtgctttgacaatgattatcaggcttgtaagttcctgcaatcccccagctcttaccggctggaggagcatcagggaaccgtcacggtgatcgactataaaaagattcttggcacaatcaaaatgaaggccatcctgggggatgtgaaatacaagaactatcagaataacattgaaatcaatgcggagggaacctgcgccggctgtattgactgctttgagaacatccactgtgagttcaccattcatacaaccgtcgaagctagctgcccgatcacgacagaatgtgtttcctttcacgatagaatcctcattacccctgacgagcacaagtacgccctgaaaatcgtgtgccatgacaagcccaaagtgtctctcaagttcaaaatttgcaatacaaacgtcgatgctgccatgaccatcgtggacagcaagcccattctggaacttgcccctgttgatcaaacaacctatatccgcgagaaggacgagcggtgtaaaacgtggatgtgcagagtgcgcgatgaaggctttcaggtcattctggagccgttcaagaatctctttgggtcctacatcggaatcttctacaccggcattctgtctatcatttgtctgcttatcgtggtttatattatcctgcccatctgcttcaaactcagagacacactgcggcagcacgaagatgcttacaagaaagagatgaagattcgctga

SEQ ID NO: 14290 - RNA, 4335 nt, synthetic construct
  misc_feature 1..4335: note = derived and/or modified CDS sequence (opt5) from JCV(61V2235)__KX817316.1__GP
  source 1..4335: mol_type = other RNA
atggaggtgctgaacctcatctggctgcttgccctgtgcagcgcttcccccgtcttccagagatgttttcaagacggcgccattgttaagcagaatccttctaaagaagcggtgaccgaggtgtgcctcaaggatgacgtcagcatgatcaaaacagaagctaagtacgtgaaaaacacgaccgggacattcgccaataacattgccatgcggaagtggctggttgctgattggcacgactgtcgcccgcagaagtcctctggaggccatatcaatgtgattgaggtcggggatgaccttagcctgcacaccgaatcctatatctgctctgccgattgtgtgatcacagttgacaaagagaccgctcagattagactccaaacagataacaccaatcattttgaggtggccggaacgaccgtcaagagcggctggttcaaatccacaacctacatcacactggaccagacctgcgaacacctgaaggtgagctgtgggcccaaatctattcagtttcatgcgtgcttcaaccagcacatgtcctgtgtgcggtttctccaccgcacgatcctgcctggaagcattgccaattctatctgccaaaacattgagatcatcattcttgtcacactgtccctcgttatcttcatttttctgagcatcgtgtctaagacctatgtgtgttaccttctgatgcccattttcatccctatcgcttttatttatggctgggtctacaataagtcctgcaaaaagtgcaaactctgtggcctggtgtatcatcccttcacagaatgcgggacccactgtgtttgcggagccagatacgagaccagcgatcggatgaagctgcatcgcgcttccggcctctgtcctgggtacaaatctctgagagccgcgcgggtgatgtgcaagagcaaaggaccggcctccatccttagcattatgacagctatcctgattctcacgtttgtcacccccatctctgccatggtgatcggcgagtccagcgaagtttatacactggacgatcttcctaacgacatggtgcagatggctgagcgcgtcaatatttactatcagatcattatcattaactacggggtgacctgggccttcctgctcctgggactgatcctcgcctatttctttaagaagtaccagcacaaattcctggacttttatgctatgtactgtgaagagtgcgatatgtaccacgaaaagtctggccttacacattggggcgacttcaccaataaatgtagacaatgcacgtgtgggcagtttgaggatgtcgcgggactgatgattcacaagaaaagctataactgcctcgtgaagtacaaggccaaatggatccgggacatcctgattatctatcttgctatgattctgatcaaggattccctcctgttcgttggcgcctctgggacagactttgccgcttgcattgatgagaaagtggtcacctggaactgtaccggacccttcctgaatctcggccgctgcgacaagagccataaaaaggcctcctacgcggggatcgctgatcagctgaagggacttggcgtgatcagcgttctggacattcctatgatcaaaaacatgcccgatgaaatttctggctccctcaagtatatcgacagcctggagacataccacgaacaactgaccgccgagtatgcctttcttacaagatactgtgactactatacgcagtacaccgataattctgggtattcccagacagtgtggcggacctacctccgcagccatgacttcggagcttgcgtcgtgtatccgaaccagcacttttgtagatgcgtgaaatacggcgataagtgtaattccgccaaatgggacttcgctaacgaaatgaagacattttataccgggcaaaaggttaaattcaataaggatctgaacctggccctcctggtccttcacaaagcgttccggggaacgggcaccgcctacgtggctgaggccatggctagaaaggacaatgggtctatggcccattttgcgctggagattcgcaaaaagttccctacaaacgccctcctggctgccctgatcgattacatcgtgtatcttcagagcctcggcgaaattgctacctttgagctggacgaagattgggagggattcaaatacaagcccgaacctacagagtccacgccccaggtccggtctcacagaaatgaccagtataactttaagaatgccgagagcaactccgataccaaagtgtgcaagaatgttcaaaaagtgctgtgtatcagcccccgctctaaggccaaattcaagaacattatcgcttgcggcgaacatgcgaacccttccgtctacatgatgccgaatgtgagcatttatcagtctaactccgagcggagccactactgtatcgccgactctcactgcctcgaaaagtatgaggttgtggagacagaactgcttaatgctctgaaaaagagcaaatgctgggccaaggagatggatgacatcattctccataaacagtccgacgggctgagaagctgtcgcatcaaggataccggaaactgcaatgtccaggaaaacgactggacaattgtgctgtgtgagaatggcaactactactattctgaagttcacaaggattacgacaaagatcaagacgtggggcatttttgccttagcccccggtgtaccaccatcagatatcctatttccaagcgccacatcaaaaagtgcgagtggcagatttcccattctacaatcgataaaatcagcgtccaggagctcgccgacattgaacagtacaagaaggctatctcccaaaaactgcagacgtctctgagcattttcaagtatgtgcggaccaaaaatctcccccacatcaagcctgcctacaaatatattacagtggagggagtcgaaaccatcgagggcatcgaaaacgcgtttattgagtccgagatccccgctctggccgggacagccattggcttcaagatcaattctagagaaggaaactaccttatggatgttattggctacgtgaaaagcgcttcctatagcgccgtgtacaccaagctgtatacgacagggccgaccatcggaatcaataccaagcacgacgagaaatgtacaggcccttgccccgcgattatcgatcataaggacgggtggctcaccttttctaaagaacgcacatccacgtggggatgtgaggagttcggctgcctggctgtcagcgatgggtgtgtgtttggctcttgccaggacattatcaaggacgaactggccgtttaccggaaaaccacagaggaacttaccacagtggagctctgcctgaccttctccgataagacgtattgtaccaacctgaatgccattacacctatcattaccgacaagttcgaagtccaatttaaaacagtggagagctacaccctccccagagttatcgctatcaagaaccacgagattaaagtgggacagatcaacgatctgggcgtctattctaaggggtgcggaaatgtgcagaaagttaacggcacaaattacgggaacggatcccctcggttcgactacctttgtcatctggccagccgcaaggaagtgattctcagaaagtgctttgataatgactatcaggcttgtaaattcctgcaatcccccagctcttaccggctggaggaacaccagggcaccgtcacggtgatcgattataagaaaattcttgggacaatcaagatgaaagccatcctgggcgacgtgaagtacaagaactatcagaataacattgagatcaatgcggaaggaacctgcgccggctgtattgattgctttgagaacatccattgtgagttcaccattcacacaaccgtcgaagctagctgcccgatcacgacagagtgtgtttcctttcacgacagaatcctcattacccctgatgaacataaatacgccctgaagatcgtgtgccacgacaaacccaaggtgtctctcaaattcaagatttgcaatacaaacgtcgacgctgccatgaccatcgtggatagcaagcccattctggagcttgcccctgttgaccagacaacctatatccgcgaaaaagatgagcggtgtaagacgtggatgtgcagagtgcgcgacgaggggtttcaagtcattctggaaccgttcaaaaatctctttggatcctacatcggcatcttctacaccgggattctgtctatcatttgtctgcttatcgtggtttatattatcctgcccatctgcttcaagctcagagatacactgcggcagcatgaggacgcttacaaaaaggaaatgaaaattcgctga

SEQ ID NO: 14291 - RNA, 4335 nt, synthetic construct
  misc_feature 1..4335: note = derived and/or modified CDS sequence (opt5) from JCV(3573-03)__HM007354.1__GP
  source 1..4335: mol_type = other RNA
atggaggtgctgagcctcatctggctgcttaccctgtgctccgcctctcccgtcttccagagatgttttcaagacggcgctattgttaagcagaaccctagcaaagaagccgtgacagaggtgtgcctcaaggatgacgtctccatgatcaaaacggaagcgaagtacgtgaaaaataccacagggaccttcgctaacaatattgccatgcggaagtggctggttgccgattggcacgactgtcgcccgcagaagtctagcggaggccatatcaacgtgattgaggtcggggatgacctttccctgcacacagaatcttatatctgcagcgctgattgtgtgatcaccgttgacaaagagacagcccagattagactccaaaccgataatacgaaccattttgaggtggctggaaccacagtcaagtccggctggttcaaaagcaccacatacatcaccctggaccagacgtgcgaacacctgaaggtgtcttgtgggcccaaatccattcagtttcatgcctgcttcaatcagcacatgagctgtgtgcggtttctccaccgcacaatcctgccttcttccattgcgaacagcatctgccaaaatattgagatcatcattcttgtcaccctgtctctcacaatcttcatttttctgaccatcgtttccaagacctatatttgttaccttctgatgcccgtgttcatccctatcgcctttgtgtatggatggatttacaacaagagctgcaaaaagtgcaaactctgtggcctggtctatcatcccttcacagaatgcggcacgcactgtgtgtgcggggctagatacgagacctccgatcggatgaagctgcatcgcgcctctggactctgtcctggctacaaaagcctgagagctgcccgggttatgtgcaagtccaaagggccggcgagcatcctttctattatgacagccgtgctgatcctcacctttgtcacacccatttccgctatgatgatcggagagagctctgaagtgtataccctggacgatcttcctgacgacatggttcagatggccgagcgcgtgaatatctactatcagattatcattatcaactacggcgtcacgtgggctttcctgctcctggggctggtgctcgcctatttctttaagaagtaccagcacaaattcctggatttttatgccatgtactgtaatgaatgcgacatgtaccacgagaaggctggacttacacattggggcgatttcaccaacagatgtcggcaatgcacctgtggccagtatgaagacgtcacagggctgattgtgcacaaaaagagctacaattgcctcgttaaatataaggcgaagtggatccgcgatattctgatcacctaccttatcattatcctggtgaaagactccctcctgtttgtcggagccacaggcacggatttcgctgcctgcattgacgagaagaccgtgacatggaactgtaccgggccctttctgaacctcggaagatgcgataaatctcagaagaaaacaagctataatgacatcgccaaccaactgaagggccttggggttatttccgtgctggatatccctatgatcaagcggatgcccgacgagattagcggatctctcaaatacatcgacaatctggaaacctatcatgagcagctgacggctgaatacgccttccttacccgctactgtgattattacacacagtataccgacaactccggctacagccagacagtctggagaacctatctccggtctcacgattttggcgcgtgcgtggtgtacccgaatcaacatttctgtagatgcgttaagtatggggacaaatgtaactccgctaagtgggattttgccaatgagatgaaaacgttctacacaggacagaagattaagtttaacaaagacctgaatctggccctcctggtccttcacaaggctttccgcggcaccgggacagcctacatcgctgaagccatggcgcggaaagataacggaagcatggcccacttcgctctggaggtgagaaagaaatttcctaccaatgccctcctggctgccctgattgactatatcgtgtaccttcagtccctcgcggagatctctaccttcgaactggatgaggactgggaagattttaagtataaacccgagcctacagaaagcccctcccaggcccgctctcatcggagcgaccaatacaacttcaagaatgctgagtccaacagcaatgtcaaggtgtgcaaaaacattcagaaggttctgtgtatctctcccagatcccgcgccaaatttgagaacattatcgcttgcggcgaacacgccaatcctagcgtgtatatgatgccgaacgtctctatttaccagtccaatagcgagcggtctcattattgtatcgccgatagccactgcctcgaagactacgagatcgtggagacggaactgctttccgctctgaagaaaagcaagtgctgggcgaaggagatggacgatattgttctccacaaacagtctgacgggctgagatcctgtcgcatgaaggataccggcaactgcgacgtgcaagaaaatgattggacaatcgtcctgtgtgagaacggaaattactattacagcgaaattcataaagactatgataaggaccaggatgtgggccacttctgcctttctccccggtgttccaccatcagataccctattaacaaacgccatatcaagcggtgcaattggcagattagccactccacaatcgacaagatctctgttcaggagctcgccgatattgagcaatataaaaaggctatcagccagaaactgcagacctccctgtctatttttaagtacgtgaaaacgaagaacctcccccatatcaagcctgcctataaatacattacagtcgaagggatcgagaccgtggaaggaatcgagaatgccttcattgaaagcgagatccccgctctggccggcaccgcgattgggtttaagatcaactccagagagggaaattaccttatggacgtgattggctatgtcaaaagcgcttcttactccgccacatataccaagctgtacacaacggggccgaccatcggcatcaacacacggcacgatgaaaaatgtaccggaccttgccccgccgttattgaccacaaggacggctggctcacattcagcaaagagcgcacctctacgtgggggtgtgaagagtttggatgcctggctgtgtccgatggctgtgtgttcgggagctgccaagacatcattaaggatgaactggccgtctatagaaagaccacagaggagcttaccacagtggaactctgcctgaccttttctgacaaaacatactgtaccaatctgaacgcgatcacgcctattatcacagataagttcgaggttcagttcaaaaccgtggaatcctataccctcccccgggtcattgctgtgaagaaccatgagatcaaagttggacagatcaatgacctgggcgtgtacagcaaggggtgcggcaacgtccagaaggtgaatggaacaaactacggcaatgggatgcctaaatttgattatctttgtcacctggcctccagaaaggaggttattctccgcaaatgcttcgacaacgattaccaagcctgtaagtttctgcagagcccctctagctatcggctggaggaacatcagggaaccgtgacgatcattgactacaaaaagatccttggcacaattaagatgaaagctatcctgggggatgtcaagtataaaaattaccagtccaacatcgaaattaatgccgagggaacctgcgctggctgtatcaactgcttcgaaaatattcactgtgagtttacaatccataccacagtggaggcctcttgcccgattgtgaccgactgtgtcagcttccacgacagaatcctcatcacgcctgatgaacacaagtatgcgctgaaagttgtgtgccaagacaagcccaaggtgtccctcaaatttaagatttgcaacaccaatatcgatgcctctatgacaattgtcgacagcaaacccatcctggagcttgctcctgtggatcagaccgcctacattaaggaaaaagacgagcgctgtaagacatggatgtgcagagttcgggatgaagggttccaggtgatcctggagccgtttaagaacctcttcggctcctacattggaatcttttataccggcatcctgtctgtcatttgtctgcttatcgtgatttacatcattctgcccatctgcttcaaactccgcgacacgctgagacagcatgaggatgcttataagaaagaaatgaagatccggtga

SEQ ID NO: 14292 - RNA, 4335 nt, synthetic construct
  misc_feature 1..4335: note = derived and/or modified CDS sequence (opt5) from KEYV(KEYV/Ochlerotatus atlanticus/USA/KEYVLK01/2005)__KT630289.1__GP
  source 1..4335: mol_type = other RNA
atgatgatctggattctgctcaccgtggtcacagttacgatcgccaaccccgtgtaccagagatgcttccaagacggcgctattgtgaagcagaatcctagcaaagaggccgtcaccgaagtgtgtctgaaggatgacgtttccatgatcaaaacagaggcgaagtatgtgaaaaaccttaccgggacattttctaataacgtcgctatgcggaagtggctggtggccgattggcacgactgccgcccgcagaagagagccggaggccatattaatgttatcgaagtgggggatgacctcagcctgcacaccgagtcctacatctgttctgctgattgcgtcattagcgtggacaaagaaacagcccagatccggcttcaaaccgatacgaccaaccatttcgaggtggctggaacaaccgtcaagtccggctggtttaaatctacaacctatattacgctggaccagacatgtgagcacctcaaggttagctgcgggcccaaatccatccagttccatgcctgttttaatcagcacatgagctgcgtgcgcttcctgcacagaaccattctgcctggatctatcgcgaactccatttgtcaaaatatcgaaatcattatcctcgtgacactgacccttctgatttttatcctcctgagcattctttctaagacctacatctgctatatcctgatgcccattttcatccctattgcctacatctatggctgggtctacaacaagtcctgtaaaaagtgcaaactctgcggcctggtgtaccatccctttacagagtgtgggacgcactgcgtttgtggagctcggtatgaaaccagcgatcgcatgaagctgcatagagcctctggcctctgccctgggtacaaatccctgcgggctgcccgcgtgatgtgtaagagcaaaggaccggcgtccattctttctatcctgacagccgtcctcatcctgaccttcattacacccatgaatgctatggtgcttggcagctccgaggaggtttataagctggaagacctccctgatgacatgctgaacatggccgagaagatcgacatttactatctgagcatcgtgctcaattactctaccacgtgggggctgcttattctgctcctgatcgtctcctgcctttttaaaaagtatcagcacgtgttcctgaactactacgctatgtattgtcacgaatgcgatatgtaccatgagaaaaagaatctcgtctataacggagactttagcaacaaatgtagacagtgcacatgtggccagtacgaagatgccaccggcctgattgtgcaccaaaagtcttataattgcctgatcaagtacaaagccaagtggttcatcaacattctcatcatttataccatcctggttcttctgaaagacagcgtgctcatggctgcggccgaggggcccgatttcaatacatgcattgagcagcggtccatctctctgaactgtaccggaccttttatcaatctgggcgggtgcgaaaagccccagaaacgcgctagctaccaatccattgccgagcagcttaaggccatcaacgctattagcatcctcgacatgccgatgatttctaagatccctgatgacatctccggagccctgagacatattgaaaatctgaaaacataccacgagcagctcacggcggagttcgctatgctgacccggtattgtgattactatacacagtttagcgacaactctggctactcccaaaccagctggcgcacatatcttagatcccatgatttcgaggtctgcatcgcctaccccaatcagcacttttgtcggtgcgtgaagaacggggagaaatgtacctctgccaattgggacttcgctaacgaaatgaagaattattacacgggaaaacagattagatttgacaaggatctgaacctcgccctgaccacactgcacaccgctttccgcggcacaagcacctactatatgtccgacatccttgccgagacgaaggccaattctctccgggattacgcgctggctctgaaaagcaagtatcctggcaacgccctcctgaaagctattcttgactttatcatgtacctgcagtccctcaacgaagccacaaagttcaaactgagctctgattgggaggactttaagtataattccgaactggaggcgagagcccttatgccccgcgctcggagctctggggattacaacttctccaatgccgagagcaccaacaaagttaagatctgcaagaatattcaaagagtgatgtgtctctctccccgcagcaaagctacagtcgaagacatcattgcctgcggagagcatgaacacccttccgtgtatatggtgccgaacaccaccatctaccagagcaatattgagcggtctcattactgtatcgccgattcccactgcctggaggaatatgagctggttcagaacgaactcctgacagctcttaagaaaagcacgtgctggaccggcgagctggaaaatgtcattccccacaagcagtccgacgggatcagatcttgtcgcacaaagaacaccggacggtgcaatgtgaagggcgaggattggacagtgatcctctgtgagaacgacaagtactattacagcgaactgaataaagattatgacaaggaccaagatattgggcatgtctgcctgtcccctagatgtaactctatccgctaccccattagccctcggcacatcaccaattgcaaatgggagaaccccgcgggcacgatttccagaatcgaaacacattctcttgccgacatcgagcagtataagaaagctattagccagaagctccagaactccctgaccatctttaagtacgagaaaaccaagaatctgccgcacattaaacctatctacaagtatattacaatcgaaggaaccgagacagtggaaggcgttgagaacgccttcatcgaagccgagattcccgctctcgccgggacgagcatcggattcaaagtcaattctcgggatggcgaccatctgatggatattatcgcgtacattaaggtggcttcctatagctctacctacacaaaactttataccacagggcctaccatcggaattaacacgaaacacgacgaaaagtgtaccggcaattgccccgcccgcctggagcacaaagtggggtggctcacatttgccaaggagagaacctccacatggggctgtgaagagttcggatgcctggctgttagcgatggctgtgtgtttgggtcttgccaagacatcatcaaagaagaactgtccgtctaccggaaggataccgaggaagtgagcaacgttgagctttgcctgacattcgccgacaaaacctattgtacgtccctcaatgcgattacacctatcattaccgaaaagtttgaggtgcagttcaagaccgtcgaaagctactctctgcccagaatcgtgggcattcgcaaccatgagatccggatcggacagattaatgatctcgggagctactccaaaggatgcggcaacgtgcaaagagtcaatgggacaaactatggctctggacagccgaagtttgactacctgtgtcaccttgctagccgcaaagaggttatcgtgagaaagtgcttcgataatgactatcaggcctgtaaatttctgcagaccccttcctcttaccggctcgaggaacatgaaggcacggtgacaattatcgactataagaagattctggggaccatcaaaatgaaggccatcctgggagatgtccgctacaaaaactatgctagcgccattgacatcaatgctgagggcgtgtgcgccgggtgtattaactgcttcgaaaacatccactgtgagtttacaattcataccacaatcgaggcgtcctgccccattgaatctgattgtgttagcttccacgacagaatccttgtgacccccaatgagcacaagtacgccctgaaactcatctgcgaagataagcctggatccacgctgaagtttaaaatttgcaacaccaagatcgacgctgccatgacactcgtcgatgctaaaccgattctggagcttgcccccgtggaccaaaccgcctacatccgggaaaaggatgagcgctgtaaaacatggatgtgcagagttcgggacgagggcattaaggtgctgctcgaacctttcaagaatctgttcgggagctatatcggcatcgtctactctattatcctgattatcattgctgcgatcatcattatctatattatccttcccatttgttttaaactgcgcgataccctcaagaaacatgaggacgcctacagaaaggaaatgaaaatccggtga

SEQ ID NO: 14293 - RNA, 4332 nt, synthetic construct
  misc_feature 1..4332: note = derived and/or modified CDS sequence (opt5) from KEYV(KEYV/Ochlerotatus atlanticus/USA/KEYVLK01/2005)__KT630289.1__GP
  source 1..4332: mol_type = other RNA
atgatctggattctgctcaccgtggtcacagttacgatcgccaaccccgtgtaccagagatgcttccaagacggcgctattgtgaagcagaatcctagcaaagaggccgtcaccgaagtgtgtctgaaggatgacgtttccatgatcaaaacagaggcgaagtatgtgaaaaaccttaccgggacattttctaataacgtcgctatgcggaagtggctggtggccgattggcacgactgccgcccgcagaagagagccggaggccatattaatgttatcgaagtgggggatgacctcagcctgcacaccgagtcctacatctgttctgctgattgcgtcattagcgtggacaaagaaacagcccagatccggcttcaaaccgatacgaccaaccatttcgaggtggctggaacaaccgtcaagtccggctggtttaaatctacaacctatattacgctggaccagacatgtgagcacctcaaggttagctgcgggcccaaatccatccagttccatgcctgttttaatcagcacatgagctgcgtgcgcttcctgcacagaaccattctgcctggatctatcgcgaactccatttgtcaaaatatcgaaatcattatcctcgtgacactgacccttctgatttttatcctcctgagcattctttctaagacctacatctgctatatcctgatgcccattttcatccctattgcctacatctatggctgggtctacaacaagtcctgtaaaaagtgcaaactctgcggcctggtgtaccatccctttacagagtgtgggacgcactgcgtttgtggagctcggtatgaaaccagcgatcgcatgaagctgcatagagcctctggcctctgccctgggtacaaatccctgcgggctgcccgcgtgatgtgtaagagcaaaggaccggcgtccattctttctatcctgacagccgtcctcatcctgaccttcattacacccatgaatgctatggtgcttggcagctccgaggaggtttataagctggaagacctccctgatgacatgctgaacatggccgagaagatcgacatttactatctgagcatcgtgctcaattactctaccacgtgggggctgcttattctgctcctgatcgtctcctgcctttttaaaaagtatcagcacgtgttcctgaactactacgctatgtattgtcacgaatgcgatatgtaccatgagaaaaagaatctcgtctataacggagactttagcaacaaatgtagacagtgcacatgtggccagtacgaagatgccaccggcctgattgtgcaccaaaagtcttataattgcctgatcaagtacaaagccaagtggttcatcaacattctcatcatttataccatcctggttcttctgaaagacagcgtgctcatggctgcggccgaggggcccgatttcaatacatgcattgagcagcggtccatctctctgaactgtaccggaccttttatcaatctgggcgggtgcgaaaagccccagaaacgcgctagctaccaatccattgccgagcagcttaaggccatcaacgctattagcatcctcgacatgccgatgatttctaagatccctgatgacatctccggagccctgagacatattgaaaatctgaaaacataccacgagcagctcacggcggagttcgctatgctgacccggtattgtgattactatacacagtttagcgacaactctggctactcccaaaccagctggcgcacatatcttagatcccatgatttcgaggtctgcatcgcctaccccaatcagcacttttgtcggtgcgtgaagaacggggagaaatgtacctctgccaattgggacttcgctaacgaaatgaagaattattacacgggaaaacagattagatttgacaaggatctgaacctcgccctgaccacactgcacaccgctttccgcggcacaagcacctactatatgtccgacatccttgccgagacgaaggccaattctctccgggattacgcgctggctctgaaaagcaagtatcctggcaacgccctcctgaaagctattcttgactttatcatgtacctgcagtccctcaacgaagccacaaagttcaaactgagctctgattgggaggactttaagtataattccgaactggaggcgagagcccttatgccccgcgctcggagctctggggattacaacttctccaatgccgagagcaccaacaaagttaagatctgcaagaatattcaaagagtgatgtgtctctctccccgcagcaaagctacagtcgaagacatcattgcctgcggagagcatgaacacccttccgtgtatatggtgccgaacaccaccatctaccagagcaatattgagcggtctcattactgtatcgccgattcccactgcctggaggaatatgagctggttcagaacgaactcctgacagctcttaagaaaagcacgtgctggaccggcgagctggaaaatgtcattccccacaagcagtccgacgggatcagatcttgtcgcacaaagaacaccggacggtgcaatgtgaagggcgaggattggacagtgatcctctgtgagaacgacaagtactattacagcgaactgaataaagattatgacaaggaccaagatattgggcatgtctgcctgtcccctagatgtaactctatccgctaccccattagccctcggcacatcaccaattgcaaatgggagaaccccgcgggcacgatttccagaatcgaaacacattctcttgccgacatcgagcagtataagaaagctattagccagaagctccagaactccctgaccatctttaagtacgagaaaaccaagaatctgccgcacattaaacctatctacaagtatattacaatcgaaggaaccgagacagtggaaggcgttgagaacgccttcatcgaagccgagattcccgctctcgccgggacgagcatcggattcaaagtcaattctcgggatggcgaccatctgatggatattatcgcgtacattaaggtggcttcctatagctctacctacacaaaactttataccacagggcctaccatcggaattaacacgaaacacgacgaaaagtgtaccggcaattgccccgcccgcctggagcacaaagtggggtggctcacatttgccaaggagagaacctccacatggggctgtgaagagttcggatgcctggctgttagcgatggctgtgtgtttgggtcttgccaagacatcatcaaagaagaactgtccgtctaccggaaggataccgaggaagtgagcaacgttgagctttgcctgacattcgccgacaaaacctattgtacgtccctcaatgcgattacacctatcattaccgaaaagtttgaggtgcagttcaagaccgtcgaaagctactctctgcccagaatcgtgggcattcgcaaccatgagatccggatcggacagattaatgatctcgggagctactccaaaggatgcggcaacgtgcaaagagtcaatgggacaaactatggctctggacagccgaagtttgactacctgtgtcaccttgctagccgcaaagaggttatcgtgagaaagtgcttcgataatgactatcaggcctgtaaatttctgcagaccccttcctcttaccggctcgaggaacatgaaggcacggtgacaattatcgactataagaagattctggggaccatcaaaatgaaggccatcctgggagatgtccgctacaaaaactatgctagcgccattgacatcaatgctgagggcgtgtgcgccgggtgtattaactgcttcgaaaacatccactgtgagtttacaattcataccacaatcgaggcgtcctgccccattgaatctgattgtgttagcttccacgacagaatccttgtgacccccaatgagcacaagtacgccctgaaactcatctgcgaagataagcctggatccacgctgaagtttaaaatttgcaacaccaagatcgacgctgccatgacactcgtcgatgctaaaccgattctggagcttgcccccgtggaccaaaccgcctacatccgggaaaaggatgagcgctgtaaaacatggatgtgcagagttcgggacgagggcattaaggtgctgctcgaacctttcaagaatctgttcgggagctatatcggcatcgtctactctattatcctgattatcattgctgcgatcatcattatctatattatccttcccatttgttttaaactgcgcgataccctcaagaaacatgaggacgcctacagaaaggaaatgaaaatccggtga

SEQ ID NO: 14294 - RNA, 4332 nt, synthetic construct
  misc_feature 1..4332: note = derived and/or modified CDS sequence (opt5) from KEYV(KEYV/Ochlerotatus atlanticus/USA/KEYVLK02/2005)__KT630292.1__GP
  source 1..4332: mol_type = other RNA
atgatctggattctgctcaccgtggtcacagccacgatcgctaaccccgtttaccagagatgcttccaagacggcgccattgtgaagcagaatcctagcaaagaggcggtgaccgaagtctgtctgaaggatgacgtgtccatgatcaaaacagaggctaagtatgttaaaaaccttaccgggacattttctaataacgtggccatgcggaagtggctggtcgccgattggcacgactgccgcccgcagaagagagctggaggccatattaatgtgatcgaagttggggatgacctcagcctgcacaccgagtcctacatctgttctgccgattgcgtgattagcgtcgacaaagaaacagctcagatccggcttcaaaccgatacgaccaaccatttcgaggtggccggaacaaccgtgaagtccggctggtttaaatctacaacctatattacgctggaccagacatgtgagcacctcaaggtcagctgcgggcccaaatccatccagttccatgcgtgttttaatcagcacatgagctgcgttcgcttcctgcacagaaccattctgcctggatctatcgccaactccatttgtcaaaatatcgaaatcattatcctcgtgacactgacccttctgatttttatcctcctgagcattctttctaagacctacatctgctatatcctgatgcccattttcatccctattgcttacatctatggctgggtgtacaacaagtcctgtaaaaagtgcaaactctgcggcctggtctaccatccctttacagagtgtgggacgcactgcgtgtgtggagcccggtatgaaaccagcgatcgcatgaagctgcatagagcttctggcctctgccctgggtacaaatccctgcgggccgcgcgcgttatgtgtaagagcaaaggaccggcctccattctttctatcctgacagctgtgctcatcctgaccttcattacacccatgaatgccatggtccttggcagctccgaggaggtgtataagctggaagacctccctgatgacatgctgaacatggctgagaagatcgacatttactatctgagcatcgttctcaattactctaccacgtgggggctgcttattctgctcctgatcgtgtcctgcctttttaaaaagtatcagcacgtcttcctgaactactacgccatgtattgtcacgaatgcgatatgtaccatgagaaaaagaatctcgtgtataacggagactttagcaacaaatgtagacagtgcacatgtggccagtacgaagatgccaccggcctgattgtccaccaaaagtcttataattgcctgatcaagtacaaagctaagtggttcatcaacattctcatcatttataccatcctggtgcttctgaaagacagcgttctcatggcggccgctgaggggcccgatttcaatacatgcattgagcagcggtccatctctctgaactgtaccggaccttttatcaatctgggcgggtgcgaaaagccccagaaacgcgccagctaccaatccattgccgagcagcttaaggctatcaacgccattagcatcctcgacatgccgatgatttctaagatccctgatgacatctccggagcgctgagacatattgaaaatctgaaaacataccacgagcagctcacggctgagttcgccatgctgacccggtattgtgattactatacacagtttagcgacaactctggctactcccaaaccagctggcgcacatatcttagatcccatgatttcgaggtgtgcatcgcctaccccaatcagcacttttgtcggtgcgtcaagaacggggagaaatgtacctctgctaattgggacttcgccaacgaaatgaagaattattacacgggaaaacagattagatttgacaaggatctgaacctcgctctgaccacactgcacaccgccttccgcggcacaagcacctactatatgtccgacatccttgcggagacgaaggccaattctctccgggattacgctctggccctgaaaagcaagtatcctggcaacgctctcctgaaagccattcttgactttatcatgtacctgcagtccctcaacgaagcgacaaagttcaaactgagctctgattgggaggactttaagtataattccgaacccgaggccagagctctgatgccccgcgcccggagctctggggattacaacttctccaatgctgagagcaccaacaaagccaaggtgtgcaagaatatccaaagagttatgtgtctttctcctcgcagcaaagccacagtggaagacattatcgcttgcggagagcatgaacacccgtccgtctatatggtgcccaacaccaccgtgtaccagagcaatattgagcggtctcattactgtatcgcggattcccactgcctcgaggaatatgagctggttcagaacgaactgctcacagccctgaagaaaagcacgtgctggaccggcgagcttgaaaatgtcattcctcacaagcagtccgacgggacaagatcttgtcgcaccaaaaacacaggacggtgcaatgtgaagggcgaggattggaccgtgatcctgtgtgagaacgacaagtactattacagcgaactcaataaagattatgacaaggaccaagatattgggcatgtctgcctgtcccccagatgtaactctatccgctaccctatcagcccccggcacattacgaattgcaaatgggagaacccggctggcacaatctccagaattgaaacccattctctggccgacatcgagcagtataagaaagccattagccagaaacttcagaactccctcaccatctttaagtacgaaaagacaaagaatctgcctcacatcaaacccatttacaagtatatcaccattgagggaacagagacggtggaaggcgttgagaacgctttcatcgaagccgagattcctgcgctggctgggaccagcatcggattcaaagtcaattctcgggatggcgaccatctcatggatatcattgcctacatcaaggtggcctcctatagctctacatacaccaagctgtatacaaccgggcccacgattggaatcaacaccaaacacgacgaaaagtgtacaggcaattgccctgctcgccttgagcacaaagtggggtggctgacctttgccaaggagagaacatccacctggggctgtgaagagttcggatgcctcgcggttagcgatggctgtgtgtttgggtcttgccaagacattatcaaagaagaactgtccgtctaccggaaggatacagaggaagtgaccaacgttgagctgtgccttacgttcgctgacaaaacatattgtaccagcctgaatgccattacccccatcatcacagaaaagtttgaggtgcagttcaagaccgtcgaatcctacagcctcccgagaattgtgggaatccgcaaccatgagattcggatcggccagattaatgatctggggtcttacagcaaaggatgcggcaacgtgcaaagagtcaatgacacgaactatgggtccggccagcctaagtttgattacctctgtcacctggcctctcgcaaagaggttatcgtgagaaagtgcttcgacaatgactatcaggcttgtaaatttcttcagacacccagctcctaccggctggaggaacatgaaggaaccgtgacaatcattgattataagaagatcctcggcaccattaaaatgaaggccatcctgggggacgtccgctacaaaaactatgcttctgccattgatatcaatgcggagggagtgtgcgccggctgtatcaactgcttcgaaaacattcactgtgagtttacaatccataccacgattgaggctagctgccccatcgaatccgactgtgtttctttccacgatagaatgctggtgacccctaatgagcacaagtacgcccttaaactgatttgcgaagacaagccggggagcacactcaagtttaaaatctgcaacaccaagattgatgctgccatgacactggtcgacgccaaacccatcctcgagctggctcctgtggatcaaaccgcgtacatccgggaaaaggacgagcgctgtaaaacgtggatgtgcagagttcgggatgagggaattaaggtgcttctggaacccttcaagaatctcttcggctcctatatcgggattgtctacagcatcattctgatcatcattgccgctatcattatcatttatgtgatcctgcctatctgttttaaacttcgcgacacactgaagaaacatgaggacgcctacagaaaggaaatgaaaattcggtga

SEQ ID NO: 14295 - RNA, 4332 nt, synthetic construct
  misc_feature 1..4332: note = derived and/or modified CDS sequence (opt5) from KEYV(C14031-33)__AF123489.1__GP
  source 1..4332: mol_type = other RNA
atgatctggattctgctcaccgtggtcacagttacgatcgccaaccccgtgtaccagagatgcttccaagacggcgctattgtgaagcagaatcctagcaaagaggccgtcaccgaagtgtgtctgaaggatgacgtttccatgatcaaaacagaggcgaagtatgtgaaaaaccttaccgggacattttctaataacgtcgctatgcggaagtggctggtggccgattggcacgactgccgcccgcagaagagagccggaggccatattaatgttatcgaagtgggggatgacctcagcctgcacaccgagtcctacatctgttctgctgattgcgtcattagcgtggacaaagaaacagcccagatccggcttcaaaccgatacgaccaaccatttcgaggtggctggaacaaccgtcaagtccggctggtttaaatctacaacctatattacgctggaccagacatgtgagcgcctcaaggttagctgcgggcccaaatccatccagttccacgcctgttttaatcagcatatgagctgcgtgagattcctgcaccggaccattctgctcggatctatcgcgaactccatttgtcaaaatatcgaaatcattatcctggtgacacttaccctgctcatttttatcctgcttagcattctgtctaagacctacatctgctatatcctcatgcctatttccatccccattgcctacatctatggctgggtctacaacaagagctgtaaaaagtgcaaactgtgcggcctggtgtaccaccctttcacagagtgtgggacgcattgcgtttgtggagctcgctatgaaacctctgatagaatgaagctccaccgggcctccggcctgtgccccgggtacaaaagccttcgcgctgccagagtgatgtgtaagtccaaaggacctgcgtctattctgagcatcctcacagccgtcctgatccttacctttattacaccgatgaatgctatggtgctgggctccagcgaggaggtttataagctcgaagacctgcccgatgacatgctgaacatggccgagaagatcgacatttactatctctctatcgtgctgaattactccaccacgtgggggcttctgattctcctgcttatcgtcagctgcctgttcaaaaagtatcatctcgtgtttctgaactactacgctctgtattgtcacgaatgcgatatgtaccacgagaaaaagaatctcgtctataacggagacttctctaacaaatgtctgcagtgcacatgtggccagtacgaagatgccaccggccttattgtgcatcagaaaagctataattgcctgatcaactacaaggccaaatggtttatcaatattctcatcatttataccatcctggttctgcttaaggactccgtgctcatggctgcggccgagcggcctgatttcaacacatgcattgagcaacgctctatcagcctgaattgtaccgggcccttcatcaacctgggaggctgcaaaaagcctcagaaaagagcttcctaccagagcattgccgaacaactcaaggccatcaatgctatttctatcctggacatgcccatgatttccaagatcccggatgacatcagcggggcccttcggcacattgagaacctgaaaacataccatgaacagctcacggcggagtttgctatgctgacccgctattgtgattactatacacagttctctgacaattccggatacagccagacctcctggagaacatatctgcggtctcacgattttgaagtctgcatcgcctaccctaaccaacatttctgtagatgcgtgaagaatggcgagaaatgtaccagcgccaactgggactttgctaatgagatgaagaactattacacggggaaacagattcgcttcgacaaggatcttaatctcgccctgaccacactgcacaccgcttttcggggaacatccacctactatatgtctgacatcctcgccgaaacgaaggcgaacagcctgagagattacgcccttgctctgaaatccaagtatcccggcaacgccctcctgaaagctattctggacttcatcatgtaccttcagcctctcaatgaggccacaaagtttaaactgagctctgattgggaagacttcaagtataactccgagcccgaagcgcgcgccctgatgccccgggctagaagctctggcgattacaatttttccaacgccgagagcaccaataaagttaaggtgtgcaagaacatccagcgcgtcatgtgtctctctcctcggagcaaagctacagtggaggacattatcgcctgcggggaacacgagcatccgtccgtgtatatggttcccaataccaccatttaccaaagcaacatcgaaagatctcactactgtattgccgattcccattgcctggaggagtatgaacttgtccagaatgagctgctcacagctctgaagaaaagcacgtgctggaccggagaactggagaacgtgatccctcacaagcagtccgacggcattcgctcttgtcggacaaagaataccgggagatgcaacgtgaagggagaagattggacagtcatcctttgtgagaatgacaagtactattacagcgagctcaacaaagattatgacaaggaccaggatatcggccacgtgtgcctgtctccccgctgtaattccattcggtaccctatcagccccagacatattaccaactgcaaatgggaaaacccggcggggacgatctcccggattgagacacactctctggccgacatcgaacaatataagaaagctatcagccagaagctccaaaattccctgaccattttcaagtacgagaaaaccaagaaccttcctcatatcaaacccatttacaagtatatcacaattgaaggcaccgagacagttgagggagtggaaaatgcctttatcgaggccgaaatccctgctctggccggcacgagcattgggttcaaagtcaactctcgcgatggagaccacctcatggatatcattgcgtacatcaaggtggcttcctatagctctacctacacaaagctgtataccacaggccccaccattgggatcaatacgaaacatgacgagaagtgtaccggaaactgccctgccagactggaacacaaagttggctggcttacattcgccaaggagcggacctccacatgggggtgtgaggaatttggctgcctggctgtgagcgatggatgtgtcttcggctcttgccaggacattatcaaagaggaactctccgtgtacagaaaggataccgaggaggttacaaatgtggaactgtgcctcacctttgccgacaaaacgtattgtacaagcctgaacgcgatcacccccattatcaccgagaagttcgaagtccagtttaagacagtggagtcctacagccttccgcgcattgtggggatccggaatcacgaaattagaatcggacagatcaacgatctgggctcttacagcaaagggtgcggaaatgtccagcgcgttaacggcaccaattatgggtccggccaacctaagttcgactacctctgtcatctggcttctagaaaagaggtgattgtgcggaagtgctttgataacgactatcaggcctgtaaattcctgcagacgcccagctcctaccgccttgaggaacacgagggaacagtcaccatcattgactataagaagatcctgggcacaattaaaatgaaggccatcctcggggatgtgagatacaaaaattatgcttctgccatcgacattaacgctgaaggagtttgcgccggctgtatcaactgctttgagaatattcattgtgagttcaccatccacacaaccattgaagcgagctgccccatcgagtccgattgtgtgtcttttcatgaccggatgctggtcacgcctaacgaacacaagtacgccctcaaactgatttgcgaggataagccggggagcgctcttaagttcaaaatctgcaataccaagatcgacgccgctatgacactggtggatgccaaacccattctcgaactggcccctgttgaccagaccgcttacatccgcgagaaggatgaaagatgtaaaacatggatgtgccgggtgcgcgacgagggaattaaggtcctgcttgagccctttaagaacctgttcggctcctatatcgggattgtgtacagcatcatcctcattatcattgcggccatcattatcatctatattatcctgcctatttgtttcaaactcagagataccctgaagaaacacgaagacgcttaccggaaggagatgaaaatccgctga

SEQ ID NO: 14296 - RNA, 4326 nt, synthetic construct
  misc_feature 1..4326: note = derived and/or modified CDS sequence (opt5) from LACV(Human/78)__NC_004109.1__GP
  source 1..4326: mol_type = other RNA
atgatctgcattctggtgctcatcaccgtcgccgctgccagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagagtcatgtgcaaatccaagggcccggcctctatccttagcatcattacggctgtgctggttctcaccttcgtgacacccatcaactccatggtcctgggggaaagcaaagagacctttgagcttgaagatctgcctgacgacatgctcgagatggcctctcggattaattcctattacctgacatgtatcctgaactatgctgtgagctggggactcgtcattatcggcctgcttattggcctcctgttcaagaagtaccaacaccgctttctgaatgtgtatgccatgtactgcgaagagtgtgatatgtaccacgacaaatctgggcttaagagacatggagatttcaccaacaaatgccggcagtgtacgtgcggccagtatgaagacgccgctgggctgatggcgcaccgcaagacatacaattgcctcgttcagtataaagccaagtggatgatgaacttcctgatcatctacatttttctgatcctcattaaggatagcgctatcgtggtccaagccgccggaaccgacttcaccacatgtctggagaccgagtccattaactggaattgcacaggcccctttcttaacctggggaattgtcagaaacagcaaaagaaagaaccttatacgaacatcgctacccagctcaagggactgaaagccatctctgtgctggatgttcccattatcacaggcattccggacgatatcgcgggcgctcttagatacattgaggaaaaggaggacttccatgtgcagctcaccatcgaatatgccatgctgagcaagtactgcgattactatacacagttttccgacaatagcgggtactctcaaaccacgtggcgggtctatctgagatcccacgacttcgaggcctgtatcctctaccctaaccagcatttttgccgctgtgtgaaaaatggagagaagtgctctagctccaactgggatttcgctaatgaaatgaaagactattacagcggcaagcagaccaaatttgataaggacctgaaccttgccctgacagctctccaccacgccttccgggggacctcctctgcgtatattgccacaatgctgagcaagaaatccaatgatgacctgatcgcttacaccaacaagattaaaacgaagtttcccggaaatgcccttctcaaagctatcattgattacatcgcctatatgaagtctctgcctggcatggcgaacttcaaatacgacgagttttgggatgaactgctctataagcccaatcccgccaaggctagcaacctggccagagggaaagagtccagctacaacttcaaacttgctatctcttccaaaagcattaagacatgtaaaaatgtgaaggacgttgcctgcctgtctcctcgctccggcgccatctatgctagcattatcgcgtgtggagaaccgaacggcccctctgtctaccggaagcctagcgggggagtgttccagtccagcaccgatagatctatttattgcctcctggactcccattgcctggaggagtttgaagccatcggccaagaggaacttgatgctgtgaaaaagagcaaatgttgggagattgagtaccccgacgtcaagctcatccaggaaggggacggaacaaaatcctgccgcatgaaggattctggcaattgtaacgtggccaccaatcggtggcctgttatccagtgcgagaacgacaagttctactatagcgaactgcagaaagattacgacaaggcccaagatattgggcactattgtctgtcccccggctgcaccacagtgagatacccgatcaatcctaaacatatttctaactgtaattggcaggtcagccgctcctctatcgctaagattgacgtgcacaacatcgaggatatcgaacagtataaaaaggccattacgcagaagctccaaaccagcctgtccctttttaaatacgcgaagacaaagaatctgccccacatcaagcctatttataaatacatcaccattgagggaacagagaccgctgaaggcatcgagagcgcctacatcgaatctgaggttcccgccctcgctgggacgtccattggattcaagatcaacagcaaagaaggcaagcatctgctggacgtgattgcctatgtcaagtctgcgtcctacagctctgtgtatacaaaactttactccaccgggcctaccagcggaatcaatacaaagcacgatgagctctgcaccggcccctgtccggctaacattaatcatcaggttgggtggctgacatttgcccgggagagaacgtccagctggggctgcgaagagttcggatgtctggccgtgtctgacggctgcgtctttgggagctgccaggatatcattaaagaggaactctccgtgtatcgcaaggaaaccgaggaggtgacagacgtcgaactgtgtcttaccttctctgataaaacatactgcaccaacctgaaccctgttacgcccatcatcaccgacctctttgaggtgcaattcaagacagtggaaacctatagcctgccccggattgtcgctgtgcagaatcacgagatcaagattggacagatcaacgacctgggcgtttactccaaagggtgtggaaatgtgcagaaggtcaacggcacaatttacgggaatggcgtgcctagatttgattatctttgccatctggcctctcggaaagaggttatcgtgcgcaagtgtttcgacaacgattaccaggcttgcaaatttctccaaagcccggcctcctatagactggaagaggactctggaaccgtcacaatcattgattacaagaagatcctcggcaccattaaaatgaaggcgatcctgggggacgtgaaatataagacgttcgccgatagcgttgacattacagctgaaggatcctgtaccggctgcatcaattgtttcgagaacatccactgcgaacttaccctgcacacaaccattgaggccagctgtcccatcaaatcttcctgcacggtgtttcatgatcggattctcgtcacacctaatgagcacaagtacgctctgaagatggtgtgcaccgaaaaacccgggaacacactgaccatcaaggtgtgtaatacaaaagtcgaggccagcatggcccttgttgacgctaagcctattatcgaactggcgcccgtggatcagaccgcctatattagagagaaagacgaacgctgcaagacgtggatgtgtcgggtgagagacgagggactccaggtcatcctggagcctttcaagaacctctttggctcttacatcggcattttctacacctttatcatttccatcgtggttctgcttgtgattatctatgtcctgctccccatctgcttcaaactgcgcgatacactgagaaagcatgaagacgcttacaaacgggagatgaagattcgctga

SEQ ID NO: 14297 - RNA, 4326 nt, synthetic construct
  misc_feature 1..4326: note = derived and/or modified CDS sequence (opt5) from LACV__KP271111.1__GP
  source 1..4326: mol_type = other RNA
atgatccggattctggtgctcatcgccgtcaccgctgccagccccgtttaccagagatgcttccaagacggcgcgattgtgaagcagaacccttccaaagaggctgtgacagaagtctgtctgaaggatgacgtgtctatgatcaaaacggaggcccgctatgttagaaatgccaccggggtgtttagcaacaatgtcgctattcggaagtggcttgtgtccgattggcacgactgccgcccgaaaaagatcatcggaggccatattaacgttatcgaagtgggggatgacctgtctctccacacagagagctacgtctgttccgccgattgctctattggagtggacaaggaaaccgctcaggtgagactgcagacagataccacaaatcatttcgagatcgccggcaccacggtcaaaagcgggtggtttaagtccaccacatatattacccttgaccaaacatgtgagcacctgaaagttagctgcggacccaagtctgtgcagttccatgcgtgttttaaccagcacatgtcctgcgtgcggttcctccaccgcaccatcctgcctggcagcattgccaattctatctgtcagaacatcgaaattatcattctggtcacgctcacactgcttatctttattctgctctccatcctgagcaaaacctacatctgctatcttctgatgcccattttcatccctattgcttacatgtatggcatcatttacaataagtcttgtaagaaatgcaagctctgcgggctggtgtaccatccctttacagagtgtggaacccactgcgtttgtggcgccagatatgatacctccgaccggatgaaactgcatcgcgctagcgggctctgccctggatacaagtccctgagagccgcgcgggtgatgtgtaaatctaagggcccggccagcatcctttccatcattacagctgtcctggtgctcacgttcgttacccccatcaacagcatggtgctgggggaatctaaagagacatttgagcttgaagaactgcctgatgacatgctcgaaatggcctcccgcattaatagctattactttacctgcatcctgaactatgctgtctcttggggactggtgattatcggcctcctgacaggccttctgtttaagaagtaccaacacagattcctcaatgtctatgccatgtactgtgaggaatgcgacatgtaccacgataaaagcgggctgaagcggcatggagacttcaccaacaaatgtcgccagtgcacgtgtggccagtatgaggatgccgctgggcttatggcgcacagaaagacatacaattgcctggtgcagtataaagccaagtggatgatgaactttctcattatctacatcttcctgattctgatcaaggactccgctattgttgtgcaagccgccggaaccgattttaccacatgcctcgagaccgaatctatcaactggaattgtacaggccccttcctgaaccttgggaattgccagaaacagcaaaagaaagagccttatacgaacattgctacccagctgaagggactcaaagccatcagcgtcctggacatccccattatcacaggcattccggatgacatcgcgggcgctctgcggtacattgaagagagagaagattttcatgtgcagcttaccatcgagtatgccatgctctccaagtactgtgactactatacacagttcagcgataattctgggtactcccaaaccacgtggcgcgtttatctgcggagccacgactttgaggcctgcatcctgtaccctaaccagcatttctgtagatgcgtgaagaatggagaaaaatgttcttccagcaactgggactttgctaatgagatgaaggattattactccggcaaacagaccaagttcgacaaagatctcaacctggcccttacagctctgcaccacgcctttcgcgggacctctagcgcgtatattgccacaatgctctccaagaagtctaatgacgatctgatcgcttacaccaacaaaattaaggccaaattccccggaaatgctctgcttaaggccatcattgactacatcgcgtatatgaaaagcctccctggcatggccaactttaagtacgatgagttctgggacgagctgctgtataaacccaatcccgctaaggcctccaacctcgctcgggggaaggaaagctcttacaacttcaaactggccatctccagcaagtctattaaaacgtgcaagaatgtcaaagatgtggcctgtctttcccctagaagcggcgctatctatgcgtctattatcgcctgcggagagccgaacggccccagcgtgtaccgcaagccttccgggggagtttttcagagctctacagaccggtccatttattgtctgctcgatagccattgcctggaggagttcgaggctatcaatcaagaagaactggacgccgtcaagaaatccaagtgctgggagattgaatactctgatgtgaaaccccttcaggagggcgacgggaccaagagctgtagaatgaaagactccggaaactgcaatgtggccacaaaccgctggcctgtcatccagtgtgaaaatgataagttttactattctgagctccagaaggactacgataaaacccaagacatcggccactattgcctgagccccgggtgtaccacagtgcggtacccgattaaccctaagcatatctccaattgcaactggcaggtttctagaagctccattgctaaaatcgatgtgcacaatattgaagacatcgagcagtataagaaagccatcacgcagaagctgcaaaccagcctctctctgttcaagtacgcgaaaacaaagaaccttccccacattaaacctatctataagtacattaccatcgagggcacagaaaccgctgagggaattgaatccgcctacatcgagagcgaagtccccgccctggctggcacgtctatcgggtttaaaattaattccaaggagggaaaacatctcctggatgtgatcgcctatgttaagagcgcgtcttactccagcgtgtatgctaagctgtactccacaggccctaccagcgggattaacaccaaacacgacgagctttgtacaggaccctgcccggccaatatcaaccatcaggtcggctggctcaccttcgccaaggaacgcacatctagctgggggtgtgaggaatttggctgcctggctgtgtccgatggatgtgttttcggctcttgccaggacattatcaaagaggaactgagcgtgtatcggaaggagacggaggaagtcaccgatgtggagctctgcctgacattttccgacaaaacctactgtacaaaccttaatcctgtgacccccattatcacggatctgttcgaagtccaatttaagaccgttgagacatattctctccccagaatcgtggccgtgcagaaccacgagattaagatcgggcagattaatgacctgggagtctacagcaaaggctgcgggaacgtgcagaagatcaatggaaccgtttacggcaacggggtgcctcggttcgactatctgtgtcatcttgcttcccgcaaagaagtcattgtgagaaagtgctttgataatgactaccaagcctgtaaattcctgcagtctccggcgagctatcggctcgaggaagattccggcacagttaccatcatcgactacaagaagattctgggaacaatcaaaatgaaggccattctcggcgatgtgaaatataagaccttcgctgacagcgtcgatatcacggccgaggggtcttgcacaggatgtattaactgctttgaaaatatccactgtgagctgacccttcacaccacaatcgaggcttcctgccccattaaaagctcttgtaccgtgttccatgacagaatcctggttacgcctaacgaacacaagtacgccctcaagatggtgtgcacagagaaacccggcaataccctgacaattaaggtctgcaacaccaaaatcgaagcctccatggctctggtggatgcgaagcctattatcgagcttgcccccgtggaccagacagcttatattcgcgaaaaagatgagcggtgtaagacctggatgtgcagagtccgcgacgaggggctgcaggttatcctcgaaccttttaagaatctgttcggaagctacatcggcattttctacacgttcatcatttccatcgtggccctcctggtgattgtctatgtgcttctgcccatctgttttaaactcagagacaccctgcggaagcatgaggatgcctacaaacgcgaaatgaagatcagatga

SEQ ID NO: 14298 - RNA, 4326 nt, synthetic construct
  misc_feature 1..4326: note = derived and/or modified CDS sequence (opt5) from LACV__M87664.1__GP
  source 1..4326: mol_type = other RNA
atgatctgcattctggtgctcatcaccgtcgccacagctagccccgttctgcagagatgtttccaagacggcgccattgtgaagcagaacccttccaaagaggcgtttacggaagtgtgccttaaggatgacgtctctatgatcaaaaccgaggctcggtacgtgcgcaatgccacaggggttttcagcaacaatgtggccattagaaagtggctggtctccgcttggcacgattgtcggccgaaaaagatcgtgggaggccatatcaacgttattgaagtgggggacgatctctctctgcacaccgagagctatgtctgctccgccgactgtacaatcggagtggataaggaaaccgctcaggtgcgccttcagacagacaccacgaatcattttgagattgccggcaccacagtcaaatctgggtggttcagaagcaccacatacatcaccctggatcaaacgtgcgagcacctcaaggtttcctgtggacccaaaagcgtgcagtttcatgcgtgcttcaaccagcacatgtcttgtgtgcggtttctgcaccgcacaattctgcctagatccatcgccaatagcatttgccagaacatcgaaatcattatcctcgtcaccctgacacttctgattttcatcctcctgtctattctttccaagacctatatctgttacctgctcatgcccatctttattcctatcgcttatatttacggcaccatctataataaaagctgcaagaagtgcaaactgtgtggcctggcccatcaccccttcacagagtgcgggacgcattgtgtgtgcggagctcggtacgacacctctgatcgcatgaagctccacagagcctccggcctgtgtcctgggtacaaaagccttcgggcggcccgcgttatgtgcaagtccaaaggaccggcttctattctgagcatcatcacagccgtgctcgtcctgacctttgtgacacccattaactccatggttcttggcgaaagcaaggagaccttcgagctggaagacctccctgatgacatgctggagatggcttctagaatcaattcctattaccccacgtgtattctgaactatgccgtgagctgggggctcgtcatcattggactgcttatcggcctgctctttaaaaagtaccaacaccggttcctgaatgtgtatgccatgtactgcgaagagtgtgacatgtatcatgataagtctggcgtcaaacgccacggggacttcacaaacaagtgcagacagtgtacctgcggacagtacgaagatgctgcgggccttatggcccatcggaaaacctacaattgcctggtgcagtataaggctaaatggatgatgaactttctcattatctacatcttcctgattctgatcaaggacagcgccattgttgtgcaagccgctgggacagattttaccacatgtctcgagacggagtccatcaactggaattgcaccggacctttcctgaaccttggcaattgtcagaagcagcagaaaaaggaaccctatacaaacattgccacccagctgaaagggctcaaggcgatctctgtcctggacatcccgattatcacaggcattcctgatgacatcgctggagccctgagatacattgaggaaaaagaggattttcacgtgcagcttaccatcgaatatgccatgctcagcaagtactgcgactattacacgcagttctccgataatagcggctactctcaaaccacatggcgcgtttatctgcggtcccatgactttgaggcttgtatcctgtaccccaaccagcacttctgcagatgtgtgaagaatggggagaaatgctcctcttccaaccgcgactttgccaatgaaatgaaggattattacagcggaaaacagaccaagttcgacaaagatctcaacctggctcttacagccctgcactcccaggtcatgcattgttctagcgcgtatattgccaccatgctctccaagaagtctaatgacgatctgatcgcttacacgaacaaaattaagacaaaatttcctggcaatgccctgcttaaggctatcattgactatatcgcctacatgaaaagcctccccgggatggcgaacttcaagtacgatgagttttgggacgaactgctgtataaacccaatcctgccaaggcttccaacctcgcccggggaaaggagagctcttacaacttcaaactggctatctccagcaagtctattaaaacctgcaagaatgtgaaagatgtggcctgtctttccccgagaagcggcgccatctatgcttctattatcgcgtgcggggaacccaacggccctagcgtttaccgcaagccctccggaggcgtcttccaaagctctacagaccggtccatttattgcctgctcgatagccactgtctggaggagtttgaagccatctcccaggaggaactggacgctgtgaagaaatctaagtgctgggagattgagtaccctgatgtgaaacttatccaggaaggggacggaaccaagagctgtagaatgaaagactccggcaattgcaacgtcgccaccaatcgctggcccgtgacacagtgtgagaacgataagttctattactctgacctccaaaaggattacgacaaaacgcaggatatcgggcattattgcctgagcccgggatgtaccacagttcggtaccctattaatcccaagcacatctccaactgcaattggcaagtgtctagaagctccattgccgaaatcgacgtccacaacattgaggatatcgaacagtataaaaaggctatcacccaaaaactgcagacaagcctctctctgtttaagtacgccaagaccaaaaatcttcctcatattaagcccatctataaatacattacgatgaagggcacagagaccgcggaggggatcgaatccgcttatattgagagcgaagtgcctgccctggccggcacctctatcggattcaaaatcaactccaaggagggcaaacacctcctggacgttattgcttacgtcaagagcgcctcttactccagcgtgtatacaaagctgtactccaccgggcccacaagcggaatcaatacgaaacatgatgaactttgtaccggcccgtgccctgcgaacattaatcaccaggtggggtggctcacatttgctcgcgagcggacctctagctggggatgtgaggagttcggctgcctggccgtttccgacgggtgcgtgtttggctcttgtcaagatatcattaaggaagaactgagcgtctatagaaaagagacagaagaggtgaccaacgtggagctctgcctgacgttctccgacaagacctactgtacaaaccttaatcccgtcacccccatcattacagatctgtttgaagttcagttcaaaaccgtggagacatattctctccctcggatcgtggccgtccagaaccatgaaatcaagattggacagatcaatgacctgggcgtgtacagcaaggggtgcggaaacgttcaaaaagtgaatggcaccatttatgggaacggagtcccgcgctttgactacctgtgtcaccttgcttccagaaaggaggtgatcgttcggaaatgcttcgataatgactaccaggcctgtaagtttctgcagtctcccgctagctatagactcgaggaagattccggcacggtgacaattatcgactacaaaaagatcctggggaccattaagatgaaagccatcctcggcgatgtcaagtataaaaccttcgcggacagcgtggatattacagccgagggatcttgcaccggctgtatcaactgcttcgaaaatattcactgtgagctgacgcttcatacaaccatcgaagctagctgccctatcaagagctcttgcacagtttttcacgaccgcattctggtgacccccaacgagcataaatacgccctcaagatggtctgtacagagaagcctgggaataccctgacgatcaaagtgtgcaacaccaagattgaggcttccatggccctggtggatgccaaacccatcattgaacttgctcctgtcgaccagacagcgtatatccgggaaaaggatgagagatgtaaaacctggatgtgccgcgttagagacgaaggactgcaagtgattctcgagcccttcaagaatctgtttggcagctacatcgggatcttctatacatttattatctccattgtggccctcctggtcatcatttacgtgcttctgccgatctgtttcaagctccgggacaccctgcgcaaacacgaggatgcttacaagagagaaatgaaaatccggtga

SEQ ID NO: 14299 - RNA, 4326 nt, synthetic construct
  misc_feature 1..4326: note = derived and/or modified CDS sequence (opt5) from LACV__KP271105.1__GP
  source 1..4326: mol_type = other RNA
atgatccggattctggtgctcatcgccgtcaccgctgccagccccgtttaccagagatgcttccaagacggcgcgattgtgaagcagaacccttccaaagaggctgtgacagaagtctgtctgaaggatgacgtgtctatgatcaaaacggaggcccgctatgttagaaatgccaccggggtgtttagcaacaatgtcgctattcggaagtggcttgtgtccgattggcacgactgccgcccgaaaaagatcatcggaggccatattaacgttatcgaagtgggggatgacctgtctctccacacagagagctacgtctgttccgccgattgctctattggagtggacaaggaaaccgctcaggtgagactgcagacagataccacaaatcatttcgagatcgccggcaccacggtcaaaagcgggtggtttaagtccaccacatatattacccttgaccaaacatgtgagcacctgaaagttagctgcggacccaagtctgtgcagttccatgcgtgttttaaccagcacatgtcctgcgtgcggttcctccaccgcaccatcctgcctggcagcattgccaattctatctgtcagaacatcgaaattatcattctggtcacgctcacactgcttatctttattctgctctccatcctgagcaaaacctacatctgctatcttctgatgcccattttcatccctattgcttacatgtatggcatcatttacaataagtcttgtaagaaatgcaagctctgcgggctggtgtaccatccctttacagagtgtggaacccactgcgtttgtggcgccagatatgatacctccgaccggatgaaactgcatcgcgctagcgggctctgccctggatacaagtccctgagagccgcgcgggtgatgtgtaaatctaagggcccggccagcatcctttccatcattacagctgtcctggtgctcacgttcgttacccccatcaacagcatggtgctgggggaatctaaagagacatttgagcttgaagaactgcctgatgacatgctcgaaatggcctcccgcattaatagctattacttcacatgcatcctgaactatgctgtctcttggggactggtgattatcggcctcctgacaggccttctgtttaagaagtaccaacacagattcctcaatgtctatgccatgtactgtgaggaatgcgacatgtaccacgataaaagcgggctgaagcggcatggagacttcaccaacaaatgtcgccagtgcacgtgtggccagtatgaggatgccgctgggcttatggcgcacagaaagacatacaattgcctggtgcagtataaagccaagtggatgatgaactttctcattatctacatcttcctgattctgatcaaggactccgctattgttgtgcaagccgccggaaccgattttaccacatgcctcgagaccgaatctatcaactggaattgtacaggccccttcctgaaccttgggaattgccagaaacagcaaaagaaagagccttatacgaacattgctacccagctgaagggactcaaagccatcagcgtcctggacatccccattatcacaggcattccggatgacatcgcgggcgctctgcggtacattgaagagagagaagattttcatgtgcagcttaccatcgagtatgccatgctctccaagtactgtgactactatacacagttcagcgataattctgggtactcccaaaccacgtggcgcgtttatctgcggagccacgactttgaggcctgcatcctgtaccctaaccagcatttctgtagatgcgtgaagaatggagaaaaatgttcttccagcaactgggactttgctaatgagatgaaggattattactccggcaaacagaccaagttcgacaaagatctcaacctggcccttacagctctgcaccacgcctttcgcgggacctctagcgcgtatattgccacaatgctctccaagaagtctaatgacgatctgatcgcttacaccaacaaaattaaggccaaattccccggaaatgctctgcttaaggccatcattgactacatcgcgtatatgaaaagcctccctggcatggccaactttaagtacgatgagttctgggacgagctgctgtataaacccaatcccgctaaggcctccaacctcgctcgggggaaggaaagctcttacaacttcaaactggccatctccagcaagtctattaaaacgtgcaagaatgtcaaagatgtggcctgtctttcccctagaagcggcgctatctatgcgtctattatcgcctgcggagagccgagcggcccctccgtgtaccgcaagcctagcgggggagtttttcagtcttccacagaccggagcatttattgtctgctcgattcccattgcctggaggagttcgaggctatcaaccaagaagaactggacgccgtcaagaaatctaagtgctgggagattgaatacagcgatgtgaaaccccttcaggagggcgacgggaccaagtcctgtaaaatgaaggactctggaaattgcaacgtggccacaaatagatggcctgtcatccagtgtgaaaacgataagttttactatagcgagctccagaaagactacgataagacccaagacatcggccactattgcctgtcccccgggtgtaccacagtgcgctacccgattaatcctaaacatatctctaactgcaattggcaggttagccggtccagcattgctaagatcgatgtgcacaacattgaagacatcgagcagtataaaaaggccatcacgcagaagctgcaaacctctctctccctgttcaaatacgcgaagaccaaaaatcttccccacattaagcctatctataaatacattaccatcgagggcacagaaaccgctgagggaattgaaagcgcctacatcgagtctgaagtccccgccctggctggcacgtccatcgggtttaagattaacagcaaagagggaaagcatctcctggatgtgatcgcctatgttaagtctgcgtcctacagctccgtgtatgctaaactgtacagcacaggccctacctctgggattaataccaagcacgacgagctttgtacaggaccctgcccggccaacatcaatcatcaggtcggctggctcaccttcgccaaagaaagaacaagctcctgggggtgtgaggaatttggctgcctggctgtgtctgatggatgtgttttcggcagctgccaggacattatcaaggaggaactgtccgtgtatcgcaaagagacggaggaagtcaccgatgtggagctctgcctgacattttctgacaagacctactgtacaaaccttaaccctgtgacccccattatcacggatctgttcgaagtccaatttaagaccgttgagacatatagcctcccccggatcgtggccgtgcagaatcacgagattaaaatcgggcagattaacgacctgggagtctactccaagggctgcgggaatgtgcagaaagttaacggaaccgtgtacggcaatggggtccctagattcgactatctgtgtcatcttgcttctcggaaggaagtgatcgttcgcaaatgctttgataacgactaccaagcctgtaagttcctgcagagcccggcgtcctatagactcgaggaagatagcggcacagtgaccattatcgactacaagaaaatcctgggaacaattaagatgaaagccatcctcggcgatgtcaagtataaaaccttcgctgactctgtggatattacggccgaggggtcctgcacaggatgtatcaattgctttgaaaacattcactgtgagctgacccttcacaccacaatcgaggctagctgccccatcaagtcttcctgtaccgttttccatgaccggattctggtgacgcctaatgaacacaagtacgccctcaaaatggtctgcacagagaagcccggcaacaccctgacaatcaaagtgtgcaataccaagattgaagccagcatggctctggtggatgcgaaacctatcattgagcttgcccccgtcgaccagacagcttatatcagagaaaaggatgagcgctgtaagacctggatgtgccgggttagagacgaggggctccaggtgattctggaaccttttaaaaacctgttcggatcctacatcggcatcttttacacgttcattatctctattgtggccctcctggtcatcgtgtatgttcttctgcccatttgttttaagctccgcgacaccctgagaaaacatgaggatgcctacaagcgggaaatgaaaatccgctga

SEQ ID NO: 14300 - RNA, 4326 nt, synthetic construct
  misc_feature 1..4326: note = derived and/or modified CDS sequence (opt5) from LACV(74-32813)__D10370.1__GP
  source 1..4326: mol_type = other RNA
atgatcagaatgctggtgctcattgtcgttaccgccgctagccccgtgtaccagcggtgcttccaagacggcgccatcgtgaagcagaacccttccaaagaggcggtcacagaagtgtgtctgaaggatgacgtttctatgattaaaacggaggctcgctatgtgaagaatgccaccggggtctttagcaacaatgtggccatcagaaaatggcttgtttccgattggcacgactgccggccgaagaagattgtgggaggccatatcaacgtcatcgaagtgggggatgacctgtctctccacacagagagctacgtgtgttccgctgattgcaccattggagtcgacaaagaaacagcccaggttcgcctgcagaccgatacaaccaatcatttcgagatcgctggcacgaccgtgaagtctgggtggtttaaaagcacaacctatattacacttgaccaaacctgtgagcacctgaaggtgtcctgcgcccccaaaagcgtccagttccatgcgtgttttaaccagcacatgtcttgcgtgagattcctccaccggacgatcctgcctggatccattgccaatagcatctgtcagaacattgaaatcatcattctggttacactcaccctgcttatctttattctgctctctatcctgtccaagacatacatttgctatcttctgatgcccatcttcatccctattgcttacatgtatggcgtgatctacaataagagctgtaaaaagtgcaaactctgcggcctggtctaccatccctttaccgagtgtgggacccactgcgtgtgtggagcccgctatgatacatctgacagaatgaagctgcatcgggcttccggcctctgccctgggtacaaaagcctgcgcgccgcgagagttatgtgtaagtccaaaggaccggcctctattcttagcatcattacggctgtgctggtcctcaccttcgtgacacccatcaactccatggtcctgggcgaaagcaaggagacctttgagcttgaagaactgcctgatgacatgctcgaaatggccctgcggatcaattcttattacttcacatgcattctgaactatgctgtgtcctgggggctcatcattgccggactgcttgttggcctgatctttaagaaataccaacaccgcttcctcaatatttatgccatgtactgtgaggaatgcaacatgtaccacgacaagagcggcctgaaaagacatggggatttcaccaataagtgtcggcagtgcacgtgtggacagtatgaggacgctacaggccttatcacccaccgcaaaacctacaactgcctggtgcagtataaggcgaagtggatgatgaactttctcattatctacatcttcctgattctgatcaaagattctgccattgtcgggcaagctacaggaaccgactttacaacgtgcctcgagaccgaaagcatcaattggaactgtacaggccccttcctgaatcttgggaactgccagaagcagcagaaaaaggagccttataccaatattgccacacaactgaaaggactcaaggccatctccgtgctggatatccccattatcacctctattccggacgatatcgctggcgccctgagatacattgaagagaaggaagactttcatgttcagcttacgaccgagtatgcgatgctcagcaaatactgtgattactatacacagttctccgacaacagcggctactctcaaaccacatggcgggtgtatctgagatcccacgattttgaggcttgcatcctgtaccctaatcagcatttctgtaagtgcgtcaaaaacggggaaaagtgttctagctccaattgggactttgccaacggaatgaaaaattattacagcggcaagcaggccaagttcgacaaagatctcaacctggctcttaccgccctgcaccacgcttttcgcgggacgtcctctgcctatatcgcggccatgctcagcaagaaatccaatgacgatctgattgcttacacaaacaagatcaaagccaagttccccggaaatgctctgcttaaagccattatcgactacattgcgtatatgaagggcctccctgagatggccaactttaagtacgatgagttctgggacgagctgctgtataaacccaaccccgctaaggcctctaatctcgctcgggggaaagaaagctcctacaacttcaagctggccatcagctctaaatccatcaagacctgcaagaatgtgaaagatgtggcctgtcttagccctagatctggcgctatttattccagcatcattgcgtgcggagagccgaacggcccctctgtttaccgcaagcctagcgggggagtctttcagtccagcacagaccggtctatctattgtctgctcgattcccattgcctggaggagttcgaggccattagccaagaagaactggacgctgtgaaaaagtccaaatgctgggagatcgaataccccgatgtgagacctcttcaggagtctgacggcgccaagagctgtcgcatgaaggattccgggaattgcaacgtcgccaccaatcggtggcccgtgatgcagtgtgaaaacgacaaattttactattctgagctccagaaggactacgataaaacccaagacattggacactattgcctgagcccgggctgtacaacgatcagataccctatcaatcccaagcatatttccaactgcaattggcaggtttctcgcagctccatcgctaaaattgatgtgcacaacgtcgaagacatcgagcagtataagaaggccattacccagaaactgcaaacaagcctctctctgttcaagtacgcgaaaaccaagaatcttcctcacatccggcccatctataaatacattacaatgaaggagaccgaaacggctgaggggatcgaatccgcctacattgagagcgaagtgcctgccctggctggcacatctgttggatttaaaatcaactccaaggagggcaagcatctcctggatgtgattgcctatgtcaaaagcgcgtcttactccagcgtgtatgctaagctgtactccaccgggcccaccagcggaatcaatacaaaacacgacgagctttgtaccggcccgtgccctgccaacatcaaccatcaggttgggtggctcacattcgccagagaacgcacgtctagctggggatgtgaggaatttggctgcctggctgtgtccgatgggtgtgtcttcggctcttgccaggacattatcaaggaggaactgagcgtgtatcggaaagagaccgaggaagtgacaaatgtcgagctctgcctgaccttttccgataagacatactgtaccaaccttaatcccgttacgcccattatcaccgacctgttcgaagtgcaatttaagacagtggagacctattctctccctagaattgtcgccgtgcagaaccacgagatcaaaattggacagatcaatgatctgggcgtttacagcaaggggtgcggaaacgtgcagaaagtcaatggcacagtgtacgggaacggagttccgcggttcgactatctgtgtcatcttgcttcccgcaaggaagtgatcgtcagaaaatgctttgataatgactaccaagcctgtaagttcctgcagtctcccgcgagctatcggctcgaggaagactccggcaccgtgacaattatcgattacaagaaaattctggggaccatcaagatgaaagccattctcggcgacgttaagtataaaacgttcgctgatagcgtggacatcacagccgagggatcttgcgctggctgtatcaactgctttcagaatattcactgtgaactgacccttcacaccacaatcgaggcctcctgccctattaagagctcttgtaccgtcttccatgatagaatcctggtgacgcccaacgagcacaagtacgccctcaaaattgtgtgcacagaaaagcctgggaataccctgacaatcaaagtctgcaacacccgcatcgaggcttccatggcgctggttgacgccaagcccattatcgaacttgctcctgtggatcagacagcctatattcgggagaaagacgaaagatgtaagacctggatgtgccgcgtgagagatgagggactgcaagtcatcctcgagccctttaagaatctgttcggcagctacattgggatcttttacacgttcattatctccatcattgccctcctggtgatcatttatgttcttctgccgatctgttttaaactccgggacaccctgcgcaagcatgatgacgcttacaaaagagaaatgaagattcggtga

SEQ ID NO: 14301 - RNA, 4326 nt, synthetic construct
  misc_feature 1..4326: note = derived and/or modified CDS sequence (opt5) from LACV(Craig County/VA/2009)__KP226848.1__GP
  source 1..4326: mol_type = other RNA
atgatccggattctggtgctcatcgccgtcaccgctgccagccccgtttaccagagatgcttccaagacggcgcgattgtgaagcagaacccttccaaagaggctgtgacagaagtctgtctgaaggatgacgtgtctatgatcaaaacggaggcccgctatgttagaaatgccaccggggtgtttagcaacaatgtcgctattcggaagtggcttgtgtccgattggcacgactgccgcccgaaaaagatcatcggaggccatattaacgttatcgaagtgggggatgacctgtctctccacacagagagctacgtctgttccgccgattgcaccattggagtggacaaggaaacagctcaggtgagactgcagaccgatacaaccaatcatttcgagatcgccggcacgaccgtcaaatctgggtggtttaagagcacaacctatattacacttgaccaaacctgtgagcacctgaaagtttcctgcggacccaagagcgtgcagttccatgcgtgttttaaccagcacatgtcttgcgtgcggttcctccaccgcacgatcctgcctggctccattgccaatagcatctgtcagaacatcgaaattatcattctggtcacactcaccctgcttatctttattctgctctctatcctgtccaaaacatacatctgctatcttctgatgcccgtgttcattcctatcgcttgtatttacggcatcatttataataagagctgcaagaaatgcaagctctgtgggctggtttaccatccctttaccgagtgcggaacccactgtgtgtgcggcgccagatacgatacatctgaccggatgaaactgcatcgcgcttccgggctctgtcctggatataagagcctgagagccgcgcgggtcatgtgcaaatccaagggcccggcctctatccttagcatcattacggctgtgctggttctcaccttcgtgacacccatcaactccatggtcctgggggaaagcaaagagacctttgagcttgaagaactgcctgatgacatgctcgaaatggcctctcgcattaattcctactatttcacatgtatcctgaactacgctgtgagctggggactggtcattatcggcctcctgattggccttctgtttaagaagtatcaacacagattcctcaatatctacgccatgtattgcgaggaatgtgacatgtaccacgataaatctgggctgaagcggcatggagacttcaccaacaaatgccgccagtgtacgtgcggccagtacgaggatgccgctgggcttatggcgcacagaaagacatataattgcctggtgcagtacaaagccaagtggatcatgaactttctcattatctatattttcctgatcctgattaaggacagcgctatcgttgtgcaagccgccggaaccgattttaccacatgtctcgagaccgaatccatcaactggaattgcacaggccccttcctgaaccttgggaattgtcagaaacagcaaaagaaagagccttacacgaacattgctacccagctgaagggactcaaagccatctctgtcctggacattcccatcattacaggcatcccggatgacatcgcgggcgctctgcggtatattgaagagagagaagattttcatgtgcagcttaccatcgagtacgccatgctcagcaagtattgcgactactacacacagttctccgataatagcgggtattctcaaaccacgtggcgcgtttacctgcggtcccacgactttgaggcctgtattctgtatcctaaccagcatttctgcagatgtgtgaagaatggagaaaaatgcagcagctccaactgggactttgctaatggcatgaaggattactatagcgggaaacaggccaagttcgacaaagatctcaacctggctcttaccgccctgcaccacgcgtttcgcggaacatcctctgcctacatcgctaccatgctcagcaagaagtccaatgacgatctgattacatataccaacaaaatcaagacgaaattccccggcaatgccctgcttaaggctatcattgactacatcgcctacatgaaatctctccctgggatggcgaactttaagtatgatgagttctgggacgaactgctgtacaaacccaatcccgccaaggctagcaacctcgcccggggcaaggagtccagctataacttcaaactggctatttcttccaagagcatcaaaacatgtaagaatgtcaaagatgtggcctgcctttctcctagatccggagccatttacgctagcatcattgcgtgtggcgaaccgaacgggccctctgtgtatcgcaagcctagcggaggcgtttttcagtccagcaccgaccggtctatctactgcctgctcgattcccattgcctggaggagttcgaagccatcagccaagaggaactggacgctgtcaagaaatccaagtgttgggagattgagtatcccgatgtgaaacctcttcaggaatctgacgggacaaagagctgcagaatgaaagactccggaaattgtaacgtggccaccaatcgctggcccatcattcagtgcgagaacgataagttttactactctgaactccagaaggactatgataaaacccaagacatcggccactactgtctgagcccggggtgcacaacggtccggtatcctattaatcccaagcatatctccaactgtaattggcaagtgtctagaagctccatcgccaaaattgatgttcacaacatcgaggacattgaacagtacaagaaagctatcacccagaagctgcagacaagcctctctctgttcaagtatgccaaaaccaagaatcttcctcacattaaacccatctacaagtatatcacaattgagggcaccgagacggcggaaggaatcgagtccgcttacattgaaagcgaggtgcctgccctggccggcgcttctatcgggtttaaaattaactccaaggaaggaaaacatctcctggatgtcatcgcctacgtgaagtctgcgtcttattccagcgtttacgctaagctgtattccacaggccccaccagcgggattaataccaaacacgacgagctttgcacaggaccgtgtcctgccaacatcaatcatcaggtgggctggctcaccttcgcccgcgagcggacatctagctgggggtgcgaagagtttggctgtctggctgtctccgatggatgcgtgttcggctcttgccaggacatcattaaggaggagctgagcgtttacagaaaagaaacggaggaggtgaccgatgtcgaactctgtctgacattttccgacaagacctattgcacaaaccttaaccccgtgacccccatcattacggatctgttcgaggtgcaatttaaaaccgtcgaaacatactctctccctcggatcgttgccgtgcagaatcacgagattaagatcgggcagatcaacgacctgggagtgtatagcaagggctgtgggaatgtccagaaagtgaacggaaccgtttacggcaatggggtgccgcgcttcgactacctgtgccatcttgcttccagaaaggaggtcattgtgcggaaatgttttgataacgactatcaagcctgcaagttcctgcagtctcccgcgagctacagactcgaagaggattccggcacagttaccatcattgactataaaaagatcctgggaacaattaagatgaaagccatcctcggcgatgtgaagtacaaaaccttcgctgacagcgtcgatatcacggccgaagggtcttgtacaggatgcattaattgttttgagaacatccactgcgaactgacccttcacaccacaattgaggcttcctgtcctatcaagagctcttgcaccgtgttccatgaccgcattctggttacgcccaatgagcacaaatatgccctcaagatggtgtgcacagaaaagcctggcaacaccctgacaatcaaagtctgtaataccaagattgaggcctccatggctctggtggatgcgaaacccatcatcgaacttgcccctgtggaccagacagcttacattcgggagaaggatgaaagatgcaaaacctggatgtgtcgcgtcagagacgaggggctgcaggttatcctcgagccctttaagaacctgttcggaagctatattggcatcttttacacgttcattatctccatcgtggccattctcgtgatcatttacgtcctgcttccgatctgctttaagctgcgggacaccctccgcaaacatgaagatgcctataagagagagatgaaaattcggtga

SEQ ID NO: 14302 - RNA, 4326 nt, synthetic construct
  misc_feature 1..4326: note = derived and/or modified CDS sequence (opt5) from LACV(Dallas/TX/2009)__GU591165.1__GP
  source 1..4326: mol_type = other RNA
atgatccggattctggtgctcatcgtcgttaccgccgctagccccgtgtaccagagatgcttccaagacggcgccattgtgaagcagaacccttccaaagaggcggtcacagaagtgtgtctgaaggatgacgtttctatgatcaaaacggaggctcgctatgtgaagaatgccaccggggtctttagcaacaatgtggccattagaaaatggcttgtttccgattggcacgactgccggccgaagaagatcgtgggaggccatatcaacgtcattgaagtgggggatgacctgtctctccacacagagagctacgtgtgttccgctgattgcaccatcggagtcgacaaagaaacagcccaggttcgcctgcagaccgatacaaccaatcatttcgagattgctggcacgaccgtgaagtctgggtggtttaaaagcacaacctatatcacacttgaccaaacctgtgagcacctgaaggtgtcctgcggacccaaaagcgtccagttccatgcctgttttaaccagcacatgtcttgcgtgagattcctccaccggacgattctgcctggctccatcgcgaatagcatttgtcagaacatcgaaatcattatcctggttacactcaccctgcttatttttatcctgctctctattctgtccaagacatacatctgctatcttctgatgcccatcttcattcctatggcctacatgtatggcgtgatctacaataagagctgtaaaaagtgcaaactctgcgggctggtctaccatccctttaccgagtgtggaacccactgcgtgtgtggcgctcgctatgatacatctgacagaatgaagctgcatcgggcctccgggctctgccctggatacaaaagcctgcgcgctgccagagttatgtgtaagtccaaaggcccggcgtctattcttagcatcattacggccgtgctggtcctcaccttcgtgacacccatcaactccatggtcctgggggaaagcaaggagacctttgagcttgaagaactgcctgatgacatgctcgaaatggctctgcggatcaattcttattacttcacatgcattctgaactatgccgtgtcctggggactcatcattgctggcctgcttgttggcctgatctttaagaaataccaacaccgcttcctcaatatttatgccatgtactgtgaggaatgcgacatgtaccacgataagagcgggctgaaaagacatggagacttcacctctaagtgtcggcagtgcacgtgtggccagtatgaggatgccacagggcttatcacccaccgcaaaacctacaactgcctggtgcagtataaggctaagtggatgatgaattttctcattatctacatcttcctgattctgatcaaagacagcgcgattgtcgtgcaagccacaggaaccgattttacaacgtgcctcgagaccgaatccatcaactggaactgtacaggccccttcctgaatcttgggaactgccagaagcagcagaaaaaggagccttataccaatattgctacacaactgaaaggactcaaggccatctctgttctggacatccccattatcaccggcattccggatgacatcgccggcgctctgagatacattgaagagaaggaagattttcatgtgcagcttacgaccgagtatgccatgctcagcaaatactgtgactactatacacagttctccgataacagcgggtactctcaaaccacatggcgggtctatctgagatcccacgactttgaggcgtgcatcctgtaccctaatcagcatttctgtcgctgcgtgaagaacggagaaaaatgttctagctccaattgggactttgctaacgagatgaagaattattacagcggcaaacaggccaagttcgataaggacctcaacctggcccttaccgctctgcaccacgcctttcgggggacgtcctctgcttatatcgccacaatgctcagcaaaaagtccaatgatgacctggtggcgtacaccaacaaaattaaggccaaattccccggaaatgctctgcttaaggccatcattgattacatcgcttatatgaaaggcctccctgacatggccaactttaagtacgatgagttctgggacgagctgctgtataagcccaatcccgcgaaagcctctaacctcgctagagggaaggaaagctcctacaacttcaaactggccgttagctctaagtccattcgcacatgcaaaaatgtcaaggatgtggcttgtcttagccctcggtctggcgccatctattccagcatcattgcctgcggagagccgaacggcccctctgtgtacagaaagcctagcgggggagtctttcagtccagcaccgaccgctctatctattgtctgctcgattcccattgcctggaggagttcgaagctattagccaagaggaactggacgcggtgaaaaagtccaaatgctgggagatcgaataccccgatattcggcctcttcaggagtctgacggcagcaagtcctgtagaatgaaagactctgggaattgcaacgttgccaccaatcgctggcccgtgatgcagtgtgaaaacgataagttttactatagcgagctccagaaggactacgataaaacacaagacatcggacactattgcctgtccccgggctgtacgaccattcggtaccctatcaatcccaagcatatctctaactgcaattggcaggtcagcagatccagcattgctaaaatcgatgtgcacaacgttgaagacattgagcagtataagaaagccatcacacagaagctgcaaacctctctctccctgttcaagtacgccaaaacaaagaatcttcctcacattaaacccatctataagtacatcaccattgaggggacggaaacagctgagggcatcgaaagcgcctacattgagtctgaagtgcctgcgctggctggaacctccatcggctttaaaattaacagcaaggaggggaaacatctcctggatgtcatcgcctatgtgaagtctgcctcctacagctccgtttatgctaagctgtacagcaccggacccacatctggcatcaataccaaacacgacgagctttgtacagggccgtgccctgccaacattaatcatcaggtgggatggctcacgttcgcgcgcgaacggaccagctcctggggctgtgaggaatttgggtgcctggctgtctctgatggctgtgtgttcggaagctgccaggacatcattaaggaggaactgtccgtgtatagaaaagatacagaggaggtcaccaacgttgaactctgcctgacattttctgacaagacctactgtacgaaccttaatcccgtgacccccatcattacagatctgttcgaggtgcaatttaaaaccgtcgaaacatatagcctccctcggatcgtggccgttcagaaccacgagattaagatcggccagatcaatgacctgggggtgtactccaagggatgcggcaacgtccagaaagtgaatgggaccgtttacggaaacggcgtgccgcgcttcgactatctgtgtcatcttgcctctagaaaggaggtcattgtgcggaaatgctttgataatgactaccaggcttgtaagttcctgcaaagccccgcctcctatagactcgaagaggatagcgggacagttaccatcattgactacaaaaagatcctgggcacgattaagatgaaagctatcctcggagatgtgaagtataaaacattcgccgactctgtcgatatcaccgcggaaggctcctgcgccgggtgtattaactgctttgagaatatccactgtgaactgacccttcacacaaccattgaggctagctgccctatcaagtcttcctgtacggtgttccatgaccgcattctggtgacacccaacgagcacaaatacgccctcaagatggtctgcaccgaaaagcctggaaatacactgaccatcaaagtttgcaacacacggatcgaggtgagcatggctctggtggatgccaagcccattatcgaacttgcccctgtcgaccagaccgcttatattagagagaaagatgaacgctgtaagacgtggatgtgcagagtgcgggacgagggcctgcaggttatcctcgagccctttaaaaatctgttcgggtcctacattggaatcttttacaccttcattatctctatcattgcgctcctggtgatcatttatgtccttctgccgatctgttttaagctccgcgacacactgagaaagcatgatgacgcctacaaacgggaaatgaagattcgctga

SEQ ID NO: 14303 - RNA, 4326 nt, synthetic construct
  misc_feature 1..4326: note = derived and/or modified CDS sequence (opt5) from LACV(Fort Bend County/TX/2009)__GU591168.1__GP
  source 1..4326: mol_type = other RNA
atgatcagaatgctggtgctcattgtcgttaccgccgctagccccgtgtaccagcggtgcttccaagacggcgccatcgtgaagcagaacccttccaaagaggcggtcacagaagtgtgtctgaaggatgacgtttctatgattaaaacggaggctcgctatgtgaagaatgccaccggggtctttagcaacaatgtggccatcagaaaatggcttgtttccgattggcacgactgccggccgaagaagattgtgggaggccatatcaacgtcatcgaagtgggggatgacctgtctctccacacagagagctacgtgtgttccgctgattgcaccattggagtcgacaaagaaacagcccaggttcgcctgcagaccgatacaaccaatcatttcgagatcgctggcacgaccgtgaagtctgggtggtttaaaagcacaacctatattacacttgaccaaacctgtgagcacctgaaggtgtcctgcggacccaaaagcgtccagttccatgcctgttttaaccagcacatgtcttgcgtgagattcctccaccggacgatcctgcctggctccattgcgaatagcatctgtcagaacattgaaatcatcattctggttacactcaccctgcttatctttattctgctctctatcctgtcccgcacatacatttgctatcttctgatgcccatcttcatccctattgcctacatgtatggcgtgatctacaataagagctgtaagaaatgcaagctctgcgggctggtctaccatccctttaccgagtgtggaacccactgcgtgtgtggcgctagatatgatacatctgaccggatgaaactgcatcgcgcctccgggctctgccctggatacaagagcctgagagctgcccgggttatgtgtaaatccaagggcccggcgtctattcttagcatcattacggccgtgctggtcctcaccttcgtgacacccatcaactccatggtcctgggggaaagcaaagagacctttgagcttgaagaactgcctgatgacatgctcgaaatggctctgcgcatcaattcttattacttcacatgcattctgaactatgccgtgtcctggggactcatcattgctggcctgcttgttggcctgatctttaagaagtaccaacacagattcctcaatatttatgccatgtactgtgaggaatgcgacatgtaccacgataaaagcgggctgaagcggcatggagacttcaccaacaaatgtcgccagtgcacgtgtggccagtatgaggatgccgctgggcttatggcgcacagaaagacatacaattgcctggtgcagtataaagccaagtggatgatgaactttctcatcatttacatcttcctgatcctgattaaggactctgctatcgtcgtgcaagccaccggaaccgattttacaacctgcctcgagacagaaagcattaactggaattgtacgggccccttcctgaaccttgggaattgccagaaacagcaaaagaaagagccttataccaacatcgccacacagctgaagggactcaaagctatttccgttctggacatccccatcattaccggcatcccggatgacattgccggcgcgctgcggtacatcgaagagaaggaagattttcatattcagcttacaaccgagtatgctatgctctctaagtactgtgactactatacgcagttcagcgataattccgggtacagccaaaccacatggagagtgtatctgcgctctcacgactttgaggcctgcatcctgtaccctaaccagcatttctgtcggtgcgtcaaaaatggagaaaagtgttccagctctaactgggactttgccaatgagatgaaaaactattactccggcaagcaggctaaattcgataaggacctcaatctggcccttaccgctctgcaccacgcctttagagggacaagctccgcgtatatcgccaccatgctctctaagaaaagcaacgatgacctgattgcttacacgaataagatcaaagccaagttccccggaaacgctctgcttaaagccattatcgattacattgcgtatatgaagggcctccctgacatggccaattttaaatacgatgaattttgggacgagctgctgtataagcccaaccccgctaaggcctccaacctcgctcgcgggaaagaatctagctacaatttcaagctggccatctccagcaaatctatcaagacatgcaaaaacgtgaaggatgtggcctgtctttcccctcggagcggcgctatttattcttccatcattgcgtgcggagagccgaatggccccagcgtttacagaaagccttctgggggagtctttcagagctccaccgaccgcagcatctattgtctgctcgattctcattgcctggaggagttcgaggccatttcccaagaagaactggacgctgtgaaaaagagcaaatgctgggagatcgaataccccgatgtgcggcctcttcaggagtccgacggcgccaagtcttgtagaatgaaagacagcgggaactgcaatgtcgccacaaaccgctggcccgtgatgcagtgtgaaaatgataagttttactattccgagctccagaaggactacgataaaacccaagacattggacactattgcctgtctccgggctgtaccacaatccggtaccctatcaaccccaagcatattagcaattgcaactggcaggtttccagatctagcatcgctaaaattgatgtgcacaatgtcgaagacatcgagcagtataagaaagccattacgcagaagctgcaaacctccctcagcctgttcaagtacgcgaaaacaaagaaccttcctcacatcaaacccatctataagtacattaccatcgaggggacagaaaccgctgagggcattgaatctgcctacatcgagtccgaagtgcctgccctggctggaacgagcattggctttaaaatcaattctaaggaggggaaacatctcctggatgttatcgcctatgtgaagtccgcgagctactcttccgtctatgctaagctgtacagcacaggacccacctccggcattaacaccaaacacgacgagctttgtacagggccgtgccctgccaatatcaaccatcaggtgggatggctcaccttcgcccgcgaacggacaagctcttggggctgtgaggaatttgggtgcctggctgttagcgatggctgtgtgttcggatcctgccaggacattatcaaggaggaactgtctgtctatagaaaagagacggaggaagtgaccaacgtggagctctgcctgacatttagcgataagacctactgtacatcccttaatcccgtcacccccattatcacggacctgttcgaagttcaatttaaaaccgtggagacatattctctccctcggattgtggccgtccagaaccacgagatcaagatcggccagattaatgatctgggggtgtacagcaagggatgcggcaacgttcagaaagtgaatgggaccgtctacggaaacggcgtgccgcgcttcgactatctgtgtcatcttgcttccagaaaggaagttatcgtgcggaaatgctttgacaatgattaccaagcctgtaagttcctgcagtctcccgcgagctatagactcgaggaagactccgggacagtcaccattatcgattacaaaaagattctgggcacaatcaagatgaaagccatcctcggagacgtgaagtataaaaccttcgctgatagcgttgacattacggccgagggctcttgcgctgggtgtatcaactgctttgaaaatattcactgtgagctgacacttcacaccaccatcgaggcctcctgccctattaagagctcttgtacagtgttccatgatcgcatcctggtcacccccaacgaacacaaatacgccctcaagatggtgtgcacggagaagcctggaaatacactgaccatcaaagtgtgcaacacacggattgaggcttccatggcgctggtcgacgccaagcccatcattgagcttgctcctgttgatcagaccgcctatatcagagaaaaagacgagcgctgtaagacatggatgtgcagagtgcgggatgagggcctccaggtgattctggaaccctttaaaaatctgttcgggagctacatcggaattttctacaccttcatcatctccattatcgccctcctggtcattatctatgtgcttctgccgatttgttttaagctccgcgacacgctgagaaagcatgacgatgcttacaaacgggagatgaagatccgctga

SEQ ID NO: 14304 - RNA, 4326 nt, synthetic construct
  misc_feature 1..4326: note = derived and/or modified CDS sequence (opt5) from LACV(LAC22988-89)__U18980.1__GP
  source 1..4326: mol_type = other RNA
atgatctgcattctggtgctcatcaccgtcgccgctgccagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagagtcatgtgcaaatccaagggcccggcctctatccttagcatcattacggctgtgctggttctcaccttcgtgacacccatcaactccatggtcctgggggaaagcaaagagacctttgagcttgaagatctgcctgacgacatgctcgagatggcctctcggattaattcctattacctgacatgtatcctgaactatgctgtgagctggggactcgtcattatcggcctgcttattggccttctcttcaagaagtaccaacaccgctttctgaatgtgtatgccatgtactgcgaagagtgtgatatgtaccacgacaaatctgggcttaagagacatggagatttcaccaacaaatgccggcagtgtacgtgcggccagtatgaagacgccgctgggctgatggcgcaccgcaagacatacaattgcctcgttcagtataaagccaagtggatgatgaacttcctgatcatctacatttttctgatcctcattaaggatagcgctatcgtggtccaagccgccggaaccgacttcaccacatgtctggagaccgagtccattaactggaattgcacaggcccctttcttaacctggggaattgtcagaaacagcaaaagaaagaaccttatacgaacatcgctacccagctcaagggactgaaagccatctctgtgctggatgttcccattatcacaggcattccggacgatatcgcgggcgctcttagatacattgaggaaaaggaggacttccatgtgcagctcaccatcgaatatgccatgctgagcaagtactgcgattactatacacagttttccgacaatagcgggtactctcaaaccacgtggcgggtctatctgagatcccacaacttcgaggcctgtatcctctaccctaatcagcatttttgccgctgtgtgaaaaacggagagaagtgctctagctccaattgggacttcgctaacgaaatgaaagattattacagcggcaagcagaccaaatttgacaaggatctgaatcttgccctgacagctctccaccacgccttccgggggacctcctctgcgtatattgccacaatgctgagcaagaaatccaacgacgatctgatcgcttacaccaataagattaaaacgaagtttcccggaaacgcccttctcaaagctatcattgactacatcgcctatatgaagtctctgcctggcatggcgaatttcaaatacgatgagttttgggacgaactgctctataagcccaaccccgccaaggctagcaacctggccagagggaaagagtccagctacaatttcaagctggctatctcttccaaaagcattaagatctgtaaaaacgtgaaggatgttgcctgcctgtctcctcgctccggcgccatttatgctagcatcattgcgtgtggagaaccgaatggcccctctgtctaccggaagcctagcgggggagtgttccagtccagcacagacagatctatctattgcctcctggattcccattgcctggaggagtttgaagccattggccaagaggaacttgacgctgtgaaaaagagcaaatgttgggagatcgagtaccccgatgtcaagctcatccaggaaggggacggaaccaaatcctgccgcatgaaggactctggcaactgtaatgtggccacaaaccggtggcctgttattcagtgcgagaatgataagttctactatagcgaactgcagaaagactacgataaggcccaagacatcgggcactattgtctgtcccccggctgcaccaccgtgagatacccgattaaccctaaacatatctctaattgtaactggcaggtcagccgctcctctattgctaagatcgatgtgcacaatatcgaggacattgaacagtataaaaaggccatcacacagaagctccaaacgagcctgtccctttttaaatacgcgaagaccaaaaacctgccccacattaagcctatctataaatacattacaatcgagggaaccgagacagctgaaggcatcgagagcgcctacattgaatctgaggttcccgccctcgctgggacctccatcggattcaagattaatagcaaagaaggcaagcatctgctggatgtgatcgcctatgtcaagtctgcgtcctacagctctgtgtatacgaaactttactccacagggcctaccagcggaattaacaccaagcacgacgagctctgcacaggcccctgtccggctaatatcaaccatcaggttgggtggctgacctttgcccgggagagaacatccagctggggctgcgaagagttcggatgtctggccgtgtctgatggctgcgtctttgggagctgccaggacattatcaaagaggaactctccgtgtatcgcaaggaaacggaggaggtgaccgatgtcgaactgtgtcttacattctctgacaaaacctactgcacaaacctgaatcctgttacccccatcattacggatctctttgaggtgcaattcaagaccgtggaaacatatagcctgccccggatcgtcgctgtgcagaaccacgagattaagatcggacagattaatgacctgggcgtttactccaaagggtgtggaaacgtgcagaaggtcaatggcaccatctacgggaacggcgtgcctagatttgactatctttgccatctggcctctcggaaagaggttatcgtgcgcaagtgtttcgataatgactaccaggcttgcaaatttctccaaagcccggcctcctatagactggaagaggattctggaacagtcaccattatcgactacaagaagattctcggcacaatcaaaatgaaggcgattctgggggatgtgaaatataagaccttcgccgacagcgttgatatcacggctgaaggatcctgtacaggctgcatcaactgtttcgagaatattcactgcgaacttaccctgcacaccacaatcgaggccagctgtcccattaaatcttcctgcaccgtgtttcatgaccggatcctcgtcacgcctaacgagcacaagtacgctctgaagatggtgtgcacagaaaaacccgggaataccctgacaattaaggtgtgtaacaccaaagtcgaggccagcatggcccttgttgatgctaagcctatcattgaactggcgcccgtggaccagacagcctatatcagagagaaagatgaacgctgcaagacctggatgtgtcgggtgagagacgagggactccaggtcatcctggagcctttcaagaatctctttggctcttacattggcatcttctacacgtttattatctccattgtggttctgcttgtgatcatctatgtcctgctccccatttgcttcaaactgcgcgacaccctgagaaagcatgaagatgcttacaaacgggagatgaagatccgctga

SEQ ID NO: 14305 - RNA, 4326 nt, synthetic construct
  misc_feature 1..4326: note = derived and/or modified CDS sequence (opt5) from LACV(LAC30928-31)__U18979.1__GP
  source 1..4326: mol_type = other RNA
atgatctgcattctggtgctcatcaccgtcgccgctgccagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcaccatctacaataagagctgcaagaaatgcaagctctgtgggctggtttaccatccctttaccgagtgcggaacacactgtgtgtgcggcgcccgctatgatacgtctgacagaatgaaactgcatcgggcttccgggctctgtcctggatacaagagcctgcgcgccgcgagagtcatgtgcaaatccaagggcccggcctctattcttagcatcatcaccgctgtgctggttctcacattcgtgacccccattaactccatggtcctgggggaaagcaaagagacatttgagcttgaagatctgcctgacgacatgctcgagatggcctctcggatcaattcctattacctgacctgtattctgaactatgctgtgagctggggactcgtcatcattggcctgcttatcggccttctcttcaagaagtaccaacaccgctttctgaatgtgtatgccatgtactgcgaagagtgtgatatgtaccacgacaaatctgggcttaagagacatggagatttcacgaacaaatgccggcagtgtacatgcggccagtatgaagacgccgctgggctgatggcgcaccgcaagacctacaattgcctcgttcagtataaagccaagtggatgatgaacttcctgattatctacatctttctgattctcatcaaggatagcgctattgtggtccaagccgccggaaccgacttcacaacctgtctggagacagagtccatcaactggaattgcacgggcccctttcttaacctggggaattgtcagaaacagcaaaagaaagaaccttataccaacattgctacacagctcaagggactgaaagccatctctgtgctggatgttcccatcattaccggcatcccggacgatattgcgggcgctcttagatacatcgaggaaaaggaggacttccatgtgcagctcacaattgaatatgccatgctgagcaagtactgcgattactatacccagttttccgacaatagcgggtactctcaaacgacctggcgggtctatctgagatcccacgacttcgaggcctgtatcctctaccctaaccagcatttttgccgctgtgtgaaaaatggagagaagtgctctagctccaaccgggatttcgctaatgaaatgaaagactattacagcggcaagcagacaaaatttgataaggacctgaaccttgccctgaccgctctccaccacgccttcagagggacatcctctgcgtatatcgccaccatgctgagcaagaaatccaatgatgacctgattgcttacacgaacaagatcaaaacaaagtttcccggaaatgcccttctcaaagctattatcgattacattgcctatatgaagtctctgcctggcatggcgaacttcaaatacgacgagttttgggatgaactgctctataagcccaatcccgccaaggctagcaacctggcccgcgggaaagagtccagctacaacttcaagctggctatctcttccaaaagcatcaagatttgtaaaaatgtgaaggacgttgcctgcctgtctcctcggtccggcgccatctatgctagcattatcgcgtgtggagaaccgaacggcccctctgtctacagaaagcctagcgggggagtgttccagtccagcaccgatccctctatttattgcctcctggactcccattgcctggaggagtttgaagccatcggccaagaggaacttgatgctgtgaaaaagagcaaatgttgggagattgagtaccctgacgtcaagctcatccaggaaggggacggaacaaaatcctgccgcatgaaggattctggcaattgtaacgtggccaccaatcggtggcccgttatccagtgcgagaacgacaagttctactatagcgaactgcagaaagattacgacaagacccaagatattgggcactattgtctgtccccgggctgcacaacggtgagataccctatcaatcccaaacatatttctaactgtaattggcaggtcagccgctcctctatcgccaagattgacgtgcacaacatcgaggatatcgaacagtataaaaaggctattacccagaagctccaaacaagcctgtccctttttaaatacgccaagaccaaaaatctgcctcacatcaagcccatttataaatacatcacaattgagggaaccgagacggcggaaggcatcgagagcgcttacatcgaatctgaggttcctgccctcgccgggacatccattggattcaagatcaacagcaaagaaggcaagcatctgctggacgtgattgcttatgtcaagtctgcctcctacagctctgtgtataccaaactttactccaccgggcccacaagcggaatcaataccaagcacgatgagctctgcacaggcccgtgtcctgcgaacattaatcatcaggttgggtggctgacgtttgctcgggagagaacctccagctggggctgcgaagagttcggatgtctggccgtgtctgacggctgcgtctttgggagctgccaggatatcattaaagaggaactctccgtgtatcgcaaggaaacagaggaggtgaccgacgtcgaactgtgtcttacattctctgataaaacctactgcacgaacctgaaccccgttacccccatcatcacagacctctttgaggtgcaattcaagaccgtggaaacatatagcctgcctcggattgtcgccgtgcagaatcacgagatcaagattggacagatcaacgacctgggcgtttactccaaagggtgtggaaatgtgcagaaggtcaacggcaccatttacgggaatggcgtgccgagatttgattatctttgccatctggcttctcggaaagaggttatcgtgcgcaagtgtttcgacaacgattaccaagcctgcaaatttctccagagccccgcttcctatagactggaagaggactctggaacagtcaccatcattgattacaagaagatcctcggcacgattaaaatgaaggccatcctgggggacgtgaaatataagacattcgcggatagcgttgacattaccgccgaaggatcctgtaccggctgcatcaattgtttcgagaacatccactgcgaacttacactgcacaccacgattgaggctagctgtcctatcaaatcttcctgcacagtgtttcatgatcggattctcgtcacccccaatgagcacaagtacgccctgaagatggtgtgcacagaaaaacctgggaacaccctgacaatcaaggtgtgtaataccaaaattgaggctagcatggcccttgtcgacgccaagcccatcattgaactggctcctgttgatcagacggcgtatatcagagagaaagacgaacgctgcaagacctggatgtgtcgggtgagagacgagggactccaggtgatcctggagcccttcaagaacctctttggctcttacattggcatcttctacacatttattatctccattgtcgccctgcttgtgatcatctatgttctgctcccgatttgcttcaaactgcgcgataccctgagaaagcatgaagacgcttacaaacgggagatgaagatccgctga

SEQ ID NO: 14306 - RNA, 4326 nt, synthetic construct
  misc_feature 1..4326: note = derived and/or modified CDS sequence (opt5) from LACV(LAC76-40)__U70206.1__GP
  source 1..4326: mol_type = other RNA
atgatctgcattctggtgctcatcaccgtcgccgctgccagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagagtcatgtgcaaatccaagggcccggcctctatccttagcatcattacggctgtgctggttctcaccttcgtgacacccatcaactccatggtcctgggggaaagcaaagagacctttgagcttgaagatctgcctgacgacatgctcgagatggcctctcggattaattcctattacctgacatgtatcctgaactatgctgtgagctggggactcgtcattatcggcctgcttattggccttctcttcaagaagtaccaacaccgctttctgaatgtgtatgccatgtactgcgaagagtgtgatatgtaccacgacaaatctgggcttaagagacatggagatttcaccaacaaatgccggcagtgtacgtgcggccagtatgaagacgccgctgggctgatggcgcaccgcaagacatacaattgcctcgttcagtataaagccaagtggatgatgaacttcctgatcatctacatttttctgatcctcattaaggatagcgctatcgtggtccaagccgccggaaccgacttcaccacatgtctggagaccgagtccattaactggaattgcacaggcccctttcttaacctggggaattgtcagaaacagcaaaagaaagaaccttatacgaacatcgctacccagctcaagggactgaaagccatctctgtgctggatgttcccattatcacaggcattccggacgatatcgcgggcgctcttagatacattgaggaaaaggaggacttccatgtgcagctcaccatcgaatatgccatgctgagcaagtactgcgattactatacacagttttccgacaatagcgggtactctcaaaccacgtggcgggtctatctgagatcccacgacttcgaggcctgtatcctctaccctaaccagcatttttgccgctgtgtgaaaaatggagagaagtgctctagctccaactgggatttcgctaatgaaatgaaagactattacagcggcaagcagaccaaatttgataaggacctgaaccttgccctgacagctctccaccacgccttccgggggacctcctctgcgtatattgccacaatgctgagcaagaaatccaatgatgacctgatcgcttacaccaacaagattaaaacgaagtttcccggaaatgcccttctcaaagctatcattgattacatcgcctatatgaagtctctgcctggcatggcgaacttcaaatacgacgagttttgggatgaactgctctataagcccaatcccgccaaggctagcaacctggccagagggaaagagtccagctacaacttcaagctggctatctcttccaaaagcattaagacatgtaaagacgtgaaggatgttgcctgcctgtctcctcgctccggcgccatctatgctagcattatcgcgtgtggagaaccgaatggcccctctgtctaccggaagcctagcgggggagtgttccagtccagcaccgacagatctatttattgcctcctggattcccattgcctggaggagtttgaagccatcggccaagaggaacttgacgctgtgaaaaagagcaaatgttgggagattgagtaccccgacgtcaagctcatccaggaaggggatggaacaaaatcctgccgcatgaaggactctggcaactgtaatgtggccaccaaccggtggcctgttatccagtgcgagaatgataagttctactatagcgaactgcagaaagactacgataagacccaagacattgggcactattgtctgtcccccggctgcacaacggtgagatacccgatcaaccctaaacatatttctaattgtaactggcaggtcagccgctcctctatcgccaagattgatgtgcacaatatcgaggacatcgaacagtataaaaaggctattacccagaagctccaaacaagcctgtccctttttaaatacgccaagaccaaaaacctgccccacatcaagcctatttataaatacatcacaattgagggaaccgagacggcggaaggcatcgagagcgcttacatcgaatctgaggttcccgccctcgccgggacatccattggattcaagatcaatagcaaagaaggcaagcatctgctggatgtgattgcttatgtcaagtctgcctcctacagctctgtgtatgcgaaactttactccaccgggcctaccagcggaatcaacacaaagcacgacgagctctgcaccggcccctgtccggctaatattaaccatcaggttgggtggctgacatttgcccgggagagaacgtccagctggggctgcgaagagttcggatgtctggccgtgtctgatggctgcgtctttgggagctgccaggacatcattaaagaggaactctccgtgtatcgcaaggaaaccgaggaggtgacagatgtcgaactgtgtcttaccttctctgacaaaacatactgcaccaatctgaaccctgttacgcccatcatcaccgacctctttgaggtgcaattcaagacagtggaaacctatagcctgccccggattgtcgctgtgcagaaccacgagatcaagattggacagatcaatgatctgggcgtttactccaaagggtgtggaaacgtgcagaaggtcaatggcacaatttacgggaacggcgtgcctagatttgactatctttgccatctggcctctcggaaagaggttatcgtgcgcaagtgtttcgataatgactaccaggcttgcaaatttctccaaagcccggcctcctatagactggaagaggattctggaaccgtcacaatcattgactacaagaagatcctcggcaccattaaaatgaaggcgatcctgggggatgtgaaatataagacgttcgccgacagcgttgatattacagctgaaggatcctgtaccggctgcatcaactgtttcgagaatatccactgcgaacttaccctgcacacaaccattgaggccagctgtcccatcaaatcttcctgcacggtgtttcatgaccggattctcgtcacacctaacgagcacaagtacgctctgaagatggtgtgcaccgaaaaacccgggaatacactgaccatcaaggtgtgtaacacaaaaattgaggccagcatggcccttgtcgatgctaagcctatcattgaactggcgcccgttgaccagaccgcctatatcagagagaaagacgaacgctgcaagacgtggatgtgtcgggtgagagatgagggactccaggtgatcctggagcctttcaagaatctctttggctcttacattggcatcttctacacctttattatctccattgtcgctctgcttgtgatcatctatgttctgctccccatttgcttcaaactgcgcgacacactgagaaagcatgaagatgcctacaaacgggagatgaagatccgctga

SEQ ID NO: 14307 - RNA, 4326 nt, synthetic construct
  misc_feature 1..4326: note = derived and/or modified CDS sequence (opt5) from LACV(LAC79-283)__U70207.1__GP
  source 1..4326: mol_type = other RNA
atgatccggattctggtgctcatcgccgtcaccgctgccagccccgtttaccagagatgcttccaagacggcgcgattgtgaagcagaacccttccaaagaggctgtgacagaagtctgtctgaaggatgacgtgtctatgatcaaaacggaggcccgctatattagaaatgccaccggggtttttagcaacaatgtggctatccggaagtggcttgtctccgattggcacgactgccgcccgaaaagaatcattggaggccatatcaacgtgattgaagttggggatgacctgtctctccacacagagagctacgtgtgttccgccgattgcaccatcggagtcgacaaggaaacagctcaggtgcggctgcagaccgatacaaccaatcatttcgagattgccggcacgaccgtgaagtctgggtggtttaaaagcacaacctatatcacacttgaccaaacctgtgagcacctgaaggtctcctgcggacccaaaagcgttcagttccatgcgtgttttaaccagcacatgtcttgcgtgcgcttcctccacagaacgattctgcctggctccatcgccaatagcatctgtcagaacattgaaatcattatcctggtgacactcaccctgcttatttttatcctgctctctatcctgtccaagacatacatttgctatcttctgatgcccatcttcattcctatcgcttacatttatggcatcatctacaataaaagctgtaagaagtgcaaactctgcgggctggtctaccatccctttaccgagtgtggaacccactgcgtgtgtggcgcccggtatgatacatctgaccgcatgaagctgcatagagcttccgggctctgccctggatacaaaagcctgcgggccgcgcgcgttatgtgtaagtccaaaggcccggcctctattcttagcatcattacggctgtgctggtcctcaccttcgtgacacccatcaactccatggttctgggggaaagcaaggagacctttgagcttgaagaactgcctgatgacatgctcggaatggcctctagaattaattcctattacttcacatgcatcctgaactatgctgtgagctggggcctggtcattatcggcctcctgaccgggcttctgtttaaaaagtaccaacaccggttcctcaatgtgtatgccatgtactgtgaagagtgcgacatgtaccacgataagtctggactgaaacgccatggcgacttcacgaacaagtgtagacagtgcacatgtgggcagtatgaagatgccaccggacttatggctcaccggaaaacctacaattgcctggtccagtataaggcgaaatggatgatgaactttctcgtgatctacattttcctgatcctgattaaggacagcgccatcgttgtgcaagctgccggcacagattttaccacatgcctcgagacggagtccattaactggaattgtaccgggcccttcctgaaccttggaaattgccagaagcagcagaaaaaggaaccttatacaaacatcgccacccaactgaaaggcctcaaggctatctctgtcctggacattcccatcattacaggcatcccggatgacattgccggggcgctgagatacatcgaggaacgcgaggattttcatgtgcagcttaccatcgaatatgctatgctcagcaaatactgtgactactatacgcagttctccgataatagcggatactctcaaaccacatggcgggtttatctgagatcccacgactttgaggcctgcattctgtaccctaaccagcatttctgtcgctgcgtgaagaatggcgagaagtgttctagctccaactgggactttgccaatgaaatgaaagatttctatagcgggaagcagaccaaatttgacaaggatctcaacctggctcttacagccctgcaccacgctttccggggaacctcctctgcctacatcgcgacgatgctcagcaaaaagtccaatgacgatctgattgcctatacaaacaagatcaaaaccaagtttcccggcaatgctctgcttaaagccattatcgactacatcgcttacatgaagtctctccctgggatggccaacttcaaacatgatgagttctgggacgaactgctgtataagcccaatcccgcgaaagccagcaacctcgctagaggcaaggagtccagctacaactttaagctggccatttcttccaaaagcatcaagacatgcaaaaatgtcaaggatgtggcttgtctttctcctcgctccggagccatttatgccagcatcattgcttgcggcgaaccgaacgggccctctgtgtaccggaaacctagcggaggcgttttccagtccagcaccgacagatctatctattgtctgctcgattcccactgcctggaggagtttgaagcgattagccaagaggaactggacgccgtcaagaagtccaaatgctgggagatcgagtaccccgatgtgaagcctcttcaggaaggggacggaaccaaatcttgtcgcatgaaggacagcggcaattgcaacgtggctacaaatcggtggcccgtcatccagtgtgagaacgataaattctattactccgaactccagaaggactacgataagacgcaagacattgggcattattgcctgtctccgggctgtaccacagtgagataccctatcaatcccaaacacattagcaactgcaattggcaggtttcccgctctagcatcgccaagattgatgtgcacaacatcgaggacatcgaacagtataaaaaggccattacccagaaactgcaaacatccctcagcctgtttaagtacgctaagaccaaaaatcttcctcatatcaagcccatttataaatacatcacgattgagggaacagagaccgccgaaggcatcgagtctgcgtatatcgaatccgaggtccctgctctggccgggaccagcattggattcaagatcaactctaaagaaggcaagcacctcctggatgtgattgcctacgttaaatccgctagctactcttccgtgtatgccaagctgtacagcacagggcccacctccggaatcaatacaaagcatgacgagctttgtacgggcccgtgccctgcgaacattaatcaccaggtcgggtggctcacctttgctcgggagagaacaagctcttggggctgtgaagagttcggatgcctggccgtgagcgatggctgtgtttttgggtcctgccaggacatcattaaagaggagctgtctgtgtatcggaaggaaaccgaggaggtcacagatgtggaactctgcctgaccttcagcgacaaaacgtactgtaccaaccttaaccccgtgacacccatcatcaccgatctgtttgaggtccaattcaatacagttgaaacctattccctccctcgcattgtggccgtgcagaaccatgagatcaagattggacagatcaatgacctgggcgtctactctaaagggtgcggaaacgtgcagaaggttaatggcacagtgtatgggaacggcgtcccgagatttgactacctgtgtcaccttgctagccggaaggaggtgattgttagaaaatgcttcgataatgactaccaagcctgtaagttcctgcagtcccccgcttcttatcgcctcgaagaggatagcggaaccgtgacgatcatcgactacaaaaagattctgggcacaatcaaaatgaaggccattctcggggatgtcaagtataaaacctttgcggactccgtggatatcaccgccgaaggaagctgcacaggctgtattaactgcttcgagaatatccactgtgaactgacccttcatacgacaatcgaggcttcttgccctattaagtccagctgtaccgtttttcacgaccggatcctggtgacacccaacgagcctcagtacgccctcaaaatggtctgcaccgaaagacccgggaatacactgaccattaaggtgtgcaacacgaaaatcgaggcttctatggccctggtggatgccaagcctattatcgaacttgctcccgtcgaccagaccgcgtatattcgcgagaaggatgaaagatgtaaaacatggatgtgccgggttcgcgacgagggactgcaagtgatcctcgagccgttcaagaatctgtttggctcctacatcggcattttctatacctttatcattagcatggtggccctcctggtcatcatttacgtgcttctgcctatctgtttcaaactcagagacacactgcggaagcatgaagatgcttacaaacgcgagatgaagatcagatga

SEQ ID NO: 14308 - RNA, 4326 nt, synthetic construct
  misc_feature 1..4326: note = derived and/or modified CDS sequence (opt5) from LACV(LAC81-4)__U70208.1__GP
  source 1..4326: mol_type = other RNA
atgatccggattctggtgctcatcgccgtcaccgctgccagccccgtttaccagagatgcttccaagacggcgcgattgtgaagcagaacccttccaaagaggctgtgacagaagtctgtctgaaggatgacgtgtctatgatcaaaacggaggcccgctatattagaaatgccaccggggtttttagcaacaatgtggctatccggaagtggcttgtctccgattggcacgactgccgcccgaaaaagatcattggaggccatatcaacgtgattgaagttggggatgacctgtctctccacacagagagctacgtgtgttccgccgattgcaccatcggagtcgacaaggaaacagctcaggtgagactgcagaccgatacaaccaatcatttcgagattgccggcacgaccgtgaaatctgggtggtttaagagcacaacctatatcacacttgaccaaacctgtgagcacctgaaagtctcctgcggacccaagagcgttcagttccatgcgtgttttaaccagcacatgtcttgcgtgcggttcctccaccgcacgattctgcctggctccatcgccaatagcatctgtcagaacattgaaatcattatcctggtgacactcaccctgcttatttttatcctgctctctatcctgtccaaaacatacatttgctatcttctgatgcccatcttcattcctatcgcttacgtctatggcattatctacaataagagctgtaagaaatgcaagctctgcgggctggtgtaccatccctttaccgagtgtggaacccactgcgtttgtggcgccagatatgatacatctgaccggatgaaactgcatcgcgcttccgggctctgccctggatacaagagcctgagagccgcgcgggtgatgtgtaaatccaagggcccggcctctatccttagcattatcacggctgtcctggtgctcaccttcgttacacccattaactccatggtgctgggggaaagcaaagagacctttgagcttgaagaactgcctgatgacatgctcggaatggcctctcgcatcaattcctattacttcacatgcattctgaactatgctgtcagctggggcctggtgatcattggcctcctgaccgggcttctgtttaagaagtaccaacacagattcctcaatgtctatgccatgtactgtgaagagtgcgacatgtaccacgataaatctggactgaagcggcatggcgacttcacgaacaaatgtcgccagtgcacatgtgggcagtatgaagatgccaccggacttatggctcacagaaagacctacaattgcctggtgcagtataaagcgaagtggatgatgaactttctcgttatctacatcttcctgattctgatcaaggacagcgccattgtggtccaagctgccggcacagattttaccacatgcctcgagacggagtccatcaactggaattgtaccgggcccttcctgaaccttggaaattgccagaaacagcaaaagaaagaaccttatacaaacattgccacccagctgaagggcctcaaagctatctctgtgctggacatccccattatcacaggcattccggatgacatcgccggggcgctgcggtacattgaggaaagagaggattttcatgttcagcttaccatcgaatatgctatgctcagcaagtactgtgactactatacgcagttctccgataatagcggatactctcaaaccacatggcgcgtgtatctgcggtcccacgactttgaggcctgcatcctgtaccctaaccagcatttctgtagatgcgtcaagaatggcgagaaatgttctagctccaactgggactttgccaatgaaatgaaggatttctatagcgggaaacagaccaagtttgacaaagatctcaacctggctcttacagccctgcaccacgctttccgcggaacctcctctgcctacattgcgacgatgctcagcaagaagtccaatgacgatctgatcgcctatacaaacaaaattaagaccaaatttcccggcaatgctctgcttaaggccatcattgactacatcgcttacatgaaatctctccctgggatggccaacttcaagcatgatgagttctgggacgaactgctgtataaacccaatcccgcgaaggccagcaacctcgctcggggcaaggagtccagctacaactttaaactggccatctcttccaagagcattaaaacatgcaagaatgtgaaagatgtggcttgtctttctcctagatccggagccatctatgccagcattatcgcttgcggcgaaccgaacgggccctctgtttaccgcaagcctagcggaggcgtcttccagtccagcaccgaccggtctatttattgtctgctcgattcccactgcctggaggagtttgaagcgatcagccaagaggaactggacgccgtgaagaaatccaagtgctgggagattgagtaccccgatgtgaaacctcttcaggaaggggacggaaccaagtcttgtagaatgaaagacagcggcaattgcaacgtcgctacaaatcgctggcccgtgatccagtgtgagaacgataagttctattactccgaactccagaaggactacgataaaacgcaagacatcgggcattattgcctgtctccgggctgtaccacagttcggtaccctattaatcccaagcacatcagcaactgcaattggcaagtgtccagatctagcattgccaaaatcgatgtccacaacattgaggacatcgaacagtataagaaagccatcacccagaagctgcagacatccctcagcctgtttaagtacgctaaaaccaagaatcttcctcatattaaacccatctataagtacattacgatcgagggaacagagaccgccgaaggcattgagtctgcgtatatcgaatccgaggtgcctgctctggccgggaccagcatcggattcaaaattaactctaaggaaggcaaacacctcctggatgttatcgcctacgtgaagtccgctagctactcttccgtctatgccaagctgtacagcacagggcccacctccggaattaatacaaaacatgacgagctttgtacgggcccgtgccctgcgaacatcaatcaccaggtggggtggctcacctttgctcgcgagcggacaagctcttggggctgtgaagagttcggatgcctggccgttagcgatggctgtgtgtttgggtcctgccaggacattatcaaggaggagctgtctgtctatagaaaagaaaccgaggaggtgacagatgtggaactctgcctgaccttcagcgacaagacgtactgtaccaaccttaaccccgtcacacccattatcaccgatctgtttgaggttcaattcaaaacagtggaaacctattccctccctcggatcgtggccgtccagaatcatgagattaagatcggacagattaacgacctgggcgtgtactctaaggggtgcggaaatgttcagaaagtgaacggcacagtctatgggaatggcgtgccgcgctttgactacctgtgtcaccttgctagcagaaaggaggttatcgtgcggaaatgcttcgataacgactaccaagcctgtaagttcctgcagtcccccgcttcttatagactcgaagaggatagcggaaccgtcacgattatcgactacaaaaagatcctgggcacaattaagatgaaagccatcctcggggatgtgaagtataaaacctttgcggactccgttgatattaccgccgaaggaagctgcacaggctgtatcaattgcttcgagaacattcactgtgaactgacccttcatacgacaatcgaggcttcttgccctatcaagtccagctgtaccgtgtttcacgaccgcattctggtcacacccaatgagcctcagtacgccctcaaaatggtgtgcaccgaacggcccgggaacacactgaccatcaaggtgtgcaatacgaagattgaggcttctatggccctggtcgatgccaaacctatcattgaacttgctcccgttgaccagaccgcgtatatcagagagaaggatgaacgctgtaaaacatggatgtgcagagtgcgggacgagggactgcaagtgattctcgagccgttcaagaacctgtttggctcctacatcggcatcttctatacctttattatcagcatggtcgccctcctggtgattatctacgttcttctgcctatttgtttcaaactccgcgacacactgagaaagcatgaagatgcttacaagcgggagatgaaaatccgctga

SEQ ID NO: 14309 - RNA, 4326 nt, synthetic construct
  misc_feature 1..4326: note = derived and/or modified CDS sequence (opt5) from LACV(LACR56869)__U70205.1__GP
  source 1..4326: mol_type = other RNA
atgatctgcattctggtgctcatcaccgtcgccgctgccagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagagtcatgtgcaaatccaagggcccggcctctatccttagcatcattacggctgtgctggttctcaccttcgtgacacccatcaactccatggtcctgggggaaagcaaagagacctttgagcttgaagatctgcctgacgacatgctcgagatggcctctcggattaattcctattacctgacatgtatcctgaactatgctgtgagctggggactcgtcattatcggcctgcttattggccttctcttcaagaagtaccaacaccgctttctgaatatctatgccatgtactgcgaagagtgtgatatgtaccacgacaaatctgggcttaagagacatggagatttcaccaacaaatgccggcagtgtacgtgcggccagtatgaagacgccgctgggctgatggcgcaccgcaagacatacaattgcctcgtgcagtataaagccaagtggatgatgaacttcctgatcatttacatctttctgattctcatcaaggatagcgctattgttgtgcaagccgccggaaccgacttcaccacatgtctggagaccgagtccatcaactggaattgcacaggcccctttcttaacctggggaattgtcagaaacagcaaaagaaagaaccttatacgaacatcgctacccagctcaagggactgaaagccatttctgtcctggatgtgcccatcattacaggcatcccggacgatattgcgggcgctcttagatacatcgaggaaaaggaggacttccatgttcagctcaccatcgaatatgccatgctgagcaagtactgcgattactatacacagttttccgacaatagcgggtactctcaaaccacgtggcgggtgtatctgagatcccacgacttcgaggcctgtattctctaccctaaccagcatttttgccgctgtgtcaaaaatggagagaagtgctctagctccaactgggatttcgctaatgaaatgaaagactattacagcggcaagcagaccaaatttgataaggacctgaaccttgccctgacagctctccaccacgccttccgggggacctcctctgcgtatatggccacaatgctgagcaagaaatccaatgatgacctgatcgcttacaccaacaagattaaaacgaagtttcccggaaatgcccttctcaaagctatcattgattacatcgcctatatgaagtctctgcctggcatggcgaacttcaaatacgacgagttttgggatgaactgctctataagcccaatcccgccaaggctagcaacctggccagagggaaagagtccagctacaacttcaagctggctatctcttccaaaagcattaagacatgtaaaaatgtgaaggacgtggcctgcctgtctcctcgctccggcgccatctatgctagcattatcgcgtgtggagaaccgaacggcccctctgtttaccggaagcctagcgggggagtcttccagtccagcaccgatagatctatttattgcctcctggactcccattgcctggaggagtttgaagccatcggccaagaggaacttgatgctgtgaaaaagagcaaatgttgggagattgagtaccccgacgtgaagctcatccaggaaggggacggaacaaaatcctgccgcatgaaggattctggcaattgtaacgtcgccaccaatcggtggcctgtgatccagtgcgagaacgacaagttctactatagcgaactgcagaaagattacgacaagacccaagatattgggcactattgtctgtcccccggctgcacaacggttagatacccgatcaatcctaaacatatttctaactgtaattggcaagtgagccgctcctctatcgccaagattgacgtccacaacatcgaggatatcgaacagtataaaaaggctattacccagaagctccagacaagcctgtccctttttaaatacgccaagaccaaaaatctgccccacatcaagcctatttataaatacatcacaattgagggaaccgagacggcggaaggcatcgagagcgcttacatcgaatctgaggtgcccgccctcgccgggacatccattggattcaagatcaacagcaaagaaggcaagcatctgctggacgttattgcttatgtgaagtctgcctcctacagctctgtctataccaaactttactccaccgggcctacaagcggaatcaataccaagcacgatgagctctgcacaggcccctgtccggcgaacattaatcatcaggacgggtggctgacgtttgctcgggagagaacctccagctggggctgcgaagagttcggatgtctggccgtgtctgatggctgcgtttttgggagctgccaggacatcattaaagaggaactctccgtgtatcgcaaggaaacagaggaggtcaccgatgtggaactgtgtcttacattctctgacaaaacctactgcacgaacctgaaccctgtgacccccatcatcacagacctctttgaggtccaattcaagaccgttgaaacatatagcctgccccggattgtggccgtgcagaatcacgagatcaagattggacagatcaacgatctgggcgtctactccaaagggtgtggaaatgtgcagaaggttaacggcaccatttacgggaatggcgtgcctagatttgactatctttgccatctggcttctcggaaagaggtcatcgtgcgcaagtgtttcgataacgactaccaagcctgcaaatttctccagagcccggcttcctatagactggaagaggattctggaacagttaccatcattgactacaagaagatcctcggcacgattaaaatgaaggccatcctgggggatgtgaaatataagacattcgcggacagcgtcgatattaccgccgaaggatcctgtaccggctgcatcaattgtttcgagaacatccactgcgaacttacactgcacaccacgattgaggctagctgtcccatcaaatcttcctgcacagtgtttcatgaccggattctcgttacccctaatgagcacaagtacgccctgaagatggtgtgcacagaaaaacccgggaacaccctgacaatcgaggtctgtaataccaagattgaagctagcatggcccttgtggatgccaaacctatcattgagctggctcccgtggaccagacgacctatatcagagaaaaggacgagcgctgcaaaacatggatgtgtcgggtcagagatgagggactccaggttatcctggaacctttcaagaacctctttggctcttacattggcatcttctacacctttattatctccattgtggcgctgcttgtgatcatctatgtcctgctccccatttgcttcaagctgcgcgacacactgagaaaacatgaggatgcctacaagcgggaaatgaaaatccgctga

SEQ ID NO: 14310 - RNA, 4326 nt, synthetic construct
  misc_feature 1..4326: note = derived and/or modified CDS sequence (opt5) from LACV(NAT_Crawford_WI_2007)__GU596383.1__GP
  source 1..4326: mol_type = other RNA
atgatccggattctggtgctcatcgccgtcaccgctgccagccccgtttaccagagatgcttccaagacggcgcgattgtgaagcagaacccttccaaagaggctgtgacagaagtctgtctgaaggatgacgtgtctatgatcaaaacggaggcccgctatgttagaaatgccaccggggtgtttagcaacaatgtcgctattcggaagtggcttgtgtccgattggcacgactgccgcccgaaaaagatcatcggaggccatattaacgttatcgaagtgggggatgacctgtctctccacacagagagctacgtctgttccgccgattgcaccattggagtggacaaggaaacagctcaggtgagactgcagaccgatacaaccaatcatttcgagatcgccggcacgaccgtcaaatctgggtggtttaagagcacaacctatattacacttgaccaaacctgtgagcacctgaaagtttcctgcggacccaagagcgtgcagttccatgcgtgttttaaccagcacatgtcttgcgtgcggttcctccaccgcacgatcctgcctggctccattgccaatagcatctgtcagaacatcgaaattatcattctggtcacactcaccctgcttatctttattctgctctctatcctgtccaaaacatacatctgctatcttctgatgcccattttcatccctattgcttacgtgtatggcatcatttacaataagagctgtaagaaatgcaagctctgcgggctggtttaccatccctttaccgagtgtggaacccactgcgtgtgtggcgccagatatgatacatctgaccggatgaaactgcatcgcgcttccgggctctgccctggatacaagagcctgagagccgcgcgggtcatgtgtaaatccaagggcccggcctctatccttagcatcattacggctgtgctggttctcaccttcgtgacacccatcaactccatggtcctgggggaaagcaaagagacctttgagcttgaagaactgcctgatgacatgctcgaaatggcctctcgcattaattcctattacttcacatgcatcctgaactatgctgtgagctggggactggtcattatcggcctcctgaccggccttctgtttaagaagtaccaacacagattcctcaatgtgtatgccatgtactgtgaggaatgcgacatgtaccacgataaatctgggctgaagcggcatggagacttcacgaacaaatgtcgccagtgcacatgtggccagtatgaggatgccaccgggcttatggctcacagaaagacctacaattgcctggttcagtataaagcgaagtggatgatgaactttctcattatctacatcttcctgattctgatcaaggacagcgccattgtggtccaagctgccggaacagattttaccacatgcctcgagacggaatccatcaactggaattgtaccggccccttcctgaaccttgggaattgccagaaacagcaaaagaaagagccttatacaaacattgccacccagctgaagggactcaaagctatctctgtgctggacatccccattatcacaggcattccggatgacatcgccggcgcgctgcggtacattgaagagagagaagattttcatgttcagcttaccatcgagtatgctatgctcagcaagtactgtgactactatacgcagttctccgataatagcgggtactctcaagccacctggcgcgtgtatctgcggtcccacgactttgaggcctgcatcctgtaccctaaccagcatttctgtagatgcgtcaagaatggagaaaaatgttctagctccaactgggactttgctaatgagatgaaggatttctatagcggcaaacagacaaagtttgacaaagatctcaacctggcccttaccgctctgcaccacgccttccgcgggacatcctctgcgtacattgccaccatgctcagcaagaagtccaatgacgatctgatcgcttatacgaacaaaattaagacaaaatttcccggaaatgccctgcttaaggctatcattgactacatcgcctacatgaaatctctccctggcatggcgaacttcaagtatgatgagttctgggacgagctgctgtacaaacccaatcccgccaaggctagcaacctcgcccgggggaaggaatccagctataactttaaactggctatctcttccaagagcattaaaacctgcaagaatgtgaaagatgtggcctgtctttctcctagatccggcgccatctacgctagcattatcgcgtgcggagagccgaacggcccctctgtttatcgcaagcctagcgggggagtcttccagtccagcacagaccggtctatttactgtctgctcgattcccattgcctggaggaatttgaggccatcagccaagaagaactggacgctgtgaagaaatccaagtgctgggagattgaatatcccgatgtgaaacctcttcaggagtctgacggcaccaagagctgtagaatgaaagactccgggaattgcaacgtcgccaccaatcgctggcccgtgatccagtgtgaaaacgataagttctactactctgagctccagaaggactatgataaaacacaagacatcggacactactgcctgagcccgggctgtacgaccgttcggtatcctattaatcccaagcatatctccaactgcaattggcaagtgtctagaagctccattgccaaaatcgatgtccacaacattgaagacatcgagcagtacaagaaagctatcacacagaagctgcaaaccagcctctctctgtttaagtatgccaaaacaaagaatcttcctcacattaaacccatctacaagtatattaccatcgaggggacggaaacagcggagggcattgaatccgcttacatcgagagcgaagtgcctgccctggccggaacctctatcggcttcaaaattaactccaaggaggggaaacatctcctggatgttatcgcttacgtcaagagcgcctcttattccagcgtgtacgcgaagctgtattccaccggacccacaagcggcattaataccaaacacgacgagctttgtacagggccgtgccctgctaacatcaatcatcaggtgggatggctcacgtttgcccgcgaacggacctctagctggggctgtgaggagttcgggtgcctggccgtttccgatggctgtgtgtttggatcttgccaggacattatcaaggaggaactgagcgtctacagaaaagagacagaggaagtgaccgatgtggagctctgcctgacattctccgacaagacctattgtacgaaccttaaccccgtcacccccattatcacagatctgtttgaagttcaattcaaaaccgtggagacatactctctccctcggatcgtggctgtccagaatcacgagattaagatcggccagattaacgacctgggggtgtatagcaagggatgcggcaatgttcagaaagtgaacgggaccgtctacggaaatggcgtgccgcgctttgactacctgtgtcatcttgcctccagaaaggaagttatcgtgcggaaatgcttcgataacgactatcaggcttgtaagttcctgcagtctcccgccagctacagactcgaggaagattccgggacagtcaccattatcgactataaaaagatcctgggcacgattaagatgaaagcgatcctcggagatgtgaagtacaaaacatttgccgacagcgttgatattaccgctgagggctcttgcaccgggtgtatcaattgcttcgaaaacattcactgtgagctgacacttcacaccacgatcgaggcctcctgccctatcaagagctcttgtacagtgtttcatgaccgcattctggtcacccccaatgaacacaaatatgctctcaagatggtgtgcacagagcggcctggaaacaccctgacaatcaaggtgtgcaataccaaaattgaagcctccatggccctggtcgatgctaagcccatcattgagcttgcgcctgttgaccagacggcctacatcagagaaaaagatgagcgctgtaagacctggatgtgcagagtgcgggacgagggcctccaggtgattctggaacccttcaaaaacctgtttgggagctatatcggaatcttctacacatttattatctccattgtcgctctcctggtgatcatttacgttcttctgccgatctgtttcaagctccgcgacaccctgagaaagcatgaggatgcctataaacgggaaatgaagatccgctga

SEQ ID NO: 14311 - RNA, 4326 nt, synthetic construct
  misc_feature 1..4326: note = derived and/or modified CDS sequence (opt5) from LACV(77)__DQ196119.1__GP
  source 1..4326: mol_type = other RNA
atgatctgcattctggtgctcatcaccgtcgccgctgccagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttgagagcacaacctatatcacacttgaccaaacctgcgaacacctgaaggtgtcctgtggacccaaaagcgtgcagttccatgcgtgctttaaccagcacatgtcttgtgtcagattcctccaccggacgattctgcctggctccatcgccaatagcatttgccagaacatcgagatcattatcctggtgacactcaccctgcttatttttatcctgctctctattctgtccaagacatacatctgttatcttctgatgcccatcttcattcctatcgcttacatttatggcaccatctacaataaaagctgcaagaagtgcaaactctgtgggctggtttaccatccctttaccgaatgcggaacacactgtatttgcggcgcccgctatgatacgtctgacagaatgaagctgcatcgggcttccgggctctgtcctggatacaaaagcctgcgcgccgcgagagtgatgtgcaagtccaaaggcccggcctctatccttagcatcattaccgctgtcctggtgctcacattcgttacccccatcaactccatggtgctgggggagagcaaggagacatttgaacttgaggatctgcctgacgacatgctcgaaatggcctctcggattaattcctattacctgacctgtatcctgaactatgctgtcagctggggactcgtgattatcggcctgcttattggccttctcttcaaaaagtaccaacaccgctttctgaatgtctatgccatgtactgcgaggaatgtgatatgtaccacgacaagtctgggcttaaaagacatggagatttcacgaacaagtgccggcagtgtacatgcggccagtatgaggacgccgctgggctgatggcgcaccgcaaaacctacaattgcctcgtgcagtataaggccaaatggatgatgaacttcctgatcatctacatttttctgatcctcattaaggatagcgctatcgttgtgcaagccgccggaaccgacttcacaacctgtctggagacagaatccattaactggaattgcacgggcccctttcttaacctggggaattgtcagaagcagcagaaaaaggagccttataccaacatcgctacacagctcaaaggactgaaggccatctctgtcctggatgtgcccattatcaccggcattccggacgatatcgcgggcgctcttagatacattgaagagaaagaagacttccatgttcagctcacaatcgagtatgccatgctgagcaagtactgcgattactatacccagttttccgacaatagcgggtactctcaaacgacctggcgggtgtatctgagatcccacgacttcgaggcctgtatcctctaccctaaccagcatttttgccgctgtgtcaagaatggagaaaaatgctctagctccaaccgggatttcgctaatgagatgaaggactattacagcggcaaacagacaaagtttgataaagacctgaaccttgccctgaccgctctccaccacgccttcagagggacatcctctgcgtatattgccaccatgctgagcaagaagtccaatgatgacctgatcgcttacacgaacaaaattaagacaaaatttcccggaaatgcccttctcaaggctatcattgattacatcgcctatatgaaatctctgcctggcatggcgaacttcaagtacgacgaattttgggatgagctgctctataaacccaatcccgccaaggctagcaacctggcccgcgggaaggaatccagctacaacttcaaacttgctatctcttccaagagcattaaaacctgtaagaatgtgaaagacgtggcctgcctgtctcctcggtccggcgccatctatgctagcattatcgcgtgtggagagccgaacggcccctctgtttacagaaagcctagcgggggagtcttccagtccagcacagatcaatctatttattgcctcctggactcccattgcctggaggaatttgaggccatcggccaggaagaacttgatgctgtgaagaaaagcaagtgttgggagattgaataccccgacgtgaaactcatccaggagggggacggaaccaagtcctgccgcatgaaagattctggcaattgtaacgtcgccaccaatcggtggcctgtgatccagtgcgaaaacgacaagttctactatagcgagctgcaaaaggattacgacaaaacacaggatattgggcactattgtctgtcccccggctgcacgaccgttagatacccgatcaatcctaagcatatttctaactgtaattggcaagtgagccgctcctctatcgccaaaattgacgtccacaacatcgaagatatcgagcagtataagaaagctattacacaaaagctccagaccagcctgtccctttttaagtacgccaaaacaaagaatctgccccacatcaaacctatttataagtacatcaccattgagggaacggaaacagcggagggcatcgaaagcgcttacatcgagtctgaagtgcccgccctcgccgggacctccattggattcaaaatcaacagcaaggagggcaaacatctgctggacgttattgcttatgtgaagtctgcctcctacagctctgtctataccaagctgtactccacagggcctaccagcggaatcaatacaaaacacgatgagctctgcacgggcccctgtccggcgaacattaatcatcaggtggggtggctgacctttgctcgggaaagaacatccagctggggctgcgaggagttcggatgtctggccgtttctgacggctgcgtgtttgggagctgccaagatatcattaaggaggaactctccgtctatcgcaaagagaccgaggaagtgacagacgtggagctgtgtcttaccttctctgataagacgtactgcaccaacctgaaccctgtcacacccatcatcaccgacctctttgaagttcagttcaaaacagtggaggcctatagcctgccccggattgtggctgtccagaatcacgagatcaagattggacagatcaacgacctgggcgtgtactccaaggggtgtggaaatgttcaaaaagtgaacggcaccatttacgggaatggcgtccctagatttgattatctttgccatctggcctctcggaaggaagtgatcgttcgcaaatgtttcgacaacgattaccaggcttgcaagtttctccagagcccggcctcctatagactggaggaagactctggaacagtgaccatcattgattacaaaaagatcctcggcacgattaagatgaaagcgatcctgggggacgtcaagtataaaacattcgccgatagcgtggacattaccgctgagggatcctgtaccggctgcatcaattgtttcgaaaacatccactgcgagcttacactgcacaccacgattgaggccagctgtcccatcaagtcttcctgcacagtttttcatgatcggattctcgtgacccctaatgaacacaaatacgctctgaagatggtctgcacagagaagcccgggaacaccctgacaatcaaagtgtgtaataccaagattgaagccagcatggcccttgtggacgctaaacctatcattgagctggcgcccgtcgatcagacggcctatatcagagaaaaggacgagcgctgcaaaacctggatgtgtcgggttagagacgagggactccaagtgatcctggaacctttcaagaacctctttggctcttacattggcatcttctacacatttattatctccattgtggctctgcttgtcatcatctatgtgctgctccccatttgcttcaagctgcgcgataccctgagaaaacatgaggacgcctacaagcgggaaatgaaaatccgctga

SEQ ID NO: 14312 - RNA, 4326 nt, synthetic construct
  misc_feature 1..4326: note = derived and/or modified CDS sequence (opt5) from LACV(LACV/00/NC-M (NC00-283))__GU206112.1__GP
  source 1..4326: mol_type = other RNA
atgatccggattctggtgctcatcgccgtcaccgctgccagccccgtttaccagcggtgcttccaagacggcgcgattgtgaagcagaacccttccaaagaggctgtgacagaagtctgtctgaaggatgacgtgtctatgatcaaaacggaggcccgctatgttagaaatgccaccggggtgtttagcaacaatgtcgctattcggaagtggcttgtgtccgattggcacgactgccgcccgaaaaagatcatcggaggccatattaacgttatcgaagtgggggatgacctgtctctccacacagagagctacgtctgttccgccgattgcaccattggagtggacaaggaaacagctcaggtgagactgcagaccgatacaaccaatcatttcgagatcgccggcacgaccgtcaaatctgggtggtttaagagcacaacctatattacacttgaccaaacctgtgagcacctgaaagtttcctgcggacccaagagcgtgcagttccatgcgtgttttaaccagcacatgtcttgcgtgcggttcctccaccgcacgatcctgcctggctccattgccaatagcatctgtcagaacatcgaaattatcattctggtcacactcaccctgcttatctttattctgctctctatcctgtccaaaacatacatctgctatcttctgatgcccattttcatccctattgcttacatgtatggcatcatttacaataagagctgtaagaaatgcaagctctgcgggctggtgtaccatccctttaccgagtgtggaacccactgcgtttgtggcgccagatatgatacatctgaccggatgaaactgcatcgcgcttccgggctctgccctggatacaagagcctgagagccgcgcgggtgatgtgtaaatccaagggcccggcctctatccttagcatcattacggctgtcctggtgctcaccttcgttacacccatcaactccatggtgctgggggaaagcaaagagacctttgagcttgaagaactgcctgatgacatgctcgaaatggcctctcgcattaattcctattacttcacatgcatcctgaactatgctgtcagctggggactggtgattatcggcctcctgaccggccttctgtttaagaagtaccaacacagattcctcaatgtctatgccatgtactgtgaggaatgcgacatgtaccacgataaatctgggctgaagcggcatggagacttcacgaacaaatgtcgccagtgcacatgtggccagtatgaggatgccgctgggcttatggcgcacagaaagacctacaattgcctggtgcagtataaagccaagtggatgatgaactttctcattatctacatcttcctgattctgatcaaggacagcgctattgttgtgcaagccgccggaaccgattttacaacctgcctcgagacagaatccatcaactggaattgtacgggccccttcctgaaccttgggaattgccagaaacagcaaaagaaagagccttataccaacattgctacacagctgaagggactcaaagccatctctgtcctggacatccccattatcaccggcattccggatgacatcgcgggcgctctgaagtacattgaagagagagaagattttcatgtgcagcttacaatcgagtatgccatgctcagcaagtactgtgactactatacccagttctccgataatagcgggtactctcaaacgacctggagagtttatctgcgctcccacgactttgaggcctgcatcctgtaccctaaccagcatttctgtcggtgcgtgaaaaatggagaaaagtgttctagctccaactgggactttgctaatgagatgaaagattattacagcggcaagcagacaaaattcgacaaggatctcaacctggcccttaccgctctgcaccacgcctttagagggacatcctctgcgtatattgccaccatgctcagcaagaaatccaatgacgatctgatcgcttacacgaacaagattaaaacaaagttccccggaaatgccctgcttaaagctatcattgactacatcgcctatatgaagtctctccctggcatgaccaactttaaatacgataagttctgggacgaactgctgtataagcccaatcccgcgaaagccagcaacctcgctcgcgggaaggagtccagctacaacttcaaactggccatctcttccaagagcattaaaacatgcaagaatgtcaaggatgtggcttgtctttctcctcggtccggcgccatctatgccagcattatcgcttgcggagaaccgaacggcccctctgtgtacagaaaacctagcgggggagtttttcagtccagcaccgaccgctctatttattgtctgctcgattcccattgcctggaggagttcgaagcgatcaatcaagaggaactggacgccgtcaagaaaagcaagtgctgggagattgagtactccgatgtgaaaccccttcaggaaggcgacgggaccaagtcttgtcggatgaaggacagcggaaactgcaatgtggctacaaacagatggcctgtcatccagtgtgagaatgataaattttactattccgaactccagaaggactacgataaaacgcaagacatcggccactattgcctgtctcccgggtgtaccacagtgcgctacccgattaaccctaagcatatcagcaattgcaactggcaggtttcccggtctagcattgccaaaatcgatgtgcacaatattgaggacatcgaacagtataagaaggccatcacccagaaactgcaaacatccctcagcctgttcaagtacgctaaaaccaagaaccttccccacattaaacctatctataagtacattacgatcgagggcacagagaccgccgaaggaattgagtctgcgtacatcgaatccgaggtccccgctctggccggcaccagcatcgggtttaaaattaattctaaggaaggaaagcatctcctggatgtgatcgcctatgttaaatccgctagctactcttccgtgtatgccaagctgtacagcacaggccctacctccgggattaacacaaaacacgacgagctttgtacgggaccctgcccggcgaatatcaaccatcaggtcggctggctcaccttcgctaaggagagaacaagctcttgggggtgtgaagagtttggctgcctggccgtgagcgatggatgtgttttcggctcctgccaggacattatcaaagaggagctgtctgtgtatcgcaaggaaaccgaggaggtcacagatgtggaactctgcctgacctttagcgacaagacgtactgtaccaaccttaatcctgtgacacccattatcaccgatctgttcgaggtccaatttaaaacagttgaaacctattccctcccccggatcgtggccgtgcagaaccacgagattaagatcgggcagattaatgacctgggagtctactctaaaggctgcgggaacgtgcagaaggttaatggaacagtgtacggcaacggggtccctagattcgactatctgtgtcatcttgctagccggaaagaggtgatcgttcgcaagtgctttgataatgactaccaagcctgtaagttcctgcagtccccggcttcttatagactcgaagaggatagcggcaccgtgacgattatcgactacaaaaagatcctgggaacaattaaaatgaaggccatcctcggcgatgtcaaatataagaccttcgcggacaacgtggatattaccgccgaagggtcctgcacaggatgtatcaattgctttgagaacattcactgtgaactgacccttcacacgacaatcgaggctagctgccccatcaagtcttcctgtaccgttttccatgaccggattctggtgacacctagcgagcacaaatacgccctcaagatggtctgcaccgaaaaacccggcaatacactgaccatcaaggtgtgcaacacgaaaattgaggcttctatggccctggtggatgccaagcctatcattgaacttgctcccgtcgaccagaccgcgtatatcagagagaaggatgaacgctgtaaaacatggatgtgccgggttagagacgaggggctccaggtgattctggagccttttaagaatctgttcggatcctacatcggcatcttttacaccttcattatcagcattatggccctcctggtgatcatttatgtccttctgcccatctgttttaaactccgcgacacactgagaaagcatgaagatgcttacaaacgggagatgaagatccgctga

SEQ ID NO: 14313 - RNA, 4326 nt, synthetic construct
  misc_feature 1..4326: note = derived and/or modified CDS sequence (opt5) from LACV(LACV/00/WV-M (WV00-3178))__GU206148.1__GP
  source 1..4326: mol_type = other RNA
atgatccggattctggtgctcatcgccattaccgctgccagccccgtctaccagagatgcttccaagacggcgcgatcgttaagcagaacccttccaaagaggctgtgacagaagtgtgtctgaaggatgacgtctctatgattaaaacggaggcccgctatgtgagaaatgccaccggggtttttagcaacaatgtggctatccggaagtggcttgtctccgattggcacgactgccgcccgaaaaagatcattggaggccatatcaacgtgattgaagttggggatgacctgtctctccacacagagagctacgtgtgttcctctgattgcaccatcggagtcgacaaggaaacagcccaggtgagactgcagaccgatacaaccaatcatttcgagattgctggcacgaccgtgaaaagcgggtggtttaagtccacaacctatatcacacttgaccaaacctgtgagcacctgaaagtcagctgcggacccaagtctgttcagttccatgcctgttttaaccagcacatgtcctgcgtgcggttcctccaccgcacgattctgcctggcagcatcgcgaatagcatctgtcagaacattgaaatcattatcctggtgacactcaccctgcttatttttatcctgctctccatcctgagcaaaacatacatttgctatcttctgatgcccatcttcattcctatcgcctacatttatggcatcatctacaataagtcttgtaagaaatgcaagctctgcgggctggtctaccatccctttaccgagtgtggaacccactgcgtgtgtggcgctagatatgatacatccgaccggatgaaactgcatcgcgccagcgggctctgccctggatacaagtccctgagagctgcccgggttatgtgtaaatctaagggcccggcgagcattctttccatcattacggccgtgctggtcctcaccttcgtgacacccatcaacagcatggttctgggggaatctaaagagacctttgagcttgaagaactgcctgatgacatgctcgaaatggcttcccgcattaatagctattacctgacatgcatcctgaactatgccgtgtcttggggactcgtcattatcggcctgcttaccggccttctcttcaagaagtaccaacacagatttctgaatacgtatgctatgtactgtgaggaatgcgacatgtaccacgataaaagcgggcttaagcggcatggagacttcacaaacaaatgtcgccagtgcacctgtggccagtatgaggatgccgccgggctgatgacccacagaaagacatacaattgcctcgtgcagtataaagctaagtggatgatgaacttcctgatcatttacatctttctgattctcatcaaggactccgcgattatcgtccaagccgctggaaccgatttcacaacgtgcctggagaccgaatctatcaactggaattgtacaggcccctttcttaacctggggaattgccagaaacagcaaaagaaagagccttataccaacattgccacacagctcaagggactgaaagccatcagcgtgctggacattcccatcattaccggcatcccggatgacatcgctggcgcccttcggtacattgaagagagagaagatttccatgttcagctcacgaccgagtatgcgatgctgtcccgctactgtgactactatacacagtttagcgataattctcggtactcccaaaccacatggagagtgtatctgcgcagccacgacttcgaggcttgcatcctctaccctaaccagcatttttgtcggtgcgtcaagaatggggaaaagtgttcttccagcaactgggacttcgccaatgagatgaaagattattactccggaaagcagaccaaatttgacaaggatctgaaccttgccctgacggctctccaccacgccttcagaggcacatctagcgcttatattgccaccatgctgtccaaaaagtctaatgacgatctgatcacatacaccaacaagattaaaaccaagtttcccgggaatgcgcttctcaaagccatcatcgactacattgcttatatgaagtctctgcctggaatggccaacttcaaatacgatgaattttgggacgagctgctctataagcccaatcccgctaaaacatccaacctggcccgcggcaaggaaagcacgtacaacttcaagctggcgatctcttccaaaagcattaagacctgcaaaaatgtgaaggatgttgcctgtctgtctcctcggtccggggctatctatgccagcattatcgcttgcggcgagccgaacggaccctctgtgtacagaaaacctagcggcggggtcttccagtccagcacagaccgctctatttattgtctcctggattcccattgcctggaggaatttgaggccatcagccaagaggagcttgacgccgtgaagaagtccaaatgctgggagaccgaataccccgaggtgaagcctctccaggaatctgatggaacaaaaagctgtcggatgaaggactccggcaattgcaacgttgctaccaatagatggcccgtcatccagtgtgagaacgacaaattctactattctgaactgcagaaggattacgacaagacgcaagatattgggcactattgcctgagcccgggatgtacaaccgtgcgctaccctatcaatcccaaacatatttccaactgcaattggcaagtgtctcggagctccatcgcgaagattgacgtccacaacatcgaggatatcgagcagtataaaaaggccattacccagaaactccagacaagcctgtctctttttaagtacgctaagaccaaaaatctgcctcacatcaagcccatttataaatacatcacaattgaaggcacggagaccgccgaagggatcgagtccgcctacatcgaaagcgaggtgcctgctctcgccggcacatctattggattcaagatcaactccaaagagggcaagcatctgctggacgttattgcgtatgtgaaaagcgcttcttactccagcgtctatgccaaactttactccaccgggcccacaagcggaatcaataccaagcacgatgaactctgtacgggcccgtgccctgccaacattaatcatcagatcgggtggctgacctttgctaaggagagaacatctagctggggatgtgaagagttcggctgcctggccgtgtccgacgggtgtgtttttggctcttgccaggatattatcaaggaggaactcagcgtgtatcggaaagagaccgaagaggtcacagacgtggaactgtgccttaccttctccgataagacatactgtaccaacctgaaccccgttacgcccatcattacagacctctttgaggtgcaattcaaaaccgtcgagacctattctctgcctcgcatcgtggcggtgcagaatcacgaaattaagatcggacagattaacgatctgggcgtctacagcaaggggtgcggaaatgttcagaaagtgaacggcacagtgtacgggaatggagtcccgagatttgactatctttgtcatctggcttcccggaaggaggtgatcgttagaaaatgcttcgacaacgattaccaagcctgtaagtttctccagtctcccgccagctatcgcctggaagaggactccggcaccgtgacgatcattgattacaaaaagatcctcgggacaattaagatgaaagctatcctgggcgacgtcaagtataaaaccttcgccgaaagcgtggatattacagctgagggatcttgcaccggctgtatcaattgcttcgagaacatccactgtgaacttacactgcacaccacgattgaggcctcctgccctatcaagagctcttgtaccgtttttcatgaccggattctcgtgacacccaatgaacacaaatacgcgctgaagatggtctgcaccgagagacctgggaacacactgaccatcaaggtgtgcaatacgaaaattgaagcctccatgacacttgttgatgctaagcccatcattgagctggcccctgtggaccagaccgcttatatccgcgagaaagatgaaagatgtaagacatggatgtgccgggtccgcgacgagggactccaggtgatcctggaacccttcaaaaacctctttggcagctacattgggatcttctacacctttattatctccattgtggccctgcttgtcatcatctatgttctgctcccgatttgtttcaagctgagagataccctgcggaagcatgaggacgcctacaaacgcgaaatgaagatcagatga

SEQ ID NO: 14314 - RNA, 4326 nt, synthetic construct
  misc_feature 1..4326: note = derived and/or modified CDS sequence (opt5) from LACV(LACV/03/NY-M (41030016))__GU206130.1__GP
  source 1..4326: mol_type = other RNA
atgatctacattctggtgctcatcgccgtcaccgctgccagccccgtttatcagagatgcttccaagacggcgcgattgtgaagcagaacccttccaaagaggctgtgacagaagtctgtctgaaggatgacgtgtctatgatcaaaacggaggcccggtacattcgcaatgccaccggggtttttagcaacaatgtggctatcagaaagtggcttgtctccgattggcacgactgccggccgaaaaagatcgtgggaggccatattaacgttatcgaagtgggggatgacctgtctctccacacagagagctatgtctgttccgccgattgcaccattggagtggacaaggaaacagctcaggtgcgcctgcagaccgatacaaccaatcatttcgagatcgccggcacgaccgtcaaatctgggtggtttaagagcacaacctacattacacttgaccaaacctgtgagcacctgaaagtttcctgcggacccaagagcatccagttccatgcgtgttttaaccagcacatgtcttgcgtgagattcctccaccggacgattctgcctggctccatcgccaatagcatctgtcagaacattgaaatcattatcctggtgacactcaccctgcttatttttatcctgctctctatcctgtccaaaacatatatttgctaccttctgatgcccgtcttcatccctattgcttatgtgtacggcatcatttacaataagagctgtaagaaatgcaagctctgcgggctggtttatcatccctttaccgagtgtggaacccactgcgtgtgtggcgcccgctacgatacatctgacagaatgaaactgcatcgggcttccgggctctgccctggatataagagcctgcgcgccgcgagagtcatgtgtaaatccaagggcccggcctctatccttagcatcattacggctgtgctggttctcaccttcgtgacacccatcaactccatggtcctgggggaaagcaaagaggtgtttgagcttgaagaactgcctgatgacatgctcgaaatggccctgcggattaatttctactattttacctgcatcctgaactacgctgtctcttggtccctcgtgattatcggactgcttacaggcctcctgttcaagcgctatcaacacaagttcctgaatatttacgccatgtactgtgaggaatgcgacatgtatcacgataaaagcggccttaagagacatggggactttaccaacaaatgtcggcagtgcacgtgtggacagtacgaggatgccacaggcctgatgacccaccgcaagacctataattgcctcgttcagtacaaagctaagtggatcatgaacttcctgatcatttatatctttctggtgctcattaaggactctgcgatcattgtccaagccgctgggacagatttcagctcctgcctggagaccgaatctatcaactggaattgtacaggaccctttcttaacctgggcaattgccagaaacagcaaaagaaagagccttacacgaacatcgccgcccagctcaaggggctgagagctattagcgtgctggacatccccatgattaccgaaatcccggatgacattgcctccgcgcttcggtatatcgaggaaagagaggctttccatgttcagctcacagccgagtacgccatgctgacccgctactgtgattattacacacagtttagcgacaattctggatattcccaaaccacgtggcgggtgtacctgagaagccacgatttcgaggcttgcatcatgtatcctaaccagcatttttgtcgctgcgtcaaaaatggcgagaagtgttcttccagcaactgggacttcgccaatgaaatgaaggactactattccggcaaacaggctaagtttgataaagacctcaacctggcccttaccgcgctgcaccacgccttccgggggacatctagcgcttacattgccgctatgctctccaagaaatctaatgatgacctgatcacctacacaaacaagattaagaccaaatttcccggaaatgccctgcttaaggcgatcattgattatatcgcctacatgaaaggcctccctgggatggctagcttcaagcatgacgagttctgggatgaactgctgtataaacccacgcccacaaaggcccctaacctcgctagaggacgcgagtccagctacaattttaaactggccatctcttccaagagcattaagacctgcaaaaacgtgaaggacgtggcctgtctttctccgcggtccggcgctatctatgcgagcattatcgcctgcggggagcccaacggcccttctgtttacagaaaacccagcaatggagtcttccagtccagcacagatcaatctatgtattgtctgctcgactcccactgcctggaagagtttgaagctattagccaggaggagctggatgccgtgaagaaatccaagtgctgggaaatcgagtaccctgacattaagccccttcaggaatctgatggcaccaaaagctgtcgcatgaaggactccgggaactgcaatgtggccaccaaccggtggccggtcatccagtgtgagaatgacaaattctactattctgaactccaaaaggattacgacaaaacacaggatatcggacattattgcctgagccctggctgtacgaccgtgagataccccattaaccctaagcacatctccaattgcaactggcaggtttctcgcagctccattgctaagatcgacgtgcacaatattgaggatatcgagcagtataaaaaggccatcacacaaaaactgcagaccagcctctctctgtttaagtacgcgaaaacaaagaaccttccccatattaagcctatctataaatacattaccatcgaagggacggagacagctgaaggaattgagtccgcctacatcgaaagcgaggtccccgccctggctggcacctctatcgggttcaagattaattccaaagagggcaagcacctcctggacgtgatcgcctatgttaaaagcgcgtcttactccagcgtgtataccaagctgtactccacaggaccgaccagcggcattaacacaaaacatgatgaactttgtacggggccttgccccgctaatatcaaccaccaggtcggatggctcacctttgccaaggagcggacatctagctggggctgtgaagagttcgggtgcctggccgtgtccgacggatgtgtttttggctcttgccaagatattatcaaggaggaactgagcgtgtatagaaaagagaccgaagaggtcacagacgtggaactctgcctgaccttctccgataagacgtactgtaccaatcttaaccccgtgacacctattatcaccgacctgtttgaggtccagttcaaaacagttgagacctattctctcccgcggatcgtggctgtgcagaaccatgaaattaagatcgggcagattaatgatctgggcgtctacagcaaaggatgcggcaacgtgcaaaaggttaatgggacagtgtacggaaacggcgtcccccgctttgactatctgtgtcaccttgcctccagaaaggaggtgatcgttcggaaatgcttcgacaatgattaccaggcttgtaagttcctgcagtctcctgccagctatagactcgaagaggactccgggaccgtgacggtcattgattacaaaaagatcctgggaacaatcaaaatgaaggcgattctcggcgacgtgaagtataaaacctttgccgataacgttgacatcaccgctgaagggagctgcacaggctgtattaattgcttcgagaacatccactgtgagctgacccttcatacgacaattgaagcctcttgccccatcaagtccagctgtaccgtgtttcacgatcgcatcctggtcacacctaatgagcataaatacgctctcaaggtggtgtgcaccgaaaaacccggaaacacactgaccattaaggtctgcaatacgaagatcgaggcctctatggccctggttgacgctaaacctattatcgaacttgcgcccgtggatcagaccgcctatattcgggagaaggacgagagatgtaaaacatggatgtgccgcgtgagagatgaaggcctgcaagtcatcctcgagccgttcaagaacctgtttgggtcctacattggaatcttctacacctttatcattagcatcgtggctctcctggttattatctatattcttctgcctatctgtttcaaactccgggacacactgcgcaagcacgaagacgcctacaagagagagatgaaaatccggtga

SEQ ID NO: 14315 - RNA, 4326 nt, synthetic construct
  misc_feature 1..4326: note = derived and/or modified CDS sequence (opt5) from LACV(LACV/06/NY(1)-M (06MS2900303))__GU206118.1__GP
  source 1..4326: mol_type = other RNA
atgatctacattctggtgctcatcgccgtcaccgctgccagccccgtttatcagagatgcttccaagacggcgcgattgtgaagcagaacccttccaaagaggctgtgacagaagtctgtctgaaggatgacgtgtctatgatcaaaacggaggcccggtacattcgcaatgccaccggggtttttagcaacaatgtggctatcagaaagtggcttgtctccgattggcacgactgccggccgaaaaagatcgtgggaggccatattaacgttatcgaagtgggggatgacctgtctctccacacagagagctatgtctgttccgccgattgcaccattggagtggacaaggaaacagctcaggtgcgcctgcagaccgatacaaccaatcatttcgagatcgccggcacgaccgtcaaatctgggtggtttaagagcacaacctacattacacttgaccaaacctgtgagcacctgaaagtttcctgcggacccaagagcatccagttccatgcgtgttttaaccagcacatgtcttgcgtgagattcctccaccggacgattctgcctggctccatcgccaatagcatctgtcagaacattgaaatcattatcctggtgacactcgctctgcttatttttatcctgctctctatcctgtccaaaacctatatttgctaccttctgatgcccgtcttcatccctattgcctatgtgtacggcgttatctacaataagagctgtaagaaatgcaagctctgcgggctggtgtatcatccctttacagagtgtggaacccactgcgtctgtggcgctcgctacgatacctctgacagaatgaaactgcatcgggcctccgggctctgccctggatataagagcctgcgcgcggccagagtgatgtgtaaatccaagggcccggcttctattcttagcatcatcacagccgttctggtgctcacgttcgtcacccccattaactccatggtgctgggggaaagcaaagaggtctttgagcttgaagaactgcctgatgacatgctcgaaatggctctgcggatcaatttctactattttacatgcattctgaactacgccgtgtcttggtccctcgttatcattggactgcttaccggcctgctgttcaagcgctatcaacacaagttcctgaatatctacgccatgtactgtgaggaatgcgacatgtatcacgataaaagcggccttaagagacatggggactttacaaacaaatgtcggcagtgcacctgtggacagtacgaggatgctacgggcctgatgacacaccgcaagacctataattgcctcgtgcagtacaaagcgaagtggattatgaacttcctgatcatctatatttttctggtcctcatcaaggactctgccattatcgtgcaagctgccgggaccgatttcagctcctgcctggagacagaatctattaactggaattgtaccggaccctttcttaacctgggcaattgccagaaacagcaaaagaaagagccttacgccaacatcgctgcccagctcaaggggctgaaagcgatcagcgttctggacattcccatgatcacagaaattccggatgacatcgcttccgcccttagatatattgaggaacgggaggccttccatgtgcagctcacggctgagtacgccatgctgaccagatactgtgattattacacacagtttagcgacaattctggatattcccaaaccacatggcgcgtctacctgcggagccacgatttcgaggcttgcatcatgtatcctaaccagcatttttgtagatgcgtgaagaatggcgagaagtgttcttccagcaactgggacttcgccaatggcatgaaagactactattccgggaagcaggcgaaatttgataaggacctcaacctggcccttaccgctctgcaccacgccttccgcggaacgtctagcgcttacatcgccaccatgctctccaaaaagtctaatgatgacctgattgcgtacacaaacaagatcaaaaccaagtttcccggcaatgccctgcttaaagctattatcgattatattgcctacatgaaggggctccctggaatggctaacttcaaacatgacgagttctgggatgagctgctgtataagcccacacccaccaaagcccctaatctcgcccggggcagagaaagctcctacaactttaagctggctatcagctctaagtccatcaaaacgtgcaagaacgtgaaagacgttgcgtgtcttagcccgcgctctggggccatttatgcttccatcattgcctgcggcgagcccaatggacctagcgtctaccggaagcccctgaacggcgtgttccagtctagcacagatcaatccatgtattgtctcctggacagccactgcctggaggaatttgaggccatctctcaggaagaacttgatgctgtgaaaaagtccaagtgctgggagattgaatacagcgacatcaaacctctccaggagtccgatgggaccaagtcttgtagaatgaaagacagcggaaattgcaacgtcgccacaaatcgctggcccgtgattcagtgtgaaaacgacaagttctactattccgagctgcaaaaagattacgacaagacccaggatatcggccattattgcctgtctccggggtgtaccacagttcggtaccctatcaatcccaagcacattagcaactgcaattggcaagtgtccagatctagcatcgcgaaaattgacgtccacaacatcgaagatattgagcagtataagaaagctatcacgcagaagctccagacctccctgagcctttttaaatacgccaagacaaagaatctgcctcatatcaaacccatttataagtacatcaccattgagggaacagaaaccgccgagggcatcgaatctgcttacattgagtccgaagtgcctgccctcgcggggacgagcatcggcttcaaaatcaactctaaggagggaaaacacctcctggacgttattgcttatgtgaagtccgccagctactcttccgtctatacaaaactttacagcaccggccccacctccgggatcaatacaaagcatgatgagctctgtaccggaccgtgccctgccaacattaatcaccaggtgggctggctgacatttgctaaggaacgcacgagctcttgggggtgtgaggagttcggatgcctggccgttagcgacggctgtgtgtttgggtcctgccaagatatcattaaagaagaactctctgtctatcggaaggagaccgaggaagtgacagacgtggagctgtgccttaccttcagcgataaaacatactgtaccaacctgaaccccgtcacgcccatcattaccgacctctttgaagttcagttcaagacagtggagacctattccctgcctagaatcgtggctgtccagaatcatgagatcaaaattggccagatcaacgatctgggagtgtactctaagggctgcgggaatgttcaaaaggtgaacggaacagtctacggcaatggggtgccgcggtttgactatctttgtcacctggccagccgcaaagaagttattgtgagaaagtgcttcgacaacgattaccaggcgtgtaaattcctccagtcccccgcctcttatcggctggaggaagacagcggaaccgtcacagtgatcgattacaagaaaattctcggcaccatcaagatgaaggctatcctgggggacgttaaatataagacgtttgccgataatgtggacattacagctgagggctcctgcaccggatgtatcaactgcttcgaaaatattcactgtgagcttaccctgcatacaaccatcgaggccagctgccctattaaatcttcctgtacggtctttcacgatagaatcctcgtgacacccaacgaacataagtacgccctgaaagtggtctgcaccgagaagcctggcaatacactgaccatcaaggtttgcaacacaaaaattgaagctagcatggcgcttgtggacgccaagcccatcattgagctggctcctgtggatcagaccgcctatatccgcgaaaaagacgagcggtgtaagacgtggatgtgcagagtccgcgatgaggggctccaagtgattctggaacccttcaaaaatctctttggatcttacatcggcattttctacacctttatcatctccattgttacactgcttgtgatcatttatatcctgctcccgatttgtttcaaggtcagagacaccctgcggaagcacgaggacgcctacaaacgcgaaatgaagatcagatga

SEQ ID NO: 14316 - RNA, 4326 nt, synthetic construct
  misc_feature 1..4326: note = derived and/or modified CDS sequence (opt5) from LACV(LACV/06/NY(2)-M (06MS350140))__GU206109.1__GP
  source 1..4326: mol_type = other RNA
atgatctacattctggtgctcatcgccgtcaccgctgccagccccgtttatcagagatgcttccaagacggcgcgattgtgaagcagaacccttccaaagaggctgtgacagaagtctgtctgaaggatgacgtgtctatgatcaaaacggaggcccggtacattcgcaatgccaccggggtttttagcaacaatgtggctatcagaaagtggcttgtctccgattggcacgactgccggccgaaaaagatcgtgggaggccatattaacgttatcgaagtgggggatgacctgtctctccacacagagagctatgtctgttccgccgattgcaccattggagtggacaaggaaacagctcaggtgcgcctgcagaccgatacaaccaatcatttcgagatcgccggcacgaccgtcaaatctgggtggtttaagagcacaacctacattacacttgaccaaacctgtgagcacctgaaagtttcctgcggacccaagagcatccagttccatgcgtgttttaaccagcacatgtcttgcgtgagattcctccaccggacgattctgcctggctccatcgccaatagcatctgtcagaacattgaaatcattatcctggtgacactcgctctgcttatttttatcctgctctctatcctgtccaaaacctatatttgctaccttctgatgcccgtcttcatccctattgcctatgtgtacggcgttatctacaataagagctgtaagaaatgcaagctctgcgggctggtgtatcatccctttacagagtgtggaacccactgcgtctgtggcgctcgctacgatacctctgacagaatgaaactgcatcgggcctccgggctctgccctggatataagagcctgcgcgcggccagagtgatgtgtaaatccaagggcccggcttctattcttagcatcatcacagccgttctggtgctcacgttcgtcacccccattaactccatggtgctgggggaaagcaaagaggtctttgagcttgaagaactgcctgatgacatgctcgaaatggctctgcggatcaatttctactattttacatgcattctgaactacgccgtgtcttggtccctcgttatcattggactgcttaccggcctgctgttcaagcgctatcaacacaagttcctgaatatctacgccatgtactgtgaggaatgcgacatgtatcacgataaaagcggccttaagagacatggggactttacaaacaaatgtcggcagtgcacctgtggacagtacgaggatgctacgggcctgatgacacaccgcaagacctataattgcctcgtgcagtacaaagcgaagtggattatgaacttcctgatcatctatatttttctggtcctcatcaaggactctgccattatcgtgcaagctgccgggaccgatttcagctcctgcctggagacagaatctattaactggaattgtaccggaccctttcttaacctgggcaattgccagaaacagcaaaagaaagagccttacgccaacatcgctgcccagctcaaggggctgaaagcgatcagcgttctggacattcccatgatcacagaaattccggatgacatcgcttccgcccttagatatattgaggaacgggaggccttccatgtgcagctcacggctgagtacgccatgctgaccagatactgtgattattacacacagtttagcgacaattctggatattcccaaaccacatggcgcgtctacctgcggagccacgatttcgaggcttgcatcatgtatcctaaccagcatttttgtagatgcgtgaagaatggcgagaagtgttcttccagcaactgggacttcgccaatgaaatgaaagactactattccggcaagcaggcgaaatttgataaggacctcaacctggcccttaccgctctgcaccacgccttccgcgggacgtctagcgcttacatcgccaccatgctctccaaaaagtctaatgatgacctgattgcgtacacaaacaagatcaaaaccaagtttcccggaaatgccctgcttaaagctattatcgattatattgcctacatgaagggcctccctgggatggctaacttcaaacatgacgagttctgggatgaactgctgtataagcccacacccaccaaagcccctaatctcgcccggggaagagagagctcctacaactttaagctggctatcagctctaagtccatcaaaacgtgcaagaacgtgaaagacgttgcgtgtcttagcccgcgctctggcgccatttatgcttccatcattgcctgcggggagcccaatggccctagcgtctaccggaagcccctgaacggagtgttccagtctagcacagatcaatccatgtattgtctcctggacagccactgcctggaagagtttgaagccatctctcaggaggagcttgatgctgtgaaaaagtccaagtgctgggaaattgagtaccctgacatcaaacccctccaggaaagcgatggcaccaagtcctgtagaatgaaagactctgggaattgcaacgtcgccacaaatcgctggccggtgattcagtgtgagaacgacaagttctactatagcgaactgcaaaaagattacgacaagacccaggatatcggacattattgcctgtcccctggctgtaccacagttcggtaccccatcaatcctaagcacatttctaactgcaattggcaagtgagcagatcctctatcgcgaaaattgacgtccacaacatcgaggatattgagcagtataagaaagctatcacgcagaagctccagaccagcctgtccctttttaaatacgccaagacaaagaatctgccccatatcaaacctatttataagtacatcaccattgaagggacagagaccgccgaaggaatcgagagcgcttacattgaatctgaggtgcccgccctcgcgggcacgtccatcgggttcaaaatcaacagcaaggagggcaaacacctcctggacgttattgcttatgtgaagtctgcctcctacagctctgtctatacaaaactttactccaccggaccgaccagcggcatcaatacaaagcatgatgaactctgtaccgggccttgccccgccaacattaatcaccaggtgggatggctgacatttgctaaggagcgcacgtccagctggggctgtgaagagttcgggtgcctggccgtttctgacggatgtgtgtttggcagctgccaagatatcattaaagaggaactctccgtctatcggaaggagaccgaagaggtgacagacgtggaactgtgccttaccttctctgataaaacatactgtaccaacctgaaccccgtcacgcctatcattaccgacctctttgaggttcagttcaagacagtggagacctatagcctgccgagaatcgtggctgtccagaatcatgaaatcaaaattgggcagatcaacgatctgggcgtgtactccaagggatgcggcaatgttcaaaaggtgaacgggacagtctacggaaatggcgtgccccggtttgactatctttgtcacctggcctctcgcaaagaggttattgtgagaaagtgcttcgacaacgattaccaggcgtgtaaattcctccagagccctgcctcctatcggctggaagaggactctgggaccgtcacagtgatcgattacaagaaaattctcggaaccatcaagatgaaggctatcctgggcgacgttaaatataagacgtttgccgataatgtggacattacagctgaagggagctgcaccggctgtatcaactgcttcgagaatattcactgtgagcttaccctgcatacaaccatcgaagcctcctgccccattaaaagctcttgtacggtctttcacgatagaatcctcgtgacacctaacgagcataagtacgccctgaaagtggtctgcaccgaaaagcccggaaatacactgaccatcaaggtttgcaacacaaaaattgaggcttccatggcgcttgtggacgccaagcctatcattgaactggctcccgtggatcagaccgcctatatccgcgagaaagacgagcggtgtaagacgtggatgtgcagagtccgcgatgaaggcctccaagtgattctggagccgttcaaaaatctctttgggagctacatcggaattttctacacctttatcatctctattgttacactgcttgtgatcatttatatcctgctccctatttgtttcaagctgagagacaccctgcggaagcacgaagacgcctacaaacgcgagatgaagatcagatga

SEQ ID NO: 14317 - RNA, 4326 nt, synthetic construct
  misc_feature 1..4326: note = derived and/or modified CDS sequence (opt5) from LACV(LACV/06/NY(3)-M (06MS270036))__GU206121.1__GP
  source 1..4326: mol_type = other RNA
atgatctacattctggtgctcatcgccgtcaccgctgccagccccgtttatcagagatgcttccaagacggcgcgattgtgaagcagaacccttccaaagaggctgtgacagaagtctgtctgaaggatgacgtgtctatgatcaaaacggaggcccggtacattcgcaatgccaccggggtttttagcaacaatgtggctatcagaaagtggcttgtctccgattggcacgactgccggccgaaaaagatcgtgggaggccatattaacgttatcgaagtgggggatgacctgtctctccacacagagagctatgtctgttccgccgattgcaccattggagtggacaaggaaacagctcaggtgcgcctgcagaccgatacaaccaatcatttcgagatcgccggcacgaccgtcaaatctgggtggtttaagagcacaacctacattacacttgaccaaacctgtgagcacctgaaagtttcctgcggacccaagagcatccagttccatgcgtgttttaaccagcacatgtcttgcgtgagattcctccaccggacgattctgcctggctccatcgccaatagcatctgtcagaacattgaaatcattatcctggtgacactcgctctgcttatttttatcctgctctctatcctgtccaaaacctatatttgctaccttctgatgcccgtcttcatccctattgcctatgtgtacggcgttatctacaataagagctgtaagaaatgcaagctctgcgggctggtgtatcatccctttacagagtgtggaacccactgcgtctgtggcgctcgctacgatacctctgacagaatgaaactgcatcgggcctccgggctctgccctggatataagagcctgcgcgcggccagagtgatgtgtaaatccaagggcccggcttctattcttagcatcatcacagccgttctggtgctcacgttcgtcacccccattaactccatggtgctgggggaaagcaaagaggtctttgagcttgaagaactgcctgatgacatgctcgaaatggctctgcggatcaatttctactattttacatgcattctgaactacgccgtgtcttggtccctcgttatcattggactgcttaccggcctgctgttcaagcgctatcaacacaagttcctgaatatctacgccatgtactgtgaggaatgcgacatgtatcacgataaaagcggccttaagagacatggggactttacaaacaaatgtcggcagtgcacctgtggacagtacgaggatgctacgggcctgatgacacaccgcaagacctataattgcctcgtgcagtacaaagcgaagtggattatgaacttcctgatcatctatatttttctggtcctcatcaaggactctgccattatcgtgcaagctgccgggaccgatttcagctcctgcctggagacagaatctattaactggaattgtaccggaccctttcttaacctgggcaattgccagaaacagcaaaagaaagagccttacgccaacatcgctgcccagctcaaggggctgaaagcgatcagcgttctggacattcccatgatcacagaaattccggatgacatcgcttccgcccttagatatattgaggaacgggaggccttccatgtgcagctcacggctgagtacgccatgctgaccagatactgtgattattacacacagtttagcgacaattctggatattcccaaaccacatggcgcgtctacctgcggagccacgatttcgaggcttgcatcatgtatcctaaccagcatttttgtagatgcgtgaagaatggcgagaagtgttcttccagcaactgggacttcgccaatggcatgaaagactactattccgggaagcaggcgaaatttgataaggacctcaacctggcccttaccgctctgcaccacgccttccgcggaacgtctagcgcttacatcgccaccatgctctccaaaaagtctaatgatgacctgattgcgtacacaaacaagatcaaaaccaagtttcccggcaatgccctgcttaaagctattatcgattatattgcctacatgaaggggctccctggaatggctaacttcaaacatgacgagttctgggatgagctgctgtataagcccacacccaccaaagcccctaatctcgcccggggcagagaaagctcctacaactttaagctggctatcagctctaagtccatcaaaacgtgcaagaacgtgaaagacgttgcgtgtcttagcccgcgctctggggccatttatgcttccatcattgcctgcggcgagcccaatggacctagcgtctaccggaagcccctgaacggcgtgttccagtctagcacagatcaatccatgtattgtctcctggacagccactgcctggaggaatttgaggccatctctcaggaagaacttgatgctgtgaaaaagtccaagtgctgggagattgaatacagcgacatcaaacctctccaggagtccgatgggaccaagtcttgtagaatgaaagacagcggaaattgcaacgtcgccacaaatcgctggcccgtgattcagtgtgaaaacgacaagttctactattccgagctgcaaaaagattacgacaagacccaggatatcggccattattgcctgtctccggggtgtaccacagttcggtaccctatcaatcccaagcacattagcaactgcaattggcaagtgtccagatctagcatcgcgaaaattgacgtccacaacatcgaagatattgagcagtataagaaagctatcacgcagaagctccagacctccctgagcctttttaaatacgccaagacaaagaatctgcctcatatcaaacccatttataagtacatcaccattgagggaacagaaaccgccgagggcatcgaatctgcttacattgagtccgaagtgcctgccctcgcggggacgagcatcggcttcaaaatcaactctaaggagggaaaacacctcctggacgttattgcttatgtgaagtccgccagctactcttccgtctatacaaaactttacagcaccggccccacctccgggatcaatacaaagcatgatgagctctgtaccggaccgtgccctgccaacattaatcaccaggtgggctggctgacatttgctaaggaacgcacgagctcttgggggtgtgaggagttcggatgcctggccgttagcgacggctgtgtgtttgggtcctgccaagatatcattaaagaagaactctctgtctatcggaaggagaccgaggaagtgacagacgtggagctgtgccttaccttcagcgataaaacatactgtaccaacctgaaccccgtcacgcccatcattaccgacctctttgaagttcagttcaagacagtggagacctattccctgcctagaatcgtggctgtccagaatcatgagatcaaaattggccagatcaacgatctgggagtgtactctaagggctgcgggaatgttcaaaaggtgaacggaacagtctacggcaatggggtgccgcggtttgactatctttgtcacctggccagccgcaaagaagttattgtgagaaagtgcttcgacaacgattaccaggcgtgtaaattcctccagtcccccgcctcttatcggctggaggaagacagcggaaccgtcacagtgatcgattacaagaaaattctcggcaccatcaagatgaaggctatcctgggggacgttaaatataagacgtttgccgataatgtggacattacagctgagggctcctgcaccggatgtatcaactgcttcgaaaatattcactgtgagcttaccctgcatacaaccatcgaggccagctgccctattaaatcttcctgtacggtctttcacgatagaatcctcgtgacacccaacgaacataagtacgccctgaaagtggtctgcaccgagaagcctggcaatacactgaccatcaaggtttgcaacacaaaaattgaagctagcatggcgcttgtggacgccaagcccatcattgagctggctcctgtggatcagaccgcctatatccgcgaaaaagacgagcggtgtaagacgtggatgtgcagagtccgcgatgaggggctccaagtgattctggaacccttcaaaaatctctttggatcttacatcggcattttctacacctttatcatctccattgttacactgcttgtgatcatttatatcctgctcccgatttgtttcaagctgagagacaccctgcggaagcacgaggacgcctacaaacgcgaaatgaagatcagatga

SEQ ID NO: 14318 - RNA, 4326 nt, synthetic construct
  misc_feature 1..4326: note = derived and/or modified CDS sequence (opt5) from LACV(LACV/65/OH-M (W17258))__GU206124.1__GP
  source 1..4326: mol_type = other RNA
atgatccggattctggtgctcatcgccgtcaccgctgccaaccccgtttaccagagatgcttccaagacggcgcgattgtgaagcagaatcctagcaaagaggctgtgacagaagtctgtctgaaggatgacgtgtccatgatcaaaacggaggcccgctatattagaaacgccaccggggtgttttctaataacgtggctatccggaagtggcttgtcagcgattggcacgactgccgcccgaaaaagatcattggaggccatatcaatgtgattgaagttggggatgacctgtccctccacacagagtcttacgtgtgtagcgccgattgcaccatcggagtcgacaaggaaacagctcaggtgagactgcagaccgatacaaccaaccatttcgagattgccggcacgaccgtgaaatccgggtggtttaagtctacaacctatatcacacttgaccaaacctgtgagcacctgaaagtcagctgcggacccaagtccgttcagttccatgcgtgttttaatcagcacatgagctgcgtgcggttcctccaccgcacggtgctgcctggctctattgccaactccatctgtcagaatatcgaaattatcattctggtcacactcaccctgcttatctttattctgctcagcatcctgtctaaaacatacatctgctatcttctgatgcccattttcatccctattgcttacgtgtatggcatcatttacaacaagtcctgtaagaaatgcaagctctgcgggctggtttaccatccctttaccgagtgtggaacccactgcgtgtgtggcgccagatatgatacaagcgaccggatgaaactgcatcgcgcttctgggctctgccctggatacaagtccctgagagccgcgcgggtcatgtgtaaaagcaagggcccggcctccatcctttctatcattacggctgtgctggttctcaccttcgtgacacccatcaatagcatggtcctgggggaatccaaagagacctttgagcttgaagaactgcctgatgacatgctcgaaatggccagccgcattgactcttattacttcacatgcatcctgaactatgctgtgtcctggggactggtcattatcggcctcctgaccggccttctgtttaagaagtaccaacacagattcctcaatgtgtatgccatgtactgtgaggaatgcgatatgtaccacgacaaaagcgggctgaagcggcatggagatttcacgaacaaatgtcgccagtgcacatgtggccagtatgaggacgccaccgggcttatggctcacagaaagacctacaattgcctggttcagtataaagcgaagtggatgatgaactttctcattatctacatcttcctgattctgatcaaggattctgccattgtggtccaagctgccggaacagactttaccacatgcctcgagacggaaaacatcaattggaactgtaccggccccttcctgaatcttgggaactgccagaaacagcaaaagaaagagccttatacaaatattgccacccagctgaagggactcaaagctatcagcgtgctggatatccccattatcacaggcattccggacgatatcgccggcgcgctgcggtacattgaagagaaggaagactttcatgttcagcttaccatcgagtatgctatgctctccaagtactgtgattactatacgcagttctctgacaacagcgggtactcccaaaccacatggagagtgtatctgcgcagccacgactttgaggcctgcatcctgtaccctaatcagcatttctgtcggtgcgtcaaaaacggagaaaagtgttcttccagcaattgggattttgccaacgagatgaaagacttctattctggcaagcagaccaaatttgataaggacctcaatctggctcttacagccctgcaccacgctttcagagggacctccagcgcctacattgcgacgatgctctccaagaaatctaacgatgacctgatcgcctatacaaataagattaaaaccaagtttcccggaaacgctctgcttaaagccatcattgattacatcgcttacatgaaaagcctccctggcatggccaatttcaagtatgacgagttctgggatgagctgctgtacaagcccaaccccgcgaaggcctccaacctcgctcgcgggaaagaatctagctataattttaagctggccatctccagcaaatctattaagacatgcaaaaacgtgaaggacgtggcttgtctttcccctcggagcggcgccatctacgcctctattatcgcttgcggagagccgaatggcccctccgtttatagaaagcctagcgggggagtcttccagtctagcaccgatcgctccatttactgtctgctcgacagccattgcctggaggaatttgaggcgatctctcaagaggaactggatgccgtgaaaaagtccaaatgctgggagattgaatatcccgacgtgaagcctcttcaggagggcgacgggaccaaaagctgtcggatgaaggattccggaaactgcaatgtcgctacaaacagatggcccgtgatccagtgtgaaaatgacaagttctactactctgagctccagaaagattatgacaagacgcaagatatcggccactactgcctgagcccggggtgtaccacagttcgctatcctattaaccccaaacatatctccaattgcaactggcaagtgtctcggagctccattgccaagatcgacgtccacaatattgaagatatcgagcagtacaaaaaggccatcacccagaagctgcagacatctctcagcctgtttaaatatgctaagaccaaaaaccttcctcacattaagcccatctacaaatatattacgatcgagggcacagaaaccgccgagggaattgaatccgcgtacatcgagagcgaagtgcctgctctggccggcacctctatcgggttcaagattaattccaaagagggaaagcatctcctggacgttatcgcctacgttaagagcgcttcttattccagcgtctacgccaaactgtattctacaggccccacctccgggattaacacaaagcacgatgagctttgtacgggaccgtgccctgcgaatatcaaccatcaggtgggctggctcacctttgctagagaacgcacaagctcctgggggtgtgaggagttcggctgcctggccgttagcgacggatgtgtgtttggctcttgccaggatattatcaaagaagaactgagcgtctaccggaaggagaccgaggaagtgacagacgtggagctctgcctgaccttctccgataaaacgtattgtaccaaccttaatcccgtcacacccattatcaccgacctgtttgaagttcaattcaagacagtggagacctactctctccctagaatcgtggccgtccagaaccacgagattaagatcgggcagattaatgacctgggagtgtatagcaaaggctgcgggaacgttcagaaggtgaatggaacagtctacggcaacggggtgccgcggtttgattacctgtgtcatcttgcttcccgcaaagaagttatcgtgagaaagtgcttcgacaatgattatcaagcctgtaaattcctgcagtctcccgctagctaccggctcgaggaagactccggcaccgtcacgattatcgattataagaagatcctgggaacaattaaaatgaaggccatcctcggcgacgtgaaatacaagacctttgcggattctgttgacattaccgccgaggggagctgcacaggatgtatcaactgcttcgaaaatattcactgtgagctgacccttcacacgacaatcgaggcttcctgccctatcaaaagctcttgtaccgtgtttcatgatcgcattctggtcacacccaacgaacacaagtatgccctcaagatggtgtgcaccgagaaacctggcaatacactgaccatcaaggtgtgcaacacgaaaattgaggcttccatggccctggtcgacgccaagcccatcattgaacttgctcctgttgatcagaccgcgtacatcagagaaaaagacgagcggtgtaagacatggatgtgcagagtgcgcgacgaggggctccaggtgattctggaacccttcaagaatctgtttggaagctatatcggcatcttctacacctttattatctctattgtcgccctcctggtgatcatttacgttcttctgccgatctgtttcaaactcagagatacactgcggaagcatgaggacgcttataaacgcgaaatgaagatcagatga

SEQ ID NO: 14319 - RNA, 4326 nt, synthetic construct
  misc_feature 1..4326: note = derived and/or modified CDS sequence (opt5) from LACV(LACV/67/NY-M (67-8109))__GU206115.1__GP
  source 1..4326: mol_type = other RNA
atgatctgcattctggtgctcatcaccgtcgccgctgccagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcaccatctacaataagagctgcaagaaatgcaagctctgtgggctggtttaccatccctttaccgagtgcggaacacactgtgtgtgcggcgcccgctatgatacgtctgacagaatgaaactgcatcgggcttccgggctctgtcctggatacaagagcctgcgcgccgcgagagtcatgtgcaaatccaagggcccggcctctattcttagcatcatcaccgctgtgctggttctcacattcgtgacccccattaactccatggtcctgggggaaagcaaagagacatttgagcttgaagatctgcctgacgacatgctcgagatggcctctcggatcaattcctattacctgacctgtattctgaactatgctgtgagctggggactcgtcatcattggcctgcttatcggcctcctgttcaagaagtaccaacaccgctttctgaatgtgtatgccatgtactgcgaagagtgtgatatgtaccacgacaaatctgggcttaagagacatggagatttcacgaacaaatgccggcagtgtacatgcggccagtatgaagacgccgctgggctgatggcgcaccgcaagacctacaattgcctcgttcagtataaagccaagtggatgatgaacttcctgattatctacatctttctgattctcatcaaggatagcgctattgtggtccaagccgccggaaccgacttcacaacctgtctggagacagagtccatcaactggaattgcacgggcccctttcttaacctggggaattgtcagaaacagcaaaagaaagaaccttataccaacattgctacacagctcaagggactgaaagccatctctgtgctggatgttcccatcattaccggcatcccggacgatattgcgggcgctcttagatacatcgaggaaaaggaggacttccatgtgcagctcacaattgaatatgccatgctgagcaagtactgcgattactatacccagttttccgacaatagcgggtactctcaaacgacctggcgggtctatctgagatcccacgacttcgaggcctgtatcctctaccctaaccagcatttttgccgctgtgtgaaaaatggagagaagtgctctagctccaaccgggatttcgctaatgaaatgaaagactattacagcggcaagcagacaaaatttgataaggacctgaaccttgccctgaccgctctccaccacgccttcagagggacatcctctgcgtatatcgccaccatgctgagcaagaaatccaatgatgacctgattgcttacacgaacaagatcaaaacaaagtttcccggaaatgcccttctcaaagctattatcgattacattgcctatatgaagtctctgcctggcatggcgaacttcaaatacgacgagttttgggatgaactgctctataagcccaatcccgccaaggctagcaacctggcccgcgggaaagagtccagctacaacttcaaacttgctatctcttccaaaagcatcaagacctgtaaaaatgtgaaggacgttgcctgcctgtctcctcggtccggcgccatttatgctagcatcattgcgtgtggagaaccgaacggcccctctgtctacagaaagcctagcgggggagtgttccagtccagcacagatcaatctatctattgcctcctggactcccattgcctggaggagtttgaagccattggccaggaggaacttgatgctgtgaaaaagagcaaatgttgggagatcgagtaccccgacgtcaagctcattcaggaaggggacggaaccaaatcctgccgcatgaaggattctggcaattgtaacgtggccaccaatcggtggcctgttatccagtgcgagaacgacaagttctactatagcgaactgcaaaaagattacgacaagacacaggatatcgggcactattgtctgtcccccggctgcacgaccgtgagatacccgattaatcctaaacatatctctaactgtaattggcaggtcagccgctcctctattgccaagatcgacgtgcacaacattgaggatatcgaacagtataaaaaggctatcacacaaaagctccagaccagcctgtccctttttaaatacgccaagacaaagaatctgccccacattaagcctatctataaatacattaccatcgagggaacggagacagcggaaggcattgagagcgcttacatcgaatctgaggttcccgccctcgccgggacctccatcggattcaagattaacagcaaagaaggcaagcatctgctggacgtgatcgcttatgtcaagtctgcctcctacagctctgtgtataccaaactttactccacagggcctaccagcggaattaatacaaagcacgatgagctctgcacgggcccctgtccggcgaacatcaatcatcaggttgggtggctgacctttgctcgggagagaacatccagctggggctgcgaagagttcggatgtctggccgtgtctgacggctgcgtctttgggagctgccaagatattatcaaagaggaactctccgtgtatcgcaaggaaaccgaggaggtgacagacgtcgaactgtgtcttaccttctctgataaaacgtactgcaccaacctgaaccctgttacacccattatcaccgacctctttgaggtgcagttcaagacagtggaaacctatagcctgccccggatcgtcgccgtgcagaatcacgagattaagatcggacagattaacgacctgggcgtttactccaaagggtgtggaaatgtgcaaaaggtcaacggcacaatctacgggaatggcgtgcctagatttgattatctttgccatctggcttctcggaaagaggttattgtgcgcaagtgtttcgacaacgattaccaggcctgcaaatttctccagagcccggcttcctatagactggaagaggactctggaaccgtcacgatcatcgattacaagaagattctcggcacaatcaaaatgaaggccattctgggggacgtgaaatataagaccttcgcggatagcgttgacatcaccgccgaaggatcctgtacaggctgcattaattgtttcgagaacatccactgcgaacttaccctgcacacgacaatcgaggctagctgtcccattaaatcttcctgcaccgtgtttcatgatcggatcctcgtcacacctaatgagcacaagtacgccctgaagatggtgtgcaccgaaaaacccgggaacacactgaccattaaggtgtgtaatacgaaaatcgaggctagcatggcccttgtcgacgccaagcctattatcgaactggctcccgttgatcagaccgcgtatattagagagaaagacgaacgctgcaagacatggatgtgtcgggtgagagacgagggactccaagtgatcctggagcctttcaagaacctctttggctcttacatcggcattttctacacctttatcatttccatcgtcgccctgcttgtgattatctatgttctgctccccatctgcttcaaactgcgcgatacactgagaaagcatgaagacgcttacaaacgggagatgaagattcgctga

SEQ ID NO: 14320 - RNA, 4326 nt, synthetic construct
  misc_feature 1..4326: note = derived and/or modified CDS sequence (opt5) from LACV(LACV/74/NY-M (74-32813))__GU206142.1__GP
  source 1..4326: mol_type = other RNA
atgatcagaatgctggtgctcattgtcgttaccgccgctagccccgtgtaccagcggtgcttccaagacggcgccatcgtgaagcagaacccttccaaagaggcggtcacagaagtgtgtctgaaggatgacgtttctatgattaaaacggaggctcgctatgtgaagaatgccaccggggtctttagcaacaatgtggccatcagaaaatggcttgtttccgattggcacgactgccggccgaagaagattgtgggaggccatatcaacgtcatcgaagtgggggatgacctgtctctccacacagagagctacgtgtgttccgctgattgcaccattggagtcgacaaagaaacagcccaggttcgcctgcagaccgatacaaccaatcatttcgagatcgctggcacgaccgtgaagtctgggtggtttaaaagcacaacctatattacacttgaccaaacctgtgagcacctgaaggtgtcctgcggacccaaaagcgtccagttccatgcctgttttaaccagcacatgtcttgcgtgagattcctccaccggacgatcctgcctggctccattgcgaatagcatctgtcagaacattgaaatcatcattctggttacactcaccctgcttatctttattctgctctctatcctgtccaagacatacatttgctatcttctgatgcccatcttcatccctattgcctacatgtatggcgtgatctacaataagagctgtaaaaagtgcaaactctgcgggctggtctaccatccctttaccgagtgtggaacccactgcgtgtgtggcgctcgctatgatacatctgacagaatgaagctgcatcgggcctccgggctctgccctggatacaaaagcctgcgcgctgccagagttatgtgtaagtccaaaggcccggcgtctattcttagcatcattacggccgtgctggtcctcaccttcgtgacacccatcaactccatggtcctgggggaaagcaaggagacctttgagcttgaagaactgcctgatgacatgctcgaaatggctctgcggatcaattcttattacttcacatgcattctgaactatgccgtgtcctggggactcatcattgctggcctgcttgttggcctgatctttaagaaataccaacaccgcttcctcaatatttatgccatgtactgtgaggaatgcaacatgtaccacgacaagagcgggctgaaaagacatggagatttcaccaataagtgtcggcagtgcacgtgtggccagtatgaggacgccacagggcttatcacccaccgcaaaacctacaactgcctggtgcagtataaggctaagtggatgatgaactttctcattatctacatcttcctgattctgatcaaagattctgcgattgtcgtgcaagccacaggaaccgactttacaacgtgcctcgagaccgaaagcatcaattggaactgtacaggccccttcctgaatcttgggaactgccagaagcagcagaaaaaggagccttataccaatattgctacacagctgaaaggactcaaggccatctccgttctggatatccccattatcacctctattccggacgatatcgccggcgctctgagatacattgaagagaaggaagactttcatgtgcagcttacgaccgagtatgccatgctcagcaaatactgtgattactatacacagttctccgacaacagcggctactctcaaaccacatggcgggtctatctgagatcccacgattttgaggcgtgcatcctgtaccctaatcagcatttctgtaagtgcgtgaaaaacggggaaaagtgttcctcttccaattgggactttgctaacgagatgaaaaattattacagcggaaagcaggccaagttcgacaaagatctcaacctggcccttaccgctctgcaccacgcctttcgcggcacgtcctctgcttatatcgccgcgatgctcagcaagaaatccaatgacgatctgattgcctacacaaacaagatcaaagctaagttccccgggaatgccctgcttaaagctattatcgactacattgcctatatgaagggactccctgaaatggcgaactttaagtacgatgagttctgggacgaactgctgtataaacccaaccccgccaaggcttctaatctcgcccggggcaaagagagctcctacaacttcaagctggctatcagctctaaatccatcaagacctgcaagaatgtgaaagatgttgcctgtcttagccctagatctggggccatttattccagcatcattgcttgcggcgagccgaacggaccctctgtctaccgcaagcctagcggcggggtgtttcagtccagcacagaccggtctatctattgtctgctcgattcccattgcctggaagagttcgaagcgattagccaagaggagctggacgccgtgaaaaagtccaaatgctgggaaatcgagtaccccgatgtcagacctcttcaggaatctgacggagctaagagctgtcgcatgaaggattccggcaattgcaacgtggccaccaatcggtggcccgttatgcagtgtgagaacgacaaattttactattctgaactccagaaggactacgataaaacccaagacattgggcactattgcctgagcccgggatgtacaacgatcagataccctatcaatcccaagcatatttccaactgcaattggcaagtgtctcgcagctccatcgccaaaattgatgtccacaacgtggaggacatcgagcagtataagaaggctattacccagaaactgcaaacaagcctctctctgttcaagtacgccaaaaccaagaatcttcctcacatcaaacccatctataagtacattacaatcgaaggcaccgagacggcggaagggattgagtccgcttacatcgaaagcgaggttcctgccctggccggcacatctgtgggatttaaaattaactccaaggagggcaagcatctcctggatgtcatcgcttatgtgaaaagcgcctcttactccagcgtttatgcgaagctgtactccaccgggcccaccagcggaatcaatacaaaacacgacgaactttgtaccggcccgtgccctgctaacattaaccatcaggtggggtggctcacattcgcccgggagagaacgtctagctggggatgtgaagagtttggctgcctggccgtctccgatgggtgtgtgttcggctcttgccaggacatcattaaggaggagctgagcgtgtatcgcaaagagaccgaagaggtcacaaatgttgaactctgcctgaccttttccgataagacatactgtaccaaccttaatcccgtgacgcccatcattaccgacctgttcgaggtgcaatttaagacagtcgagacctattctctccctcggatcgtggctgttcagaaccacgaaattaaaatcggacagatcaatgatctgggcgtgtacagcaaggggtgcggaaacgtccagaaagtgaatggcacagtttacgggaacggagtgccgagattcgactatctgtgtcatcttgcctcccggaaggaggtcattgtgcgcaaatgctttgataatgactaccaggcttgtaagttcctgcaatctcccgccagctatagactcgaagaggactccggcaccgttacaatcattgattacaagaaaatcctggggaccattaagatgaaagcgatcctcggcgacgtgaagtataaaacgttcgccgatagcgtcgacatcacagctgaaggatcttgcgccggctgtattaactgctttgagaatatccactgtgagctgacccttcacaccacaattgaagctagctgccctatcaagagctcttgtaccgtgttccatgatcggattctggtgacgcccaacgagcacaagtacgccctcaaaatggtctgcacagaaaagcctgggaataccctgacaatcaaagtttgcaacaccagaatcgaggcctccatggctctggtggacgcgaagcccattatcgaacttgcccctgtggatcagacagcttatattcgcgagaaagacgagcggtgtaagacctggatgtgcagagtccgcgatgaaggactccaggtgatcctggagccctttaagaatctgttcggcagctacattgggatcttttacacgttcattatctccatcattgccctcctggttatcatttatgtgcttctgccgatctgttttaaactcagagacaccctgcggaagcatgatgacgcctacaaacgcgaaatgaagattagatga

SEQ ID NO: 14321 - RNA, 4326 nt, synthetic construct
  misc_feature 1..4326: note = derived and/or modified CDS sequence (opt5) from LACV(LACV/93/MO-H)__GU206139.1__GP
  source 1..4326: mol_type = other RNA
atgatctgcattctggtgctcatcaccgtcgccgctgccagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagagtcatgtgcaaatccaagggcccggcctctatccttagcatcattacggctgtgctggttctcaccttcgtgacacccatcaactccatggtcctgggggaaagcaaagagacctttgagcttgaagatctgcctgacgacatgctcgagatggcctctcggattaattcctattacctgacatgtatcctgaactatgctgtgagctggggactcgtcattatcggcctgcttattggccttctcttcaagaagtaccaacaccgctttctgaatatctatgccatgtactgcgaagagtgtgatatgtaccacgacaaatctgggcttaagagacatggagatttcaccaacaaatgccggcagtgtacgtgcggccagtatgaagacgccgctgggctgatggcgcaccgcaagacatacaattgcctcgtgcagtataaagccaagtggatgatgaacttcctgatcatttacatctttctgattctcatcaaggatagcgctattgttgtgcaagccgccggaaccgacttcaccacatgtctggagaccgagtccatcaactggaattgcacaggcccctttcttaacctggggaattgtcagaaacagcaaaagaaagaaccttatacgaacatcgctacccagctcaagggactgaaagccatttctgtcctggatgtgcccatcattacaggcatcccggacgatattgcgggcgctcttagatacatcgaggaaaaggaggacttccatgttcagctcaccatcgaatatgccatgctgagcaagtactgcgattactatacacagttttccgacaatagcgggtactctcaaaccacgtggcgggtgtatctgagatcccacgacttcgaggcctgtattctctaccctaaccagcatttttgccgctgtgtcaaaaatggagagaagtgctctagctccaactggggcttcgctaatgaaatgaaagattattacagcgggaagcagaccaaatttgacaaggatctgaaccttgccctgacagctctccaccacgccttccggggaacctcctctgcgtatatggccacaatgctgagcaagaaatccaatgacgatctgatcgcttacaccaacaagattaaaacgaagtttcccggcaatgcccttctcaaagctatcattgactacatcgcctatatgaagtctctgcctgggatggcgaacttcaaatacgatgagttttgggacgaactgctctataagcccaatcccgccaaggctagcaacctggccagaggcaaagagtccagctacaacttcaagctggctatctcttccaaaagcattaagacatgtaaaaatgtgaaggatgtggcctgcctgtctcctcgctccggagccatctatgctagcattatcgcgtgtggcgaaccgaacgggccctctgtttaccggaagcctagcggaggcgtcttccagtccagcaccgacagatctatttattgcctcctggattcccattgcctggaggagtttgaagccatcgggcaagaggaacttgacgctgtgaaaaagagcaaatgttgggagattgagtaccccgatgtgaagctcatccaggaaggagacggcacaaaatcctgccgcatgaaggactctgggaattgtaacgtcgccaccaatcggtggcctgtgatccagtgcgataacgacaagttctactatagcgagctgcagaaagattacgacaagacccaagatattggccactattgtctgtcccccggatgcacaacggttagatacccgatcaatcctaaacatatttctaactgtaattggcaagtgagccgctcctctatcgccaagattgacgtccacaacatcgaagatatcgagcagtataaaaaggctattacccagaagctccagacaagcctgtccctttttaaatacgccaagaccaaaaatctgccccacatcaagcctatttataaatacatcacaattgaaggcaccgagacggcggaggggatcgaaagcgcttacatcgagtctgaagtgcccgccctcgccggaacatccattggcttcaagatcaacagcaaagaggggaagcatctgctggacgttattgcttatgtgaagtctgcctcctacagctctgtctataccaaactttactccaccggacctacaagcggcatcaataccaagcacgatgaactctgcacagggccctgtccggcgaacattaatcatcaggacggctggctgacgtttgctcgggagagaacctccagctggggatgcgaggagttcggctgtctggccgtgtctgatgggtgcgtttttggaagctgccaggacatcattaaagaagaactctccgtgtatcgcaaggagacagaagaggtcaccgatgtggagctgtgtcttacattctctgacaaaacctactgcacgaacctgaaccctgtgacccccatcatcacagacctctttgaagtccaattcaagaccgttgagacatatagcctgccccggattgtggccgtgcagaatcacgaaatcaagattggccagatcaacgatctgggggtctactccaaaggatgtggcaatgtgcagaaggttaacgggaccatttacggcaatggagtgcctagatttgactatctttgccatctggcttctcggaaagaggtcatcgtgcgcaagtgtttcgataacgactaccaagcctgcaaatttctccagagcccggcttcctatagactggaggaagattctggcacagttaccatcattgactacaagaagatcctcgggacgattaaaatgaaggccatcctgggagatgtgaaatataagacattcgcggacagcgtcgatattaccgccgagggctcctgtaccgggtgcatcaattgtttcgaaaacatccactgcgagcttacactgcacaccacgattgaagctagctgtcccatcaaatcttcctgcacagtgtttcatgaccggattctcgttacccctaatgagcacaagtacgccctgaaggtggtctgcacagagaaacccggaaacaccctgacaatcgaagtgtgtaataccaagattgaggctagcatggcccttgtggatgccaaacctatcattgaactggctcccgtcgaccagacgacctatatcagagagaaggacgaacgctgcaaaacatggatgtgtcgggttagagatgagggcctccaggtgatcctggagcctttcaagaacctctttggctcttacattgggatcttctacacctttattatctccattgtggcgctgcttgtcatcatctatgtgctgctccccatttgcttcaagctgcgcgacacactgagaaaacatgaagatgcctacaagcgggagatgaaaatccgctga

SEQ ID NO: 14322 - RNA, 4326 nt, synthetic construct
  misc_feature 1..4326: note = derived and/or modified CDS sequence (opt5) from LACV(LACV/95/OH-H (CCH-MB96))__GU206136.1__GP
  source 1..4326: mol_type = other RNA
atgatccggattctggtgctcatcgccgtcaccgctgccagccccgtttaccagagatgcttccaagacggcgcgattgtgaagcagaacccttccaaagaggctgtgacagaagtctgtctgaaggatgacgtgtctatgatcaaaacggaggcccgctatattagaaatgccaccggggtttttagcaacaatgtggctatccggaagtggcttgtctccgattggcacgactgccgcccgaaaaagatcattggaggccatatcaacgtgattgaagttggggatgacctgtctctccacacagagagctacgtgtgttccgccgattgcaccatcggagtcgacaaggaaacagctcaggtgagactgcagaccgatacaaccaatcatttcgagattgccggcacgaccgtgaaatctgggtggtttaagagcacaacctatatcacacttgaccaaacctgtgagcacctgaaagtctcctgcggacccaagagcgttcagttccatgcgtgttttaaccagcacatgtcttgcgtgcggttcctccaccgcacgattctgcctggctccatcgccaatagcatctgtcagaacattgaaatcattatcctggtgacactcaccctgcttatttttatcctgctctctatcctgtccaaaacatacatttgctatcttctgatgcccatcttcattcctatcgcttacgtctatggcattatctacaataagagctgtaagaaatgcaagctctgcgggctggtgtaccatccctttaccgagtgtggaacccactgcgtttgtggcgccagatatgatacatctgaccggatgaaactgcatcgcgcttccgggctctgccctggatacaagagcctgagagccgcgcgggtgatgtgtaaatccaagggcccggcctctatccttagcatgattacggctgtcctggtgctcaccttcgttacacccatcaactccatggtgctgggggaaagcaaagagacctttgagcttgaagaactgcctgatgacatgctcgaaatggtctctcgcattaattcctattacttcacatgcatcctgaactatgccgtgagctggggactgattatcattggcctcctgaccggccttctgtttaagaagtaccaacacagattcctcaatgtctatgctatgtactgtgaggaatgcgacatgtaccacgataaatctgggctgaagcggcatggagacttcacgaacaaatgtcgccagtgcacatgtggccagtatgaggatgccgccgggcttatggctcacagaaagacctacaattgcctggtgcagtataaagcgaagtggatgatgaactttctcatcatctacattttcctgatcctgattaaggacagcgccatcgttgtgcaagctgccggaaccgattttacaacctgcctcgagacagaatccattaactggaattgtacgggccccttcctgaaccttgggaattgccagaaacagcaaaagaaagagccttataccaacatcgccacacagctgaagggactcaaagctatctctgtcctggacattcccatcattaccggcatcccggatgacattgccggcgcgctgcggtacatcgaagagagagaagattttcatgtgcagcttacaatcgagtatgctatgctcagcaagtactgtgactactatacccagttctccgataatagcgggtactctcaaacgacctggcgcgtttatctgcggtcccacgactttgaggcctgcattctgtaccctaaccagcatttctgtagatgcgtgaagaatggagaaaaatgttctagctccaactggggctttgccaatgagatgaaggacttctatagcgggaaacagacaaagtttgataaagacctcaacctggctcttaccgccctgcaccacgctttccgcggaacatcctctgcctacatcgcgaccgtcctcagcaagaagtccaatgatgacctgattgcctatacgaacaaaatcaagacaaaatttcccggcaatgctctgcttaaggccattatcgattacatcgcttacatgaaatctctccctgggatggccaacttcaagtatgacgagttctgggatgagctgctgtacaaacccaatcccgcgaaggccagcaacctcgctcggggcaaggaatccagctataactttaaactggccatttcttccaagagcatcaaaacctgcaagaatgtgaaagacgtggcttgtctttctcctagatccggagccatttacgccagcatcattgcttgcggcgagccgtctgggcccagcgtttatcgcaagcctcccggaggcgtcttccagtccagcacagatcggtctatctactgtctgctcgactcccattgcctggaggaatttgaggcgattagccaagaagaactggatgccgtgaagaaatccaagtgctgggagatcgaatatcctgacgtgaaaccccttcaggagtctgatgggaccaagagctgtagaatgaaagactccggaaactgcaatgtcgctaccaaccgctggccggtgatccagtgtgaaaatgacaagttctactactctgagctccagaaggattatgacaaaacacaagatattggccactactgcctgagccctgggtgtacgaccgttcggtatcccatcaaccctaagcatatttccaattgcaactggcaagtgtctagaagctccatcgccaaaattgacgtccacaatatcgaagatatcgagcagtacaagaaagccattacacagaagctgcaaaccagcctctctctgtttaagtatgctaaaacaaagaaccttccccacatcaaacctatttacaagtatatcaccattgagggcacggaaacagccgagggaatcgaatccgcgtacatcgagagcgaagtgcccgctctggccggcacctctattgggttcaaaatcaattccaaggagggaaaacatctcctggacgttattgcctacgtcaagagcgcttcttattccagcgtgtacaccaagctgtattccacaggcccgaccagcgggatcaacacaaaacacgatgagctttgtacgggaccttgccccgccaatattaaccatcaggtgggctggctcacctttgcgcgcgaacggacatctagctgggggtgtgaggagttcggctgcctggctgtttccgacggatgtgtgtttggctcttgccaggatatcattaaggaggaactgagcgtctacagaaaagagaccgaggaagtgacagacgtggagctctgcctgaccttctccgataagacgtattgtaccaatcttaaccccgtcacacctatcatcaccgacctgtttgaagttcaattcaaaacagtggagacctactctctcccgcggattgtggccgtccagaaccacgagatcaagattgggcagatcaatgatctgggagtgtatagccgcggctgcgggaacgttcagaaggtgaatggaacagtctacggcaacggggtgcccagatttgactacctgtgtcatcttgcctcccggaaagaagttattgtgagaaagtgcttcgacaatgattatcaggcttgtaaattcctgcagtctcctgccagctaccgcctcgaggaagactccggcaccgtcacgatcatcgattataagaaaattctgggaacaatcaagatgaaggctattctcggcgacgtgaaatacaagacctttgccgatagcgttgacatcaccgcggaggggtcttgcacaggatgtattaactgcttcgaaaatatccactgtgagctgacccttcacacgacaatcgaggcctcctgccccattaaaagctcttgtaccgtgtttcatgatcggatcctggtcacacctaacgaacacaagtatgctctcaaaatggtgtgcaccgagaagcccggcaatacactgaccattaaggtgtgcaacacgaaaatcgaagcctccatggctctggtcgacgccaagcctattatcgagcttgcccccgttgatcagaccgcttacattagagaaaaagacgagcgctgtaagacatggatgtgcagagtgcgggatgaggggctccaggtgatcctggaaccgttcaaaaatctgtttggaagctatatcggcattttctacacctttatcatttccatcgtcgcgctcctggtgattatctacgttcttctgcctatctgtttcaagctccgcgacacactgagaaagcatgaggacgcctataaacgggaaatgaagattcgctga

SEQ ID NO: 14323 - RNA, 4326 nt, synthetic construct
  misc_feature 1..4326: note = derived and/or modified CDS sequence (opt5) from LACV(LACV/95/WV-H)__GU206133.1__GP
  source 1..4326: mol_type = other RNA
atgatctgcattctggtgctcatcaccgtcgccgctgccagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcaccatctacaataagagctgcaagaaatgcaagctctgtgggctggtttaccatccctttaccgagtgcggaacacactgtgtgtgcggcgcccgctatgatacgtctgacagaatgaaactgcatcgggcttccgggctctgtcctggatacaagagcctgcgcgccgcgagagtcatgtgcaaatccaagggcccggcctctattcttagcatcatcaccgctgtgctggttctcacattcgtgacccccattaactccatggtcctgggggaaagcaaagagacatttgagcttgaagatctgcctgacgacatgctcgagatggcctctcggatcaattcctattacctgacctgtattctgaactatgctgtgagctggggactcgtcatcattggcctgcttatcggcctcctgttcaagaagtaccaacaccgctttctgaatgtgtatgccatgtactgcgaagagtgtgatatgtaccacgacaaatctgggcttaagagacatggagatttcacgaacaaatgccggcagtgtacatgcggccagtatgaagacgccgctgggctgatggcgcaccgcaagacctacaattgcctcgttcagtataaagccaagtggatgatgaacttcctgattatctacatctttctgattctcatcaaggatagcgctattgtggtccaagccgccggaaccgacttcacaacctgtctggagacagagtccatcaactggaattgcacgggcccctttcttaacctggggaattgtcagaaacagcaaaagaaagaaccttataccaacattgctacacagctcaagggactgaaagccatctctgtgctggatgttcccatcattaccggcatcccggacgatattgcgggcgctcttagatacatcgaggaaaaggaggacttccatgtgcagctcacaattgaatatgccatgctgagcaagtactgcgattactatacccagttttccgacaatagcgggtactctcaaacgacctggcgggtctatctgagatcccacgacttcgaggcctgtatcctctaccctaaccagcatttttgccgctgtgtgaaaaatggagagaagtgctctagctccaactgggatttcgctaatgaaatgaaagactattacagcggcaagcagacaaaatttgataaggacctgaaccttgccctgaccgctctccaccacgccttccgggggacatcctctgcgtatatcgccaccatgctgagcaagaaatccaatgatgacctgattgcttacacgaacaagatcaaaacaaagtttcccggaaatgcccttctcaaagctattatcgattacattgcctatatgaagtctctgcctggcatggcgaacttcaaatacgacgagttttgggatgaactgctctataagcccaatcccgccaaggctagcaacctggccagagggaaagagtccagctacaacttcaaacttgctatctcttccaaaagcatcaagacctgtaaaaatgtgaaggacgttgcctgcctgtctcctcgctccggcgccatttatgctagcatcattgcgtgtggagaaccgaacggcccctctgtctaccggaagcctagcgggggagtgttccagtccagcacagatcaatctatctattgcctcctggactcccattgcctggaggagtttgaagccattggccaggaggaacttgatgctgtgaaaaagagcaaatgttgggagatcgagtaccccgacgtcaagctcattcaggaaggggacggaaccaaatcctgcagaatgaaggattctggcaattgtaacgtggccaccaatcgctggcctgttatccagtgcgagaacgacaagttctactatagcgaactgcaaaaagattacgacaagacacaggatatcgggcactattgtctgtcccccggctgcacgaccgtgcggtacccgattaatcctaaacatatctctaactgtaattggcaggtcagcagatcctctattgccaagatcgacgtgcacaacattgaggatatcgaacagtataaaaaggctatcacacaaaagctccagaccagcctgtccctttttaaatacgccaagacaaagaatctgccccacattaagcctatctataaatacattaccatcgagggaacggagacagcggaaggcattgagagcgcttacatcgaatctgaggttcccgccctcgccgggacctccatcggattcaagattaacagcaaagaaggcaagcatctgctggacgtgatcgcttatgtcaagtctgcctcctacagctctgtgtataccaaactttactccacagggcctaccagcggaattaatacaaagcacgatgagctctgcacgggcccctgtccggcgaacatcaatcatcaggttgggtggctgacctttgctcgcgagcggacatccagctggggctgcgaagagttcggatgtctggccgtgtctgacggctgcgtctttgggagctgccaagatattatcaaagaggaactctccgtgtatagaaaggaaaccgaggaggtgacagacgtcgaactgtgtcttaccttctctgataaaacgtactgcaccaacctgaaccctgttacacccattatcaccgacctctttgaggtgcagttcaagacagtggaaacctatagcctgccccgcatcgtcgccgtgcagaatcacgagattaagatcggacagattaacgacctgggcgtttactccaaagggtgtggaaatgtgcaaaaggtcaacggcacaatctacgggaatggcgtgcctcggtttgattatctttgccatctggcttctagaaaagaggttattgtgcggaagtgtttcgacaacgattaccaggcctgcaaatttctccagagcccggcttcctatcgcctggaagaggactctggaaccgtcacgatcatcgattacaagaagattctcggcacaatcaaaatgaaggccattctgggggacgtgaaatataagaccttcgcggatagcgttgacatcaccgccgaaggatcctgtacaggctgcattaattgtttcgagaacatccactgcgaacttaccctgcacacgacaatcgaggctagctgtcccattaaatcttcctgcaccgtgtttcatgatagaatcctcgtcacacctaatgagcacaagtacgccctgaagatggtgtgcaccgaaaaacccgggaacacactgaccattaaggtgtgtaatacgaaaatcgaggctagcatggcccttgtcgacgccaagcctattatcgaactggctcccgttgatcagaccgcgtatattcgggagaaagacgaaagatgcaagacatggatgtgtcgcgtgcgggacgagggactccaagtgatcctggagcctttcaagaacctctttggctcttacatcggcattttctacacctttatcatttccatcgtcgccctgcttgtgattatctatgttctgctccccatctgcttcaaactgagagatacactgcgcaagcatgaagacgcttacaaaagagagatgaagattcggtga

SEQ ID NO: 14324 - RNA, 4326 nt, synthetic construct
  misc_feature 1..4326: note = derived and/or modified CDS sequence (opt5) from LACV(LACV/96/WV-M (WV96-3955))__GU206145.1__GP
  source 1..4326: mol_type = other RNA
atgatctacattctggtgctcatcgccgtcaccgctgccagccccgtttatcagagatgcttccaagacggcgcgattgtgaagcagaacccttccaaagaggctgtgacagaagtctgtctgaaggatgacgtgtctatgatcaaaacggaggcccggtacattcgcaatgccaccggggtttttagcaacaatgtggctatcagaaagtggcttgtctccgattggcacgactgccggccgaaaaagatcacaggaggccatattaacgtgatcgaagttggggatgacctgtctctccacaccgagagctatgtgtgttccgccgattgcacaattggagtcgacaaggaaaccgctcaggtgcgcctgcagacagataccacgaatcatttcgagatcgccggcaccacagtgaaatctgggtggtttaagagcaccacatacattacccttgaccaaacgtgtgagcacctgaaagtctcctgcggacccaagagcgttcagttccatgcgtgttttaaccagcacatgtcttgcgtgagattcctccaccggacaatcctgcctggctccattgccaatagcatctgtcagaacatcgaaattatcattctggtgaccctcacactgcttatctttattctgctctctatcctgtccaaaacctatatctgctaccttctgatgcccattttcatccctattgcttatgtctacggcatcatttacaataagagctgtaagaaatgcaagctctgcgggctggtgtatcatccctttaccgagtgtggaacacactgcgtttgtggcgcccgctacgatacgtctgacagaatgaaactgcatcgggcttccgggctctgccctggatataagagcctgcgcgccgcgagagtgatgtgtaaatccaagggcccggcctctatccttagcatcattaccgctgtcctggtgctcacattcgttacccccatcaactccatggtgctgggggaaagcaaagaggtctttgagcttgaagaactgcctgatgacatgctcgaaatggccctgcggattaattcttactatttcacatgcatcctgaactacgctgtgtcctggggactcattatcattggcctgcttaccggcctgctctttaagaagtatcaacaccgcttcctgaatatctacgccatgtactgtgaggaatgcgacatgtatcacgataaaagcgggcttaagagacatggagacttcacgaacaaatgtcggcagtgcacatgtggccagtacgaggatgccgctgggctgatgacccaccgcaagacctataattgcctcgtccagtacaaagcgaagtggatcatgaactttctgattgtgtatatcttcctgattctcatcaaggactctgccattatcgttagagctgccggaacagattttagctcctgcctggagaccgaaatcattaactggaattgtacaggccccttccttaacctggggaattgccaacggcagcagaaaaaggagccttacgccaacatcgctgcccaactcaaaggactgaaggcgatttctgtgctggacatccccatgattacggaaatcccggatgacatcgctagcgcccttagatatattgaggaacgcgaggcctttcatgtccagctcaccgctgagtacgccatgctgtcccggtactgtgattattacacacagttcagcgacaattctggctattcccagaccacatggagagtgtacctgcgcagccacgattttgaggcttgcatcctctatcctaaccaacatttctgtcggtgcgttaaaaatggcgagaagtgttcttccgccaactgggactttgcgaatgaaatgaaggactactatagcgggaaacaggccaagttcgataaagacctgaaccttgctctgaccgccatgcaccacgcttttagaggaacgtcctctgcctacatggcggccatgctcagcaagaaatccaatgatgacctgattacctacacaaacaagctgaagaccaaattccccggcaatgctctgctcaaggccatcattgattatatcgcttacatgaaagggctgcctggaatggccaactttaagcatgacgagttctgggatgaactgctctataaacccacacccaccaaggcccctaatctggctcgcggccgggagtctagctacaacttcgagcttgcgatctccagcaaatctattaagacgtgcaagaacgtgaaagacgtcgcctgtctgtccccgagaagcggggctatctatgcctctattatcgcctgcggcgaacccaatggaccttccgtgtaccgcaagcccagcggcggggtgtttcagtctagcacagatcagtccatgtattgtctcctggacagccactgcctggaggagttcgaagctatttctcaagaggaacttgatgccgttaaaaagtccaaatgctgggagatcgaataccctgacgtcaagctcctgcaggagaacgatggaaccaagagctgtcggatgaaagactccggcaattgcaacgtggcgacaaatagatggcccgtgattcagtgtgaaaacgacaagttttactattctgagctgcagaaagattacgacaagacccaagatatcgggcattattgcctcagcccgggatgtgctaccatccgctaccctattaatcccaaacacatctccaactgcaattggcaggtctctcggagctccattgccaagatcgacgtgcacaacattgaggatatcgaacagtataagaaagccatcacacagaagctgcaaacgtctcttagcctgttcaaatacgctaagaccaaaaatctccctcatattaagcccatctataagtacattacaatcgagggcaccgaaacagccgaggggattgaatccgcgtacatcgagagcgaggttcctgctctggccggcacctctatcggatttaaaattaactccaaggaaggcaaacaccttcttgacgtgatcgcctatgtcaagagcgcttcttactccagcgtgtatacgaaactctactctacagggcccacctccggagttaataccaagcatgatgagctgtgtacaggcccgtgccctgccaacattaatcaccaggtggggtggctgaccttcgctagagaacggacaagctcctggggatgtgaggaatttggctgcctcgccgtcagcgacgggtgtgtgttcggctcttgccaggatatcattaaagaggagctgagcgtttatcgcaaggaaacggaggaagtgaccgacgtcgagctttgcctgacattttccgataagacctactgtacaaacctcaaccccgtgacccccatcattacggacctgttcgaggtgcaatttaaaaccgtcgaaacatattctctgcctagaatcgttgcggtgcagaatcatgagatcaagattggacagatcaacgatcttggcgtgtacagcaaagggtgcggaaatgtccagaaggtgaacggcaccatttacgggaatggagttccgcggttcgactatctgtgtcacctcgcctccagaaaagaagtgatcgtccgcaagtgctttgacaacgattaccaggcttgtaagttcctgcaatctcccgccagctatcggctcgaggaagactccggcacagtgaccattatcgattacaaaaagatcctggggacaattaaaatgaaggctatccttggcgacgttaaatataagaccttcgccgataatgtggacattacggccgagggatcttgcacaggctgtatcaactgctttgagaatattcactgtgaactgaccctccataccacaatcgaggctagctgccctatcaagtccagctgtaccgtcttccacgatcgcattctggtgacgcccaacgaacataaatacgcgctgaaggttgtgtgcacagagaaacctgggaatacccttacaatcaaggtctgcaacaccaaaattgaagccgctatggccctggtggacgccaagcccatcattgagctcgctcctgtggatcagacagcctatatcagagagaaggacgaaagatgtaaaacctggatgtgccgggtccgcgatgagggactgcaggttattctcgaaccctttaagaatctgttcggctcttacatcgggatcttttacacgttcattatctccattgtggcgcttctggtgatcatttatatcctcctgccgatctgttttaaactgagagacacccttcggaagcacgaggacgcttacaaacgcgaaatgaagattagatga

SEQ ID NO: 14325 - RNA, 4326 nt, synthetic construct
  misc_feature 1..4326: note = derived and/or modified CDS sequence (opt5) from LACV(LACV/97/NC-M (NC97-7306))__GU206127.1__GP
  source 1..4326: mol_type = other RNA
atgatccggattctggtgctcatcgccgtcaccgctgccagccccgtttaccagagatgcttccaagacggcgcgattgtgaagcagaacccttccaaagaggctgtgacagaagtctgtctgaaggatgacgtgtctatgatcaaaacggaggcccgctatattagaaatgccaccggggtttttagcaacaatgtggctatccggaagtggcttgtctccgattggcacgactgccgcccgaaaaagatcattggaggccatatcaacgtgattgaagttggggatgacctgtctctccacacagagagctacgtgtgttccgccgattgcaccatcggagtcgacaaggaaacagctcaggtgagactgcagaccgatacaaccaatcatttcgagattgccggcacgaccgtgaaatctgggtggtttaagagcacaacctatatcacacttgaccaaacctgtgagcacctgaaagtctcctgcggacccaagagcgttcagttccatgcgtgttttaaccagcacatgtcttgcgtgcggttcctccaccgcacgattctgcctggctccatcgccaatagcatctgtcagaacattgaaatcattatcctggtgacactcaccctgcttatttttatcctgctctctatcctgtccaaaacatacatttgctatcttctgatgcccatcttcattcctatcgcttacgtctatggcattatctacaataagagctgtaagaaatgcaagctctgcgggctggtgtaccatccctttaccgagtgtggaacccactgcgtttgtggcgccagatatgatacatctgaccggatgaaactgcatcgcgcttccgggctctgccctggatacaagagcctgagagccgcgcgggtgatgtgtaaatccaagggcccggcctctatccttagcatgattacggctgtcctggtgctcaccttcgttacacccatcaactccatggtgctgggggaaagcaaagagacctttgagcttgaagaactgcctgatgacatgctcgaaatggtctctcgcattaattcctattacttcacatgcatcctgaactatgccgtgagctggggactgattatcattggcctcctgaccggccttctgtttaagaagtaccaacacagattcctcaatgtctatgctatgtactgtgaggaatgcgacatgtaccacgataaatctgggctgaagcggcatggagacttcacgaacaaatgtcgccagtgcacatgtggccagtatgaggatgccgccgggcttatggctcacagaaagacctacaattgcctggtgcagtataaagcgaagtggatgatgaactttctcatcatctacattttcctgatcctgattaaggacagcgccatcgttgtgcaagctgccggaaccgattttacaacctgcctcgagacagaatccattaactggaattgtacgggccccttcctgaaccttgggaattgccagaaacagcaaaagaaagagccttataccaacatcgccacacagctgaagggactcaaagctatctctgtcctggacattcccatcattaccggcatcccggatgacattgccggcgcgctgcggtacatcgaagagagagaagattttcatgtgcagcttacaatcgagtatgctatgctcagcaagtactgtgactactatacccagttctccgataatagcgggtactctcaaacgacctggcgcgtttatctgcggtcccacgactttgaggcctgcattctgtaccctaaccagcatttctgtagatgcgtgaagaatggagaaaaatgttctagctccaactgggactttgccaatgagatgaaggatttctatagcggcaaacagacaaagtttgacaaagatctcaacctggctcttaccgccctgcaccacgctttccgcgggacatcctctgtctacatcgccaccatgctcagcaagaagtccaatgacgatctgattgcgtatacgaacaaaatcaagacaaaatttcccggaaatgccctgcttaaggctattatcgactacatcgcctacatgaaatctctccctggcatggctaacttcaagtatgatgagttctgggacgagctgctgtacaaacccaatcccgccaaggcgagcaacctcgcccgggggaaggaatccagctataactttaaactggctatttcttccaagagcatcaaaacctgcaagaatgtgaaagatgtggcctgtctttctcctagatccggcgctatttacgccagcatcattgcctgcggagagccgaacggcccctctgtttatcgcaagcctcccgggggagtcttccagagctccacagaccggagcatctactgtctgctcgattctcattgcctggaggaatttgaggctatttcccaagaagaactggacgcggtgaagaaaagcaagtgctgggagatcgaatatcctgatgtgaaaccccttcaggagtccgacggcaccaagtcttgtagaatgaaagacagcgggaattgcaacgtcgccaccaatcgctggccggtgatccagtgtgaaaacgataagttctactactccgagctccagaaggactatgataaaacacaagacattggacactactgcctgtctcctggctgtacgaccgttcggtatcccatcaatcctaagcatattagcaactgcaattggcaagtgtccagatctagcatcgctaaaattgatgtccacaacatcgaagacatcgagcagtacaagaaagccattacacagaagctgcaaacctccctcagcctgtttaagtatgccaaaacaaagaatcttccccacatcaaacctatttacaagtatatcaccattgaggggacggaaacagctgagggcatcgaatctgcctacatcgagtccgaagtgcccgcgctggctggaaccagcattggcttcaaaatcaactctaaggaggggaaacatctcctggatgttattgcctacgtgaagtccgccagctattcttccgtctacaccaagctgtatagcacaggaccgacctccggcatcaatacaaaacacgacgagctttgtacggggccttgccccgctaacattaatcatcaggtgggatggctcacctttgcccgcgaacggacaagctcttggggctgtgaggagttcgggtgcctggcggttagcgatggctgtgtgtttggatcctgccaggacatcattaaggaggaactgtctgtctacagaaaagagaccgaggaagtgacagatgtggagctctgcctgaccttcagcgacaagacgtattgtaccaaccttaaccccgtcacacctatcatcaccgatctgtttgaagttcaattcaaaacagtggagacctactccctcccgcggattgtggctgtccagaatcacgagatcaagattggccagatcaacgacctgggggtgtattctaaggcctgcggaaatgttcagaaagtgaacggcacagtctacgggaatggagtgccccgctttgactacctgtgtcatcttgccagcagaaaggaagttattgtgcggaaatgcttcgataacgactatcaggcttgtaagttcctgcagtcccctgcctcttacagactcgaggaagatagcggcaccgtcacgatcatcgactataaaaagattctggggacaatcaagatgaaagctattctcggcgatgtgaagtacaaaacctttgccgactccgttgatatcaccgcggagggaagctgcacaggctgtattaattgcttcgaaaacatccactgtgagctgacccttcacacgacaatcgaggcctcttgccccattaagtccagctgtaccgtgtttcatgaccgcatcctggtcacacctaatgaacacaaatatgctctcaagatggtgtgcaccgagcggcccgggaacacactgaccattaaggtgtgcaatacgaaaatcgaagcctctatggctctggtcgatgccaagcctattatcgagcttgcccccgttgaccagaccgcttacattagagaaaaagatgagcgctgtaagacatggatgtgcagagtgcgggacgagggactccaggtgatcctggaaccgttcaaaaacctgtttggctcctatatcgggattttctacacctttatcattagcatcgtcgcgctcctggtgattatctacgttcttctgcctatctgtttcaagctccgcgacacactgagaaagcatgaggatgcctataaacgggaaatgaagattcgctga

SEQ ID NO: 14326 - RNA, 4326 nt, synthetic construct
  misc_feature 1..4326: note = derived and/or modified CDS sequence (opt5) from LACV(LACV/human/1960)__EF485031.1__GP
  source 1..4326: mol_type = other RNA
atgatctgcattctggtgctcatcaccgtcgccgctgccagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcaccatctacaataagagctgcaagaaatgcaagctctgtgggctggtttaccatccctttaccgagtgcggaacacactgtgtgtgcggcgcccgctatgatacgtctgacagaatgaaactgcatcgggcttccgggctctgtcctggatacaagagcctgcgcgccgcgagagtcatgtgcaaatccaagggcccggcctctattcttagcatcatcaccgctgtgctggttctcacattcgtgacccccattaactccatggtcctgggggaaagcaaagagacatttgagcttgaagatctgcctgacgacatgctcgagatggcctctcggatcaattcctattacctgacctgtattctgaactatgctgtgagctggggactcgtcatcattggcctgcttatcggccttctcttcaagaagtaccaacaccgctttctgaatgtgtatgccatgtactgcgaagagtgtgatatgtaccacgacaaatctgggcttaagggacatggcgatttcacgaacaaatgcagacagtgtacatgcgggcagtatgaagacgccgctggactgatggcgcaccggaagacctacaattgcctcgttcagtataaagccaagtggatgatgaacttcctgattatctacatctttctgattctcatcaaggatagcgctattgtggtccaagccgccggcaccgacttcacaacctgtctggagacagagtccatcaactggaattgcacggggccctttcttaacctgggaaattgtcagaaacagcaaaagaaagaaccttataccaacattgctacacagctcaagggcctgaaagccatctctgtgctggatgttcccatcattaccggcatcccggacgatattgcgggggctctgcgctacatcgaggaaaaggaggacttccatgtgcagctcacaattgaatatgccatgctgagcaagtactgcgattactatacccagttttccgacaatagcggatactctcaaacgacctggagagtctatctgcggtcccacgacttcgaggcctgtatcctctaccctaaccagcatttttgcagatgtgtgaaaaatggcgagaagtgctctagctccaactgggatttcgctaatgaaatgaaagactattacagcgggaagcagacaaaatttgataaggacctgaaccttgccctgaccgctctccaccacgccttccgcggaacatcctctgcgtatatcgccaccatgctgagcaagaaatccaatgatgacctgattgcttacacgaacaagatcaaaacaaagtttcccggcgatgcccttctcaaagctattatcgactacattgcctatatgaagtctctgcctgggatggcgaatttcaaatacgatgagttttgggacgaactgctctataagcccaaccccgccaaggctagcaatctggcccggggcaaagagtccagctacaacttcaaacttgctatctcttccaaaagcatcaagacctgtaaaaacgtgaaggatgttgcctgcctgtctcctagatccggagccatttatgctagcatcattgcgtgtggcgaaccgaatgggccctctgtctaccgcaagcctagcggaggcgtgttccagtccagcacagaccaatctatctattgcctcctggattcccattgcctggaggagtttgaagccattgggcaggaggaacttgacgctgtgaaaaagagcaaatgttgggagatcgagtaccccgacgtcaagctcattcaggaaggagatggcaccaaatcctgccggatgaaggactctgggaactgtaatgtggccaccaacagatggcctgttatccagtgcgagaatgataagttctactatagcgaactgcaaaaagactacgataagacacaggacatcggccactattgtctgtcccccggatgcacgaccgtgcgctacccgattaaccctaaacatatctctaattgtaactggcaggtcagccggtcctctattgccaagatcgatgtgcacaatattgaggacatcgaacagtataaaaaggctatcacacaaaagctccagaccagcctgtccctttttaaatacgccaagacaaagaacctgccccacattaagcctatctataaatacattaccatcgagggcacggagacagcggaagggattgagagcgcttacatcgaatctgaggttcccgccctcgccggaacctccatcggcttcaagattaatagcaaagaagggaagcatctgctggatgtgatcgcttatgtcaagtctgcctcctacagctctgtgtataccaaactttactccacaggacctaccagcggcattaacacaaagcacgacgagctctgcacggggccctgtccggcgaatatcaaccatcaggttggctggctgacctttgctagagagcgcacatccagctggggatgcgaagagttcggctgtctggccgtgtctgatgggtgcgtctttggaagctgccaagacattatcaaagaggaactctccgtgtatcggaaggaaaccgaggaggtgacagatgtcgaactgtgtcttaccttctctgacaaaacgtactgcaccaatctgaaccctgttacacccattatcaccgacctctttgaggtgcagttcaagacagtggaaacctatagcctgcccagaatcgtcgccgtgcagaaccacgagattaagatcggccagattaatgatctgggggtttactccaaaggatgtggcaacgtgcaaaaggtcaatgggacaatctacggcaacggagtgcctcgctttgactatctttgccatctggcttctcggaaagaggttattgtgagaaagtgtttcgataatgactaccaggcctgcaaatttctccagagcccggcttcctatcggctggaagaggattctggcaccgtcacgatcatcgactacaagaagattctcgggacaatcaaaatgaaggccattctgggagatgtgaaatataagaccttcgcggacagcgttgatatcaccgccgaaggctcctgtacagggtgcattaactgtttcgagaatatccactgcgaacttaccctgcacacgacaatcgaggctagctgtcccattaaatcttcctgcaccgtgtttcatgaccgcatcctcgtcacacctaacgagcacaagtacgccctgaagatggtgtgcaccgaaaaacccggaaatacactgaccattaaggtgtgtaacacgaaaatcgaggctagcatggcccttgtcgatgccaagcctattatcgaactggctcccgttgaccagaccgcgtatattagagagaaagacgaacggtgcaagacatggatgtgtagagtgcgcgatgagggcctccaagtgatcctggagcctttcaagaatctctttggctcttacatcgggattttctacacctttatcatttccatcgtcgccctgcttgtgattatctatgttctgctccccatctgcttcaaactgcgggacacactgagaaagcatgaagatgcttacaaacgcgagatgaagattagatga

SEQ ID NO: 14327 - RNA, 4326 nt, synthetic construct
  misc_feature 1..4326: note = derived and/or modified CDS sequence (opt5) from LACV(LACV/mosquito/1978)__EF485037.1__GP
  source 1..4326: mol_type = other RNA
atgatccgcattctggtgctcatcgccgtcaccgctgccagccccgtttaccagcggtgcttccaagacggcgcgattgtgaagcagaacccttccaaagaggctgtgacagaagtctgtctgaaggatgacgtgtctatgatcaaaacggaggcccgctatgttagaaatgccaccggggtgtttagcaacaatgtcgctattcggaagtggcttgtgtccgattggcacgactgccgcccgaaaaagatcatcggaggccatattaacgttatcgaagtgtctgatgacctgagcctccacacagagtcctacgtctgttctgccgattgcaccattggggtggacaaggaaacagctcaggtgagactgcagaccgatacaaccaatcatttcgagatcgccggaacgaccgtcaaaagcggctggtttaagtccacaacctatattacacttgaccaaacctgtgagcacctgaaagttagctgcgggcccaagtctgtgcagttccatgcgtgttttaaccagcacatgtcctgcgtgcggttcctccaccgcacgatcctgcctggaagcattgccaattctatctgtcagaacatcgaaattatcattctggtcacactcaccctgcttatctttattctgctctccatcctgagcaaaacatacatctgctatcttctgatgcccattttcatccctattgcttacatgtatggcatcatttacaataagtcttgtaagaaatgcaagctctgcggcctggtgtaccatccctttaccgagtgtgggacccactgcgtttgtggagccagatatgatacatccgaccggatgaaactgcatcgcgctagcggcctctgccctgggtacaagtccctgagagccgcgcgggtgatgtgtaaatctaagggaccggccagcatcctttccatcattacggctgtcctggtgctcaccttcgttacacccatcaacagcatggtgctgggcgaatctaaagagacctttgagcttgaagaactgcctgatgacatgctcgaaatggcctcccgcattaatagctattacttcacatgcatcctgaactatgctgtctcttgggggctggtgattatcggactcctgaccggccttctgtttaagaagtaccaacacagattcctcaatatttatgccatgtactgtgaggaatgcgacatgtaccacgataaaagcggcctgaagcggcatggggacttcacgaacaaatgtcgccagtgcacatgtggacagtatgaggatgccgctggccttatggcgcacagaaagacctacaattgcctggtccagtataaagccaagtggatgatgaactttctcatcatctacattttcctgatcctgattaaggactccgctatcgtggttcaagccgccgggaccgattttacaacctgcctcgagacagaatctattgactggaactgtacgggacccttcctgaatcttggcaactgccagaaacagcaaaagaaagagccttataccaatatcgctacacagctgaaggggctcaaagccatcagcgtgctggatattcccatcattacccggatcccggacgatattgcgggagctctgagatacatcgaagagagagaagactttcatgtccagcttacaaccgagtatgccatgctctccaagtactgtgattactatacgcagttcagcgacaactctggctactcccaaaccacatggcgggtgtatctgagaagccacgactttgaggcctgcatcctgtaccctaatcagaacttctgtcgctgcgttaagaatggcgaaaaatgttcttccagcaactgggattttgctaatgagatgaaggactattaccccgggaaacaggccaagttcgataaagacctcaacctggctcttaccgccctgcatcacgcgtttcggggaacatcctctgcctatattgctaccatgctcagcaagaagtccaatgatgacctgatcgcctacacgaacaaaattaagacaaaattccctggcaatgctctgcttaaggccatcattgattacatcgcgtatatgaaatctctccccgggatggccaactttaagtacgacgagttctgggatgagctgctgtataaacccaatcctgctaaggccagcaacctcgctagaggaaaggaatccagctacaacttcaaactggccatctcttccaagagcattaaaacctgcaagaatgtgaaagacgtcgcctgtctttctccgcgctccggcgctatctatgcgagcattatcgcctgcggggagcccaacggcccttctgtgtaccggaagcccagcggaggcgtgtttcagtccagcacagatagatctatttattgtctgctcgactcccactgcctggaggagttcgaggctatcagccaagaagaactggatgccgttaagaaatccaagtgctgggagattgaatactctgacgtcaaacctcttcaggaggggaatggaaccaagagctgtcgcatgaaagactccggcaactgcaatgtggccaccaaccggtggcccgtgatccagtgtgaaaatgataagttttactattctgagctccagaaggactacgataaaacacaagacatcgggcattattgcctgagcccgggatgtacgaccgtcagataccctattaaccccaagcacatctccaattgcaactggcaagtgtctcgcagctccattgctaaaatcgatgttcataatattgaagacatcgagcagtataagaaagccatcacacagaagctgcagaccagcctctctctgttcaagtacgcgaaaacaaagaaccttcctcacattaaacccatctataagtacattaccatcgagggcacggaaacagctgaggggattgaatccgcctacatcgagagcgaagtgcctgccctggctggcacctctatcggatttaaaattaattccaaggagggcaaacacctcctggatgtcatcgcctatgttaagagcgcgtcttactccagcgtgtatgctaagctgtactccaccgggcccacaagcggaattaacaccaaacatgacgagctttgtacaggcccgtgccctgccaatatcaaccaccaggtggggtggctcacgttcgccaaggaacggacctctagctggggatgtgaggaatttggctgcctggctgtctccgatgggtgtgtgttcggctcttgccaggacattatcaaagaggaactgagcgtttatagaaaggagacagaggaagtgaccgatgtcgagctctgcctgacattttccgacaaaacctactgtacgaaccttaatcccgtgacccccattatcacagatctgttcgaagtgcaatttaagaccgtcgagacatattctctccctcggatcgttgccgtgcagaaccatgagattaagatcggacagattaatgacctgggcgtgtacagcaaagggtgcggaaacgtccagaaggtgaatggcaccgtttacgggaacggagtgccgcgcttcgactatctgtgtcaccttgcttccagaaaagaagtcatcgtgcggaagtgctttgataatgactaccaagcctgtaaattcctgcagtctcccgcgagctatagactcgaggaagattccggcacagttaccattatcgactacaagaagatcctggggacgattaaaatgaaggccatcctcggcgatgtgaaatataagacattcgctgacagcgtcgatattaccgccgagggatcttgcaccggctgtatcaactgctttgaaaatattcattgtgagctgacacttcacaccacgatcgaggcttcctgccctatcaaaagctcttgtacagtgttccacgaccgcattctggttacccccaacgaacataagtacgccctcaagatggtgtgcacagagaaacctgggaataccctgacaatcaaggtctgcaacaccaaaattgaagcctccatggctctggtggatgcgaagcccatcattgagcttgcccctgtggaccagacggcttatatccgggaaaaagatgagagatgtaagacctggatgtgccgcgtcagagacgagggactgcaggttattctcgaaccctttaagaatctgttcggcagctacatcgggatcttttacacattcattatctccattgtggccctcctggccatcatttatgtgcttctgccgatctgttttaaactccgggacaccctgcgcaagcacgaggatgcttacaaaagagaaatgaagatccggtga

SEQ ID NO: 14328 - RNA, 4326 nt, synthetic construct; identical to SEQ ID NO: 14297
  misc_feature 1..4326: note = derived and/or modified CDS sequence (opt5) from LACV__KP271111.1__GP
  source 1..4326: mol_type = other RNA

SEQ ID NO: 14329 - RNA, 4263 nt, synthetic construct
  misc_feature 1..4263: note = derived and/or modified CDS sequence (opt5) from OROV(BeAn19992)__NC_005775.1__GP
  source 1..4263: mol_type = other RNA
atggccaacctgatcattatcagcatggtgctcggcgtcgcttacgggcaccccctgtccacctctcaaattggagacagatgcttcgccggcgggaatctttttaaggagatgaacctgagcgttggactcggcgaaatctgtgtgaaagatgacatttccatcgtgaagtctacaacggtcttcagcaaaaataagcctgcgctggaggctaccacaaaattttatcggtccttcatcgtgaaggattggtctgaatgcaacccggttcttgacaagtttgggaatttcatggtgctgagcgtcgatgacaacggacatattatccccaaaatgtacacctgtcgcgccgcctgcgatattagactcaataaggacaacgctgagatcattctgtccagcacaaaactgaatcactttgaaatcgtgggcaccacatctacctccggctggttcaagaacacgattaccaataacctcgagcatacatgtgagcacgttaccgtgaattgcgggcagaaaagcgtcaagtttcatgcctgtttccggcagcaccgcggatgcatcagatttttcaagggcacatatatgccttactctatgatcgaagctatgtgtgtgaacattgagctgatcattcttaccctgtatatctttgccgcgattatcttcgccctcatcattacgaaatcctacgtggcttatctgcttctgcccctcttctaccctgtcacatggttttacgggaaggtttataaaaagatcaatagctgccccaactgtctgctggcctctcaccctttcacctcctgcccgaaattttgcatttgtggaagccggttctcctgcacagaagctctcaaggtgcatcgcatgggcaaagattgtctggggtacaagtctcttagcaaggccagacagatgtgcaaatccaagagctggtcttttaccgcggccatcctgaccggactcattctgatggagttcatctcccccatcgctggcgagcggatgtataaacttgaagaactggccgacgaatttattaagctcacagagcaagtgaacatcctggaacgcgagatggaggtcctgaaacaaagcattatcgtgatgttcgctattatcctcgttctgcttctgtttgaaaatatgattttcaacagactctttcggatcttctaccgctcttgtagcatgtgcggcctgatccactatagacctgggcttaagattgatctgacgaagaccaatcggtgtggatcctgcatctgtggctttgacgagcagcagtctagcgggttcgaatacgagattttcctcaaagatatgcatgtgcagaaggaatcctgcaaatttagcccccgcgtcaaccacttcagaaatatcaaggccctgctgtttgccctcgtgatttgtgctacaatctataccgtttacgcggacgaggactgcctgtctaaagatatcaagattacataccaagagcttcacaactgcatcggacctaagattatgggcgacacctgtgtgtccaaaagcgaactgtattctgatctcttctccaagaatctggtcacggagtacgacaaaaagtattttgaacccgatacagtgaacgaccagttcaataaaatcgagtttgcccaggatgctcatcggatgattctgcttgaaagaatcctctacaagaccgagtgcgagatgctgagcctgaagaaaaactccgggccgtataatgtcgcctggcgcacctacctcaagaaccacaatatcgacctgtgttctcggcataactataaaatgatttgccagtgtatcaatacacacagcatgtgcaacaacaccgatattgactacaataaggaaatcgagacatactataaatccaacgccgctgcctacagagcggatcttaatacgattatggacaccctgaagacagctttccgcggactcaccaaagtgctgatcgaaaactatatcgagaaggacgattctgacgccctgaaggccctttttagcaatattacagattccgttcaagacaactaccagatgatcggcattctcaaattcgctagcaagctgctggatatcaatctcggccggtctaccagatccgcccatcacagcattatgacgaacgagatccctaaatctaatccctttaccgactattcctacagcaacctgaatattaaggaatgtatgtctcctgagagccttaaatgcttcaagaagcgcgggtccacaccccacaccaaccatctgctctgtaaaatcgataataagtataaggcttttgactggcccgaaatcgagacaattcagaaaggacaaaaactgtgcctgggcgatagccactgtaaccttgagttcaccgccatcacggcggacaagattatgtctctcacaaattgctacaaggagtccttcaccgcccagcctgctgatatgcaggccgggatcaaaaagtgcagcgctgacgagattggagaatgtacaaccctggaggataaaacctggccgatcatcttttgcggcgggaagtactattactccgactctaaagaacatgccaaggacggcagcattaacaactattgtctgacaaataagtgctccgagcagcggttccccatccacgaaaactggtttaaaaagtgtaattgggataaaacgcacaaggagttctctaccatgagacaaattaactacaatgacatcacaagctatcgcaaagcgattgagtccgaaatcggaaccgatctcatgacacatcactacaagcctaccaaaaacctgccccatgtggtccctcggtatcactctatcgacgtgcagggcacggagagcacagaagggattatcaatggatttattcagaacaccatccccgccatttccggccttggggttggataccatctgaatttccagagcaaccaactctttgatatcgtgattttcgtcaagaaggctgtgtacaaagcccagtatcagaaggcttacaccacaggcccgtctatctccatcaatattgagcacaacgaaagatgcaccgggcactgtcctgagaaaatccccgccaaggagggctggctgacatttagcaaagaacatacgtcttcctggggatgcgaggaatatggctgtctggccattgacaccgggtgcctttacggaagctgtcaggatgtgatccgccctgagctcgacgtttataagaagattggctctgaggtctccctgatcgaaatctgcattacactgccccacgagacctactgcaatgatatggacatcctcgaacctattatcggggataaactgagcgcttccttccaaaacacacagaccaatcagcttcccacgctgattgcgtataagaaaggaaagatctacaccggccagatcaacgacattgggaacacagccctccaatgtggcagcatccaggtgattaatggatctaccatcggcacagggagcccgaaatttgattacatttgccatgctatgcggagaaaggacgtgatcgtccggaagtgtttcaacgacaattatcagtcctgcacccgcctggagaaaagaaacgatctgattccttaccggaagggagacgtgatcgaagtttctaaaacaggcagcaatatggggcaaatgaccttcaagatcgagcttggagatattaactataaaatctttacgaagtccattgacctgcagatgtctggcatctgtgccgggtgcattgattgtgccgagggcatcagctgctccatcaatgctgaagtgcccgccgagacagtctgtcactgcaagaccaactgtgaagacttcattaataacatcgtgttttctccccagattaaaaattacaacatcaaggttcattgcaaaagcaaggtggagaaaattaccgcgcacatctgcggaagagatatcgacctccagctgacaattaagccttataatcaaaagatcgatctctcccagctggacgaaagcaactacattcgcgaggaggatcttcagtgtggcacctggctgtgcaaagtccagaaggaagggatcgacattatcttcaaaggactcttttctggcctggggcggtattggacgattctgatctactccatcattggagtggttatcattgtgatccttgtctacattctgctcccgatcggcagactgctcaaggctttcctgatccgccacgagattgaatatgccatggagcagaaaatcaagtga

SEQ ID NO: 14330 - RNA, 4263 nt, synthetic construct
  misc_feature 1..4263: note = derived and/or modified CDS sequence (opt5) from OROV(BeH759021)__KP691607.1__GP
  source 1..4263: mol_type = other RNA
atggccaacctgatcattatcagcatggtgctctccgtcgcttacggccaccccctgtctaccagccagattggggacagatgcttcgccggaggcaatctttttaaggagatgaacctgtccgttgggctcggagaaatctgtgtgaaagatgacatttctatcgtgaagtccacaacggtcttctccaaaaatcggcctgcgctggaggctaccacaaagttttatcgctctttcatcgtgaaagattggagcgaatgcaacccggttcttgacaagtttggcaatttcatggtgctgtccgtcgatgacaacgggcatattatgcccaagatgtacacctgtagagccgcctgcgatatccggctcaataaagacaacgctgagattatcctgagctctacaaagctgaatcactttgaaattgtgggaaccacatccaccagcggctggttcaaaaacacgatcaccaataacctcgagcatacatgtgagcacgttaccgtgaattgcggccaaaagtctgtcaaatttcatgcctgtttccgccagcacagagggtgcattcggtttttcaagggaacatatatgccttactccatgatcgaagctatgtgtgtgaacatcgagctgattatccttaccctgtatatttttgccgcgatcattttcgccctcatcatcacaaagagctacgtggcttatctgcttctgcccctcttctaccctgtcacgtggttttacggcaaagtttataagaaaattaattcttgccccaactgtctgctggcctcccaccctttcaccagctgcccgaagatctgcatttgtgggtcccgcttttcttgcacagaagctctcaaagtgcatagaatgggaaaggattgtctgggctacaaaagcctttccaaggcccggcagatgtgcaagagcaaatcttggtccttcaccgcggccatcctgaccgggctcattctgatggagtttatcagccccatcgctggagagcgcatgtataagctcgaggagctggccgacgagttcattaaactcacagaacaggtgaacatcctggaaagagaaatggaggtcctgaagcaatctattatcgtgatgtttgctattatcctcgttctgcttctgttcgaaaatatgatttttaaccggcttttcagcatcttttaccgctcctgttctatgtgcggcctgatccactatagacctggccttaaaattgatctgacgaagaccaataagtgtgggagctgcatctgtggattcaacgagcagcagtccagcggctttgaatacgagattttcctcaaagacatgcatatccagaaggaatcttgcaaattcagcccccgggtgaatcactttcgcaacattaaggccctgctgttcgccctcgtcatctgtgctacaatctataccgtgtacgcggatgaggactgcctgagcaaagacattaagatcacataccaagagcttcacaattgcattgggcctaagatcatgggaaacacctgtgtttctaaaaatgaactgtattccgatctctttagcaagaacctggtgacggagtacgacaaaaagtatttcgaacccgatacagtcaatgaccagtttaacaaaattgagttcgcccaggatgctcatagaatgatcctgcttgaacggatcctctacaagaccgagtgcgagatgctgtccctgaagaaaaattctggcccgtataacgtggcctggagaacctacctcaagaatcacaacattgacctgtgtagccgccataactataaaatgatctgccagtgtattaatacacactccatgtgcaagaacaccgatatcgactacaataaagaaattgagacatactataagtctaacgccgctgcctaccgggcggatcttaatacgatcatggacaccctgaaaacagcttttagagggctcaccaaggtcctgatcgaaaactatattgagaaggatgacagcgacgccctgaaagcccttttctccaatatcacagatagcgtgcaagacaactaccagatgattggaatcctcaagtttgcttctaaactgctggatattaatctcggccgctccacccggagcgcccatcactctatcatgacgaacgagattcctaagtccaatcccttcaccgactatagctactctaacgttaatatcaaagaatgtatgagccctgagtccctgaagtgctttaagaaaagagatagcacaccccacaccaaccatcttctgtgtaagatcgactctaaatataaggctttcgattggcccgaaattgagacaatccagaaaggccaaaagctctgcctgggggactcccactgtaatctggaatttaccgccattacggcggataagatcatgagccttacaaactgctacaaagagtccttcaccgcccagcctgctgacatgcagacaggaattaagaaatgctctgccgatgagatcggcgaatgtaccaccctcgaggacaagacatggccgatcgtgttctgcgggggaaaatactattacagcgattccaaggaacatgctaaggacggctctattaacaattattgtctgacgaacaaatgcagcgagcagcgctttcccatccacgaaaattggttcaagaaatgtaactgggacaagacccacaaagagttttccacaatgcggcaaattaattacaacgatatcacctcttatagaaaggccattgagagcgaaatcgggtccgacctgatgacacatcactacaaacctaccaagaatctcccccatgtcgtgcctcgctatcacagcatcgatgttcagggcacggagtctacagaaggaattatcaacggcttcattcagaataccatccccgcgatttccgggctgggagtgggctaccatcttaactttaaggggaatcagctgttcgacatcgtcatttttgtgaaaaaggccgtgtacaaagctcaatatcagaaggcctacaccacaggaccgagcatctctatcaacattgagcacaatgaacggtgcaccggccactgtcctgagaaaatccccgctaaggaggggtggctcacattctccaaggaacatacgagctcttggggctgcgaggaatatggatgtctggccattgataccggctgcctgtacgggtcctgtcaggacgttatcagacctgagcttgatgtctataaaaagattggaagcgaggtgtccctcatcgaaatctgcattacactgccccacgagacctactgcaacgacatggatatcctggaacctattatcggcgacaaactcagcgcctcttttcagaatacacaaaccaaccagctgcccacgcttattgcttataagaaagggaagatctacaccggacagatcaacgatattggcaatacagcgctgcagtgtgggagcatccaagtgattaacggctccaccatcggaacaggctctccgaagttcgactacatttgccatgccatgcgccggaaagatgtcatcgtgagaaagtgttttaatgacaactatcagagctgcacccggctcgagaaacgcaatgacctgattccttacagaaagggggatgttatcgaagtgtccaaaacaggatctaacatgggccagatgaccttcaagatcgagctgggggacgtcaattataagattttcacgaaaagcatcgatcttcaaatgtccggaatttgtgctggctgcatcgactgtgccgaggggatttcttgcagcatcaacgccgaagtgcccgctgagacagtttgtcactgcaagaccaattgtgaagattttatcaacaatattgtgttcagcccccagatcaaaaactacaatattaaggtccattgcaaatccaaggtggagaagatcattgcccacatctgcggccgggacatcgatctgcagctcaccgttaaaccttataaccagaagattgacctgtctcaactcgatgaatccaattacatcagagaggaggacctgcagtgtggaacatggctttgcaaagtgcagaaggaaggcgtcgatattatctttaaagggctgttcagcggactcggccgctattggaccattctgatctactctattatcggggtggtgatcattgtcatcctggtttacattcttctgccgatcggacggctcctgaaggcgtttctcattagacacgagatcgaatatgctatggagcagaaaatcaagtga

SEQ ID NO: 14331 - RNA, 4263 nt, synthetic construct
  misc_feature 1..4263: note = derived and/or modified CDS sequence (opt5) from OROV(BeH759022)__KP691610.1__GP
  source 1..4263: mol_type = other RNA
atggccaacctgatcattatcagcatggctctctccgtggcctacggccaccccctgtctaccagccagattggggacagatgcttcgcgggaggcaatctttttaaggagatgaacctgtccgtcgggctcggagaaatctgtgttaaagatgacatttctatcgtgaagtccacaacggtgttctccaaaaatcggcctgctctggaggccaccacaaagttttatcgctctttcatcgtcaaagattggagcgaatgcaacccggtgcttgacaagtttggcaatttcatggttctgtccgtggatgacaacgggcatattatgcccaagatgtacacctgtagagccgcttgcgatatccggctcaataaagacaacgccgagattatcctgagctctacaaagctgaatcactttgaaattgtcggaaccacatccaccagcggctggttcaaaaacacgatcaccaataacctcgagcatacatgtgagcacgtgaccgttaattgcggccaaaagtctgtgaaatttcatgcttgtttccgccagcacagagggtgcattcggtttttcaagggaacatatatgccttactccatgatcgaagccatgtgtgtcaacatcgagctgattatccttaccctgtatatttttgcggccatcattttcgctctcatcatcacaaagagctacgtggcctatctgcttctgcccctcttctaccctgtgacgtggttttacggcaaagtctataagaaaattaattcttgccccaactgtctgctggcttcccaccctttcaccagctgcccgaagatctgcatttgtgggtcccgcttttcttgcacagaagccctcaaagttcatagaatgggaaaggattgtctgggctacaaaagcctttccaaggcgcggcagatgtgcaagagcaaatcttggtccttcaccgccgctatcctgaccgggctcattctgatggagtttatcagccccatcgccggagagcgcatgtataagctcgaggagctggctgacgagttcattaaactcacagaacaggtgaacatcctggaaagagaaatggaggtgctgaagcaatctattatcgtcatgtttgccattatcctcgtgctgcttctgttcgaaaatatgatttttaaccggcttttcagcatcttttaccgctcctgttctatgtgcggcctgatccactatagacctggccttaaaattgatctgacgaagaccaataagtgtgggagctgcatctgtggattcaacgagcagcagtccagcggctttgaatacgagattttcctcaaagacatgcatatccagaaggaatcttgcaaattcagcccccgggttaatcactttcgcaacattaaggccctgctgttcgctctcgtgatctgtgcgacaatctataccgtctacgccgatgaggactgcctgagcaaagacattaagatcacataccaagagcttcacaattgcattgggcctaagatcatgggaaacacctgtgtgtctaaaaatgaactgtattccgatctctttagcaagaacctggttacggagtacgacaaaaagtatttcgaacccgatacagtgaatgaccagtttaacaaaattgagttcgctcaggatgcccatagaatgatcctgcttgaacggatcctctacaagaccgagtgcgagatgctgtccctgaagaaaaattctggcccgtataacgtcgcctggagaacctacctcaagaatcacaacattgacctgtgtagccgccataactataaaatgatctgccagtgtattaatacacactccatgtgcaagaacaccgatatcgactacaataaagaaattgagacatactataagtctaacgctgccgcgtaccgggctgatcttaatacgatcatggacaccctgaaaacagcctttagagggctcaccaaggtgctgatcgaaaactatattgagaaggatgacagcgacgccctgaaagctcttttctccaatatcacagatagcgtccaagacaactaccagatgattggaatcctcaagtttgcctctaaactgctggatattaatctcggccgctccacccggagcgctcatcactctatcatgacgaacgagattcctaagtccaatcccttcaccgactatagctactctaacgtgaatatcaaagaatgtatgagccctgagtccctgaagtgctttaagaaaagagatagcacaccccacaccaaccatcttctgtgtaagatcgactctaaatataaggccttcgattggcccgaaattgagacaatccagaaaggccaaaagctctgcctgggggactcccactgtaatctggaatttaccgcgattacggccgataagatcatgagccttacaaactgctacaaagagtccttcaccgctcagcctgccgacatgcagacaggaattaagaaatgctctgctgatgagatcggcgaatgtaccaccctcgaggacaagacatggccgatcgttttctgcgggggaaaatactattacagcgattccaaggaacatgccaaggacggctctattaacaattattgtctgacgaacaaatgcagcgagcagcgctttcccatccacgaaaattggttcaagaaatgtaactgggacaagacccacaaagagttttccacaatgcggcaaattaattacaacgatatcacctcttatagaaaggcgattgagagcgaaatcgggtccgacctgatgacacatcactacaaacctaccaagaatctcccccatgtggtccctcgctatcacagcatcgatgtgcagggcacggagtctacagaaggaattatcaacggcttcattcagaataccatccccgccatttccgggctgggagttggctaccatcttaactttaaggggaatcagctgttcgacatcgtgatttttgtcaaaaaggctgtgtacaaagcccaatatcagaaggcttacaccacaggaccgagcatctctatcaacattgagcacaatgaacggtgcaccggccactgtcctgagaaaatccccgccaaggaggggtggctcacattctccaaggaacatacgagctcttggggctgcgaggaatatggatgtctggccattgataccggctgcctgtacgggtcctgtcaggacgtgatcagacctgagcttgatgtttataaaaagattggaagcgaggtctccctcatcgaaatctgcattacactgccccacgagacctactgcaacgacatggatatcctggaacctattatcggcgacaaactcagcgcttcttttcagaatacacaaaccaaccagctgcccacgcttattgcgtataagaaagggaagatctacaccggacagatcaacgatattggcaatacagccctgcagtgtgggagcatccaagtgattaacggctccaccatcggaacaggctctccgaagttcgactacatttgccatgctatgcgccggaaagatgtgatcgtcagaaagtgttttaatgacaactatcagagctgcacccggctcgagaaacgcaatgacctgattccttacagaaagggggatgtgatcgaagtttccaaaacaggatctaacatgggccagatgaccttcaagatcgagctgggggacgtgaattataagattttcacgaaaagcatcgatcttcaaatgtccggaatttgtgccggctgcatcgactgtgccgaggggatttcttgcagcatcaacgctgaagtccccgccgagacagtgtgtcactgcaagaccaattgtgaagattttatcaacaatattgttttcagcccccagatcaaaaactacaatattaaggtgcattgcaaatccaaggtcgagaagatcattgcgcacatctgcggccgggacatcgatctgcagctcaccgtgaaaccttataaccagaagattgacctgtctcaactcgatgaatccaattacatcagagaggaggacctgcagtgtggaacatggctttgcaaagttcagaaggaaggcgtggatattatctttaaagggctgttcagcggactcggccgctattggaccattctgatctactctattatcggggtcgtgatcattgtgatcctggtctacattcttctgccgatcggacggctcctgaaggcttttctcattagacacgagatcgaatatgccatggagcagaaaatcaagtga

SEQ ID NO: 14332 - RNA, 4263 nt, synthetic construct
  misc_feature 1..4263: note = derived and/or modified CDS sequence (opt5) from OROV(BeH759040)__KP691616.1__GP
  source 1..4263: mol_type = other RNA
atggccaacctgatcattatcagcatgattctctccgtggcttacggccaccccctgtctaccagccagatcggggacagatgcttcgccggaggcaatctttttaaggagatgaacctgtccgtcgggctcggagaaatttgtgttaaagatgacatctctatcgtcaagagcacaacggtgttctccaaaaatcggcctgcgctggaggctaccacaaagttttatcgctctttcattgtgaaagattggagcgaatgcaacccggtgcttgacaagtttggcaatttcatggttctgtccgtggatgacaacgggcatatcatgcccaagatgtacacctgtagagccgcctgcgatattcggctcaataaagacaacgctgagatcattctgagctctacaaagctgaatcactttgaaatcgtcggaaccacatccaccagcggctggttcaaaaacacgattaccaataacctcgagcatacatgtgagcacgtgaccgttaattgcggccaaaagtctgtgaaatttcatgcctgtttccgccagcacagagggtgcatccggtttttcaagggaacatatatgccttactccatgatcgaagctatgtgtgtcaacattgagctgatcattcttaccctgtatatctttgccgcgattatcttcgccctcatcattacaaagagctacgtggcttatctgcttctgcccctcttctaccctgtgacgtggttttacggcaaagtctataagaaaatcaattcttgccccaactgtctgctggcctcccaccctttcaccagctgcccgaagatttgcatctgtgggtcccgcttttcttgcacagaagctctcaaagttcatagaatgggaaaggattgtctgggctacaaaagcctttccaaggcccggcagatgtgcaagagcaaatcttggtccttcaccgcggccattctgaccgggctcatcctgatggagtttatcagccccattgctggagagcgcatgtataagctcgaggagctggccgacgagttcatcaaactcacagaacaggtgaacattctggaaagagaaatggaggtgctgaagcaatctatcattgtcatgtttgctatcattctcgtgctgcttctgttcgaaaatatgatctttaaccggcttttcagcatcttttaccgctcctgttctatgtgcggcctgattcactatagacctggccttaaaatcgatctgacgaagaccaataagtgtgggagctgcatttgtggattcaacgagcagcagtccagcggctttgaatacgagatcttcctcaaagacatgcatattcagaaggaatcttgcaaattcagcccccgggttaatcactttcgcaacatcaaggccctgctgttcgccctcgtgatctgtgctacaatttataccgtctacgcggatgaggactgcctgtccaaagacatcaagattacataccaagagcttcacaattgcatcgggcctaagattatgggaaacacctgtgtgtctaaaaatgaactgtattccgatctctttagcaagaacctggttacggagtacgacaaaaagtatttcgaacccgatacagtgaatgaccagtttaacaaaatcgagttcgcccaggatgctcatagaatgatcctgcttgaacggattctctacaagaccgagtgcgagatgctgtccctgaagaaaaattctggcccgtataacgtcgcctggagaacctacctcaagaatcacaacatcgacctgtgtagccgccataactataaaatgatttgccagtgtatcaatacacactccatgtgcaagaacaccgatattgactacaataaagaaatcgagacatactataagtctaacgccgctgcctaccgggcggatcttaatacgatcatggacaccctgaaaacagcttttagagggctcaccaaggtgctgattgaaaactatatcgagaaggatgacagcgacgccctgaaagcccttttctccaatattacagatagcgtccaagacaactaccagatgatcggcattctcaagtttgcttctaaactgctggatatcaatctcggacgctccacccggagcgcccatcactctattatgacgaacgagatccctaagtccaatcccttcaccgactatagctactctaacgtgaatatcaaagaatgtatgagccctgagtccctgaagtgctttaagaaaagagatagcacaccccacaccaaccatcttctgtgtaagattgactctaaatataaggctttcgattggcccgaaatcgagacaattcagaaaggccaaaagctctgcctgggggactcccactgtaatctggaatttaccgccatcacggcggataagattatgagccttacaaactgctacaaagagtccttcaccgcccagcctgctgacatgcagacaggaatcaagaaatgctctgccgatgagatcggcgaatgtaccaccctcgaggacaagacatggccgattgttttctgcgggggaaaatactattacagcgattccaaggaacatgctaaggacggctctatcaacaattattgtctgacgaacaaatgcagcgagcagcgctttcccattcacgaaaattggttcaagaaatgtaactgggacaagacccacaaagagttttccacaatgcggcaaatcaattacaacgatattacctcttatagaaaggccatcgagagcgaaatcgggtccgacctgatgacacatcactacaaacctaccaagaatctcccccatgtggtccctcgctatcacagcattgatgtgcagggcacggagtctacagaaggaatcattaacggcttcatccagaataccattcccgcgatctccgggctgggagttggctaccatcttaactttaaggggaatcagctgttcgacattgtgatctttgtcaaaaaggccgtgtacaaagctcaatatcagaaggcctacaccacaggaccgagcatctctattaacatcgagcacaatgaacggtgcaccggccactgtcctgagaaaattcccgctaaggaggggtggctcacattctccaaggaacatacgagctcttggggctgcgaggaatatggatgtctggccatcgataccggctgcctgtacgggtcctgtcaggacgtgattagacctgagcttgatgtttataaaaagatcggaagcgaggtctccctcatcgaaatttgcatcacactgccccacgagacctactgcaacgacatggatattctggaacctatcattggcgacaaactcagcgcctcttttcagaatacacaaaccaaccagctgcccacgcttatcgcttataagaaagggaagatctacaccggacagattaacgatatcggcaatacagcgctgcagtgtgggagcattcaagtgatcaacggctccaccattggaacaggctctccgaagttcgactacatctgccatgccatgcgccggaaagatgtgattgtcagaaagtgttttaatgacaactatcagagctgcacccggctcgagaaacgcaatgacctgatcccttacagaaagggggatgtgatcgaagtttccaaaacaggatctaacatgggccagatgaccttcaagattgagctgggggacgtgaattataagatcttcacgaaaagcattgatcttcaaatgtccggaatctgtgctggctgcattgactgtgccgaggggatctcttgcagcatcaacgccgaagtccccgctgagacagtgtgtcactgcaagaccaattgtgaagattttattaacaatatcgttttcagcccccagattaaaaactacaatatcaaggtgcattgcaaatccaaggtcgagaagattatcgcccacatctgcggccgggacattgatctgcagctcaccgtgaaaccttataaccagaagatcgacctgtctcaactcgatgaatccaattacattagagaggaggacctgcagtgtggaacatggctttgcaaagttcagaaggaaggcgtggatatcatttttaaagggctgttcagcggactcggccgctattggaccatcctgatttactctatcatcggggtcgtgattatcgtgattctggtctacatccttctgccgattggacggctcctgaaggcgtttctcatcagacacgagatcgaatatgctatggagcagaaaattaagtga

SEQ ID NO: 14333 - RNA, 4263 nt, synthetic construct
  misc_feature 1..4263: note = derived and/or modified CDS sequence (opt5) from OROV(BeH759146)__KP691631.1__GP
  source 1..4263: mol_type = other RNA
atggccaacctgatcattatcagcatggtgctctccgtcgcttacggccaccccctgtctaccagccagattggggacagatgcttcgccggaggcaatctttttaaggagatgaacctgtccgttgggctcggagaaatctgtgtgaaagatgacatttctatcgtcaagagcacaacggtgttctccaaaaatcggcctgcgctggaggctaccacaaagttttatcgctctttcatcgtgaaagattggagcgaatgcaacccggttcttgacaagtttggcaatttcatggtgctgtccgtcgatgacaacgggcatattatgcccaagatgtacacctgtagagccgcctgcgatatccggctcaataaagacaacgctgagattatcctgagctctacaaagctgaatcactttgaaattgtgggaaccacatccaccagcggctggttcaaaaacacgatcaccaataacctcgagcatacatgtgagcacgttaccgtgaattgctgtcaaaagtctgtcaaatttcatgcctgcttccgccagcacagaggctgtattcggtttttcaaggggacatatatgccttactccatgatcgaagctatgtgcgtgaacatcgagctgattatccttaccctgtatatttttgccgcgatcattttcgccctcatcatcaccaagagctacgtggcttatctgcttctgcccctcttctaccctgtcacatggttttacggaaaagtttataagaaaattaattcttgtcccaactgcctgctggcctcccaccctttcaccagctgcccgaagatctgtatttgcggctcccgcttttcttgtacagaagctctcaaagtgcatagaatggggaaggattgcctgggatacaaaagcctttccaaggcccggcagatgtgtaagagcaaatcttggtccttcaccgcggccatcctgaccggcctcattctgatggagtttatcagccccatcgctggggagcgcatgtataagctcgaggagctggccgacgagttcattaaactcacagaacaggtgaacatcctggaaagagaaatggaggtcctgaagcaatctattatcgtgatgtttgctattatcctcgttctgcttctgttcgaaaatatgatttttaaccggcttttcagcatcttttaccgctcctgctctatgtgtggactgatccactatagacctggccttaaaattgatctgacgaagaccaataagtgcggcagctgtatctgcgggttcaacgagcagcagtccagcggatttgaatacgagattttcctcaaagacatgcatatccagaaggaatcttgtaaattcagcccccgggtgaatcactttcgcaacattaaggccctgctgttcgccctcgtcatctgcgctacaatctataccgtgtacgcggatgaggactgcctgtccaaagacattaagatcacataccaagagcttcacaattgtattggccctaagatcatggggaatacctgcgtttctaaaaacgaactgtattccgatctctttagcaagaacctggtgacggagtacgacaaaaagtatttcgaacccgatacagtcaatgaccagtttaacaaaattgagttcgcccaggatgctcatagaatgatcctgcttgaacggatcctctacaagaccgagtgtgagatgctgtccctgaagaaaaattctggaccgtataacgtggcctggagaacctacctcaagaatcacaacattgacctgtgcagccgccataactataaaatgatctgtcagtgcattaatacacactccatgtgtaagaacaccgatatcgactacaataaagaaattgagacatactataagtctaacgccgctgcctaccgggcggatcttaatatcatcatggacacgctgaaaaccgcttttagaggcctcacaaaggtcctgattgaaaactatatcgagaaggatgacagcgacgccctgaaagcccttttctccaatattaccgatagcgtgcaagacaactaccagatgatcgggattctcaagtttgcttctaaactgctggatatcaatctcggacgctccacacggagcgcccatcactctattatgaccaacgagatccctaagtccaatcccttcacggactatagctactctaacgttaatatcaaagaatgcatgagccctgagtccctgaagtgttttaagaaaagagatagcacgccccacacaaaccatcttctgtgcaagattgactctaaatataaggctttcgattggcccgaaatcgagaccattcagaaaggccaaaagctctgtctgggcgactcccactgcaatctggaatttacagccatcaccgcggataagattatgagccttacgaactgctacaaagagtccttcacagcccagcctgctgacatgcagaccgggatcaagaaatgttctgccgatgagatcggagaatgcacaaccctcgaggacaagacctggccgattgtgttctgtggcgggaaatactattacagcgattccaaggaacatgctaaggacggatctatcaacaattattgcctgacaaacaaatgtagcgagcagcgctttcccattcacgaaaattggttcaagaaatgcaactgggacaagacgcacaaagagttttccaccatgcggcaaatcaattacaacgatattacatcttatagaaaggccatcgagagcgaaatcggctccgacctgatgacccatcactacaaacctacaaagaatctcccccatgtcgtgcctcgctatcacagcattgatgttcaggggaccgagtctacggaaggcatcattaacggattcatccagaatacaattcccgcgatctccggcctgggggtgggataccatcttaactttaagggcaatcagctgttcgacattgtcatctttgtgaaaaaggccgtgtacaaagctcaatatcagaaggcctacaccaccgggccgagcatctctattaacatcgagcacaatgaacggtgtacaggacactgccctgagaaaattcccgctaaggagggctggctcaccttctccaaggaacatacaagctcttgggggtgtgaggaatatgtttgcctggccatcgatacgggctgtctgtacggatcctgccaggacgtcattagacctgagcttgatgtgtataaaaagatcggcagcgaggtgtccctcatcgaaatttgcatcaccctgccccacgagacatactgtaacgacatggatattctggaacctatcattggggacaaactcagcgcctcttttcagaatacccaaacaaaccagctgcccacccttatcgcttataagaaaggaaagatctacacgggccagattaacgatatcgggaataccgcgctgcagtgcggaagcattcaagtcatcaacggctccacaattgggaccggctctccgaagttcgactacatctgtcatgccatgcgccggaaagatgtgattgttagaaagtgctttaatgacaactatcagagctgtacacggctcgagaaacgcaatgacctgatcccttacagaaagggagatgtgatcgaagtctccaaaaccggctctaacatggggcagatgacattcaagattgagctgggagacgtgaattataagatcttcaccaaaagcattgatcttcaaatgtccggcatctgcgctgggtgtattgactgcgccgagggaatctcttgtagcatcaacgccgaagttcccgctgagacggtgtgccactgtaagacaaattgcgaagattttattaacaatatcgtcttcagcccccagattaaaaactacaatatcaaggtgcattgcaaatccaaggttgagaagattatcgcccacatctgtggccgggacattgatctgcagctcaccgtgaaaccttataaccagaagatcgacctgtctcaactcgatgaatccaattacattagagaggaggacctgcagtgcgggacctggctttgtaaagtccagaaggaaggcgtggatatcatttttaaaggactgttcagcggcctcgggcgctattggacaatcctgatttactctatcatcggagtggtcattatcgttattctggtgtacatccttctgccgattggccggctcctgaaggcgtttctcatcagacacgagatcgaatatgctatggagcagaaaattaagtga

SEQ ID NO: 14334 - RNA, 4263 nt, synthetic construct
  misc_feature 1..4263: note = derived and/or modified CDS sequence (opt5) from OROV(BeH759620)__KP691622.1__GP
  source 1..4263: mol_type = other RNA
atggccaacctgatcattatcagcatggtgctctccgtcgcttacggccaccccctgtctaccagccagattggggacagatgcttcgccggaggcaatctttttaaggagatgaacctgtccgttgggctcggagaaatctgtgtgaaagatgacatttctatcgtgaagtccacaacggtcttctccaaaaatcggcctgcgctggaggctaccacaaagttttatcgctctttcatcgtgaaagattggagcgaatgcaacccggttcttgacaagtttggcaatttcatggtgctgtccgtcgatgacaacgggcatattatgcccaagatgtacacctgtagagccgcctgcgatatccggctcaataaagacaacgctgagattatcctgagctctacaaagctgaatcactttgaaattgtgggaaccacatccaccagcggctggttcaaaaacacgatcaccaataacctcgagcatacatgtgagcacgttaccgtgaattgcggccaaaagtctattaaatttcatgcctgtttccgccagcacagagggtgcatccggtttttcaagggaacatatatgccttactccatgatcgaagctatgtgtgtcaacattgagctgatcattcttaccctgtatatctttgccgcgattatcttcgccctcatcattacaaagagctacgtggcttatctgcttctgcccctcttctaccctgtgacgtggttttacggcaaagtctataagaaaatcaattcttgccccaactgtctgctggcctcccaccctttcaccagctgcccgaagatttgcatctgtgggtcccgcttttcttgcacagaagctctcaaagttcatagaatgggaaaggattgtctgggctacaaaagcctttccaaggcccggcagatgtgcaagagcaaatcttggtccttcaccgcggccattctgaccgggctcatcctgatggagtttatcagccccattgctggagagcgcatgtataagctcgaggagctggccgacgagttcatcaaactcacagaacaggtgaacattctggaaagagaaatggaggtgctgaagcaatctatcattgtcatgtttgctatcattctcgtgctgcttctgttcgaaaatatgatctttaaccggcttttcagcatcttttaccgctcctgttctatgtgcggcctgattcactatagacctggccttaaaatcgatctgacgaagaccaataagtgtgggagctgcatttgtggattcaacgagcagcagtccagcggctttgaatacgagatcttcctcaaagacatgcatattcagaaggaatcttgcaaattcagcccccgggttaatcactttcgcaacatcaaggccctgctgttcgccctcgtgatctgtgctacaatttataccgtctacgcggatgaggactgcctgagcaaagacatcaagattacataccaagagcttcacaattgcatcgggcctaagattatgggaaacacctgtgtgtctaaaaatgaactgtattccgatctctttagcaagaacctggttacggagtacgacaaaaagtatttcgaacccgatacagtgaatgaccagtttaacaaaatcgagttcgcccaggattcccatagaatgatcctgcttgaacggattctctacaagaccgagtgcgagatgctgtctctgaagaaaaatagcggcccgtataacgtcgcttggagaacctacctcaagaatcacaacatcgacctgtgttcccgccataactataaaatgatttgccagtgtatcaatacacactctatgtgcaagaacaccgatattgactacaataaagaaatcgagacatactataagagcaacgccgccgcttaccgggccgatcttaatacgatcatggacaccctgaaaacagcgtttagagggctcaccaaggtgctgattgaaaactatatcgagaaggatgactccgacgctctgaaagcccttttcagcaatattacagattctgtccaagacaactaccagatgatcggcattctcaagtttgcctccaaactgctggatatcaatctcggacgcagcacccggtctgctcatcactccattatgacgaacgagatccctaagagcaatcccttcaccgactattcttacagcaacgtgaatatcaaagaatgtatgtcccctgagagcctgaagtgctttaagaaaagagattctacaccccacaccaaccatcttctgtgtaagattgactccaaatataaggccttcgattggcccgaaatcgagacaattcagaaaggccaaaagctctgcctgggggacagccactgtaatctggaatttaccgctatcacggccgataagattatgtcccttacaaactgctacaaagagtctttcaccgcgcagcctgccgacatgcagacaggaatcaagaaatgcagcgctgatgagatcggcgaatgtaccaccctcgaggacaagacatggccgattgttttctgcgggggaaaatactattactccgattctaaggaacatgccaaggacggcagcatcaacaattattgtctgacgaacaaatgctccgagcagcgctttcccattcacgaaaattggttcaagaaatgtaactgggacaagacccacaaagagttttctacaatgcggcaaatcaattacaacgatattaccagctatagaaaggctatcgagtccgaaatcgggagcgacctgatgacacatcactacaaacctaccaagaatctcccccatgtggtccctcgctatcactctattgatgtgcagggcacggagtccacagaaggaatcattaacggcttcatccagaataccattcccgccatcagcgggctgggagttggctaccatcttaactttaaggggaatcagctgttcgacattgtgatctttgtcaaaaaggcggtgtacaaagcccaatatcagaaggcttacaccacaggaccgtctatctccattaacatcgagcacaatgaacggtgcaccggccactgtcctgagaaaattcccgccaaggaggggtggctcacattcagcaaggaacatacgtcttcctggggctgcgaggaatatggatgtctggctatcgataccggctgcctgtacgggagctgtcaggacgtgattagacctgagcttgatgtttataaaaagatcggatccgaggtcagcctcatcgaaatttgcatcacactgccccacgagacctactgcaacgacatggatattctggaacctatcattggcgacaaactctctgccagctttcagaatacacaaaccaaccagctgcccacgcttatcgcctataagaaagggaagatctacaccggacagattaacgatatcggcaatacagctctgcagtgtgggtccattcaagtgatcaacggctctaccattggaacaggcagcccgaagttcgactacatctgccatgcgatgcgccggaaagatgtgattgtcagaaagtgttttaatgacaactatcagtcctgcacccggctcgagaaacgcaatgacctgatcccttacagaaagggggatgtgatcgaagtttctaaaacaggaagcaacatgggccagatgaccttcaagattgagctgggggacgtgaattataagatcttcacgaaatccattgatcttcaaatgtctggaatctgtgccggctgcattgactgtgctgaggggatcagctgctccatcaacgccgaagtccccgccgagacagtgtgtcactgcaagaccaattgtgaagattttattaacaatatcgttttcagcccccagattaaaaactacaatatcaaggtgcattgcaaatctaaggtcgagaagattatcgctcacatctgcggccgggacattgatctgcagctcaccgtgaaaccttataaccagaagatcgacctgtcccaactcgatgaaagcaattacattagagaggaggacctgcagtgtggaacatggctttgcaaagttcagaaggaaggcgtggatatcatttttaaagggctgttctctggactcggccgctattggaccatcctgatttactccatcatcggggtcgtgattatcgtgattctggtctacatccttctgccgattggacggctcctgaaggcctttctcatcagacacgagatcgaatatgcgatggagcagaaaattaagtga

SEQ ID NO: 14335 - RNA, 4263 nt, synthetic construct
  misc_feature 1..4263: note = derived and/or modified CDS sequence (opt5) from OROV(BeAn19991)__KP052851.1__GP
  source 1..4263: mol_type = other RNA
atggccaacctgatcattatcagcatggtgctcggcgtcgcttacgggcaccccctgtccacctctcagattggagacagatgcttcgccggcgggaatctttttaaggagatgaacctgagcgttggactcggcgaaatctgtgtgaaagatgacatttccatcgtgaagtctacaacggtcttcagcaaaaataagcctgcgctggaggctaccacaaaattttatcggtccttcatcgtgaaggattggtctgaatgcaacccggttcttgacaagtttgggaatttcatggtgctgagcgtcgatgacaacggacatattatccccaaaatgtacacctgtcgcgccgcctgcgatattagactcaataaggacaacgctgagatcattctgtccagcacaaaactgaatcactttgaaatcgtgggcaccacatctacctccggctggttcaagaacacgattaccaataacctcgagcatacatgtgagcacgttaccgtgaattgcgggcaaaaatccgtcaagtttcatgcctgtttccggcagcaccgcggatgcatcagatttttcaagggcacatatatgccttactctatgatcgaagctatgtgtgtgaacattgagctgatcattcttaccctgtatatctttgccgcgattatcttcgccctcatcattacgaaatcctacgtggcttatctgcttctgcccctcttctaccctgtcacatggttttacgggaaggtttataaaaagatcaatagctgccccaactgtctgctggcctctcaccctttcacctcctgcccgaaaatttgcatctgtggaagccggttttcctgcacagaagctctcaaggtgcatcgcatgggcaaagattgtctggggtacaagtctcttagcaaggccagacagatgtgcaaatccaagagctggtctttcaccgcggccattctgaccggactcatcctgatggagtttatctcccccattgctggcgagcggatgtataaacttgaggagctggccgacgaatttatcaagctcacagaacaggtgaacattctggaacgcgagatggaggtcctgaaacaaagcatcattgtgatgtttgctatcattctcgttctgcttctgttcgaaaatatgatctttaacagactcttccggatcttttaccgctcttgtagcatgtgcggcctgattcactatagacctgggcttaagatcgatctgacgaagaccaatcggtgtggatcctgcatttgtggcttcgacgagcagcagtctagcgggtttgaatacgagatcttcctcaaagatatgcatgtgcagaaggaatcctgcaaattcagcccccgcgtcaaccactttagaaatattaaggccctgctgttcgccctcgtgatctgtgctacaatctataccgtttacgcggacgaggactgcctgtctaaagatattaagatcacataccaagagcttcacaactgcattggacctaagatcatgggcgacacctgtgtgtccaaaagcgaactgtattctgatctcttttccaagaatctggtcacggagtacgacaaaaagtatttcgaacccgatacagtgaacgaccagtttaataaaattgagttcgcccaggatgctcatcggatgatcctgcttgaaagaatcctctacaagaccgagtgcgagatgctgagcctgaagaaaaactccgggccgtataatgtcgcctggcgcacctactttaagaaccacaatattgacctctgttctcggcataactataaaatgatctgccagtgtattaatacacacagcatgtgcaagaacaccgatatcgactacaacaaagaaattgagacatactataagtccaatgccgctgcctacagagcggatctgaacacgatcatggacacccttaaaacagctttccgcggactgaccaaggtgctcatcgaaaattatattgagaaggacgattctgacgccctgaaagccctgtttagcaacatcacagattccgttcaagacaattaccagatgattggcatccttaagttcgctagcaaactcctggatattaacctgggccggtctaccagatccgcccatcacagcatcatgacgaatgagattcctaagtctaacccctttaccgactattcctacagcaatctcaacatcaaagaatgtatgtctcctgagagcctgaagtgcttcaagaaacgcgattccacaccccacaccaatcatcttctgtgtaagatcgacaacaaatataaggcttttgattggcccgaaattgagacaatccagaaagggcaaaagctctgcctgggagacagccactgtaatctggagttcaccgccattacggcggataagatcatgtctcttacaaactgctacaaagaatccttcaccgcccagcctgctgacatgcaggccggcattaagaaatgcagcgctgatgagatcggggaatgtacaaccctcgaggacaagacctggccgatcattttctgcggaggcaaatactattactccgactctaaggaacatgccaaggatgggagcatcaataactattgtctgacaaacaaatgctccgagcagcggttccccattcacgaaaattggtttaagaaatgtaactgggacaagacgcacaaagagttctctaccatgagacaaatcaattacaacgatattacaagctatcgcaaggcgatcgagtccgaaatcggcaccgacctgatgacacatcactacaaacctaccaagaatctcccccatgtggtccctcggtatcactctattgatgtgcagggaacggagagcacagaaggcatcattaacgggtttatccagaataccattcccgccatctccggactgggcgttgggtaccatcttaacttcaagggaaatcagctgtttgacattgtgatcttcgtcaaaaaggctgtgtacaaagcccaatatcagaaggcttacaccacaggcccgagcatctctattaacatcgagcacaatgaaagatgcaccgggcactgtcctgagaaaattcccgccaaggagggctggctcacattttccaaggaacatacgagctcttggggatgcgaggaatatggctgtctggccatcgataccgggtgcctgtacggatcctgtcaggacgtgattcgccctgagcttgatgtttataaaaagatcggcagcgaggtctctctcatcgaaatttgcatcacactgccccacgagacctactgcaacgacatggatattctggaacctatcattggggacaaactctccgctagcttccagaatacacaaaccaaccagctgcccacgcttatcgcgtataagaaaggaaagatctacaccggccagattaatgatatcgggaacacagccctgcagtgtggctccattcaagtgatcaacggaagcaccattggcacagggtctccgaagtttgactacatctgccatgctatgcggagaaaagacgtgattgtccggaagtgtttcaatgataactatcagagctgcacccgcctcgagaaaagaaatgacctgatcccttaccggaagggagatgtgatcgaagtttccaaaacaggctctaacatggggcagatgaccttcaagattgagctgggagacatcaattataagatttttacgaaaagcatcgatcttcaaatgtccggcatttgtgccgggtgcatcgactgtgccgagggcatctcttgcagcattaacgctgaagtgcccgccgagacagtctgtcactgcaagaccaattgtgaagatttcatcaacaatattgtgtttagcccccagatcaaaaactacaatattaaggttcattgcaaatctaaggtggagaagatcaccgcgcacatctgcggaagagacattgatctgcagctcacaatcaaaccttataaccagaagattgacctgagccaactcgatgaatccaattacatccgcgaggaggacctgcagtgtggcacctggctttgcaaagtccagaaggaagggattgacatcattttcaaaggactgtttagcggcctcgggcggtattggacgatcctgatctactctattatcggagtggttattatcgtgattctggtctacatccttctgccgatcggcagactcctgaaggctttcctcattcgccacgagatcgaatatgccatggagcagaaaattaagtga

SEQ ID NO: 14336 - RNA, 4263 nt, synthetic construct
  misc_feature 1..4263: note = derived and/or modified CDS sequence (opt5) from OROV(Tr9760)__AF312381.2__GP
  source 1..4263: mol_type = other RNA
atggccaacctgatcattatcagcatggtgctctccattgcttacggccaccccctgtctaccagccagatcggggacagatgcttcgccggaggcaatctttttaaggagatgaacctgtccgtcgggctcggagaaatttgtgttaaagatgacatctctatcgtcaagagcacaacggtgttctccaaaaataagctggcgcttgaggctaccacaaaattttatcggtctttcattgtgaaggattggagcgaatgcaaccctgtgctggacaagtttggcaatttcatggttctctccgtggatgacaacgggcataccatcccgaaaatgtacacatgtcgcgccgcctgcgatattagactgaataaggacaacgctgagatcattctgagctctaccaaactcaatcactttgaaatcgtcggaacaacctccacgagcggctggttcaagaacaccattacaaataacctggagcatacctgtgagcacgtgacagttaattgcggccaaaaatctgtgaagtttcatgcctgtttccggcagcaccgcgggtgcgtcagatttttcaagggaacctatatgccccactccatgatcgaagctatgtgtgtgaacatcgagcttattatcctgacgctctacatttttgccgcgatcattttcgccctgatcatcacaaaaagctatgtggcttaccttctgctccctctgttctatcccgccacctggttttacggcaaggtctacaaaaagattaattcttgccctaactgtctgctcgcttcccatcccttcacaagctgccctaaaatctgcatttgtgggtcccggttttcttgcaccgaagccctgaaggttcaccgcatgggaaaagattgtcttggctataagagcctgtccaaggcgagacagatgtgcaaaagcaagtcttggtccttcaccgccgctatcctcacagggctgattcttatggagtttatcagcccgatcgccggagagcggatgtacaaactggaggagctcgctgacgagttcattaagctgacggaacaggtgaacatcctggaacgcgaaatggaggtgctcaaacaatctattatcgtcatgtttgccattatcctggtgcttctgctgttcgaaaatatgatttttaacagactgttccggatcttttatcgcagctgttccatgtgcggccttatccattacagacccggcctgaagattgatctcaccaagacaaatcggtgtgggtcttgcatctgtggattcgacgagcagcagagctccggctttgaatatgagattttcctgaccgatatgcacgttcagaaagaaagctgcaagttctctcctcgcgtgaaccactttagaaatacaaaagccctcctcttcgctctggtcatctgtgcgaccatttacacggtgtatgccgacgaggactgcctttccaaggatatcaaaatcacataccaagagctgcataactgcattgggcccaagatcatgggagacacctgtgttagcaagtctgaactctactccgatctgtttagcaaaaatctggtgaccgagtatgacaagaaatacttcgaacctgatacagtcaacgaccagtttaataagattgagttcgctcaggatgcccaccggatgatccttctcgaacgcattctgtataaaaccgagtgcgagatgctgtccctcaagaagaactctggcccctacaatgtggcctggagaacacatctgaaaaaccacaatatcgacctttgtagccggcataactataagatgatctgccagtgtattaatgctcactccatgtgcaaaaacacggatatcgactacaacaaggaaattgagacctattacaaatctaatgccgcggcttacagagccgggctgaacacaatcatggataccctcaagacagcctttcgcggactgaccaaagtcctgattgaaaattatatcgagaaggacgacagcgatgctcttaaggccctcttctccaacatcacggacagcgtgcaagataattaccagatgattggcatcctgaaatttgcttctaagctgctcgacattaacctgggccggtccaccagaagcgcccaccattctatcatgacaaatgagattccgaaatccaaccctttcaccgattatagctactctaatgttaacatcaaggaatgtatgagccccgagtcccttaaatgctttaagaagcgcgacagcacacctcacaccaatcatctgctctgtaaaattgataacaagtataaagcgttcgactggcccgaaatcgagacgatccagaaggggcaaaaactgtgcctgggagattctcactgtaatcttgaatttacagccattaccgctgaccggatcatgtccctcacaaactgctacaaggagagcttcaccgcccagcccgctgatatgcaggccggcattaagaaatgctccgcggacgagatcggggaatgtaccacactggaggataagacgtggcctattgtgttctgctctggaaaatattactacagcgactccaaggaacacgccaaagacggctctatcaataactattgtctgaccaacaagtgcagcgagcagagatttccgatccatgaaaattggttcaagaaatgtaactgggataagacacacaaagagtttcgcccctacgagaccaataactataatgacattacatcctaccggaaggctatcgaatctgagattgggaccgatctcatgacgcatcactataaacctacaaagaacctgccccatgtcgtgcctagataccacagcatcgacgttcaaggcaccgaatccaccgagggaattatcaatggcttcatccagaacacaattcccgccatcagcgggcttgatgtgggatatcacctgaattttaaaggcaaccaactcttcgacattgtcatctttgtgaagaaggctgtgtacaaagcccagtaccagaaggcctataccacagggccgtctatttccatcaatattgaacataacgagcgctgcacgggacactgtcctgagaaaatccccgctaaggaaggctggctgaccttcagcaaagagcatacatcttcctgggggtgcgaagagtacggctgtctggcgatcgataccggatgcctttatggcagctgtcaggacgttattcggcctgagctcgatgtctacaagaagatcgggtctgaagcctccctgattgagatctgcattacactgccccacgaaacctattgcaatgacatggatatcctcgagcctatcattggagacaaactgagcgcttcctttcagaacacgcagaccaatcaacttcccacactgatcgcctacaagaaaggcaagatttataccgggcagatcaacgatattggaaacacagccctccagtgtggcagcatccaggtgatcaatgggtctaccattggcacaggaagcccgaaattcgactacatctgccatgctatgagacggaaggacgtgattgtccgcaagtgttttaacgataattaccaatcctgcaccagactggaaaaacggaacgacctgatcccttatagaaagggcgatgtgattgaggtttctaaaacggggagcaatatgggacagatgacattcaagatcgagcttggcgacattaactacaaaatcttcaccaagtccgtggatctgcagatgtctgggatctgtgccggatgcattgactgtgcggaaggcatcagctgctccattaatgctgaggtccccgccgaaaccgtgtgtcactgcaagacaaactgtgaggattttatcaataacattgttttctctccccaaatcaaaaattataacatcaaggtgcactgcaaaagcaaggtcgagaaaattaccgcccatatctgcgggcgcgacattgatctccagctgacggtgaagccttacaatcagaagatcgacctctcccagctggatgaaagcaactatattcgggaggaagaccttcaatgtggcacatggctgtgcaaagttcagaaggagggaatcgacatcatgtttaaaggcctcttctctgggctgggaagatactggaccattctgatctattccattatcggcgtggtcattatcgtgattcttgtgtacatcctgctcccgatcgggcgcctgctcaaggcttttctgattagacacgaaatcgagtacgccatggaacagaaaattaagtga

SEQ ID NO: 14337 - RNA, 4263 nt, synthetic construct
  misc_feature 1..4263: note = derived and/or modified CDS sequence (opt5) from OROV(TRVL-9760)__KC759123.1__GP
  source 1..4263: mol_type = other RNA
atggccaacctgatcattatcagcatggtgctctccattgcttacggccaccccctgtctaccagccagatcggggacagatgcttcgccggaggcaatctttttaaggagatgaacctgtccgtcgggctcggagaaatttgtgttaaagatgacatctctatcgtcaagagcacaacggtgttctccaaaaataagctggcgcttgaggctaccacaaaattttatcggtctttcattgtgaaggattggagcgaatgcaaccctgtgctggacaagtttggcaatttcatggttctctccgtggatgacaacgggcatatcattccgaaaatgtacacctgtcgcgccgcctgcgatatcagactgaataaggacaacgctgagattatcctgagctctacaaaactcaatcactttgaaattgtcggaaccacatccaccagcggctggttcaagaacacgatcaccaataacctggagcatacatgtgagcacgtgaccgttaattgcggccaaaaatctgtgaagtttcatgcctgtttccggcagcaccgcgggtgcatcagatttttcaagggaacatatatgccctactccatgattgaagctatgtgtgtcaacatcgagcttattatcctgaccctctatatttttgccgcgatcatcttcgccctgattatcacgaaaagctacgtggcttatcttctgctccctctgttctaccccgccacatggttttacggcaaggtgtataaaaagattaattcttgccctaactgtctgctcgcttcccaccccttcaccagctgccctaaaatctgcatttgtgggtcccggttttcttgcacagaagccctgaaggtccatcgcatgggaaaagattgtcttggctacaagagcctgtccaaggcgagacagatgtgcaaaagcaagtcttggtccttcaccgccgctatcctcaccgggctgatccttatggagtttattagcccgatcgccggagagcggatgtataaactggaggaactcgctgccgaatttattaagctgacagagcaggttaacatcctggaacgcgagatggaggtgctcaaacaatctattatcgtgatgtttgccattatcctggtccttctgctgttcgaaaatatgatctttaacagactgttccggattttctaccgcagctgttccatgtgcggccttatccactatagacccggcctgaagattgacctcacgaagaccaatcggtgtgggtcttgcatctgtggattcgatgagcagcagagctccggctttgaatacgagattttcctgaaagacatgcatgtgcagaaggaaagctgcaaattctctcctcgcgttaaccactttagaaatacaaaggctctcctcttcgcgctggtgatctgtgccaccatctatacagtctacgctgatgaggactgcctttccaaagacattaagatcacctaccaagagctgcacaactgcattgggcccaagatcatgggagatacgtgtgtgagcaaatctgaactctattccgacctgtttagcaagaatctggttacagagtacgataaaaagtatttcgaacctgacaccgtgaacgatcagtttaataaaattgagttcgcccaggacgcccatcggatgatccttctcgaaagaatcctgtacaagaccgagtgcgagatgctgtccctcaagaaaaactctggcccctataatgtcgcttggcgcacatacctgaagaaccacaatattgatctttgtagccggcataactataaaatgatctgccagtgtattaatgcccactccatgtgcaagaacaccgacatcgattacaacaaagaaattgagacatactataagtctaatgcggctgcctacagagccgacctgaacacgatcatggataccctcaaaacagcttttcgcgggctgaccaaggtgctgatcgaaaattatattgagaaggacgacagcgatgcccttaaagctctcttctccaacatcacagacagcgtccaagataattaccagatgattggaatcctgaagtttgcctctaaactgctcgacattaacctgggccggtccaccagaagcgcgcatcactctatcatgacgaatgagattccgaagtccaaccctttcaccgattatagctactctaatgtgaacatcaaagaatgtatgagccccgagtcccttaagtgctttaagaaacgcgacagcacacctcacaccaatcatctgctctgtaagatcgataacaaatataaggccttcgactggcccgaaattgagacaatccagaaaggccaaaagctgtgcctgggggattctcactgtaatcttgaatttaccgctattacggccgaccggatcatgtccctcacaaactgctacaaggagagcttcaccgctcagcccgccgatatgcaggcgggaattaaaaagtgctccgccgacgagatcggcgaatgtacaaccctggaggataaaacctggcctatcgttttctgctctgggaagtactattacagcgactccaaagaacatgctaaggacggatctattaataactattgtctgacaaacaagtgcagcgagcagagatttccgatccacgaaaattggttcaaaaagtgtaactgggataaaacgcacaaggagttttccaccatgcgccaaattaattacaacgacatcacatcttatcggaaagccattgagagcgaaatcggcaccgatctcatgacacatcactacaagcccaccaaaaatctgcctcatgtggtccccagatatcactccatcgacgtgcaggggacggagagcacagaaggcattatcaacggattcattcagaataccatccctgctatttctggccttggggttggataccatctgaactttaagggcaatcaactcttcgatatcgtgatttttgtcaagaaagccgtgtacaaggcccagtatcagaaggcttacaccacagggccctccatcagcatcaacattgagcacaatgaacgctgcaccggacactgtccggagaaaatccctgcgaaagagggctggctgacattctctaaggaacatacgtccagctgggggtgcgaggaatatggctgtctggccattgacaccggatgcctttacggctcttgtcaggatgtgatccggcccgagctcgacgtttataagaaaattgggtccgaggctagcctgatcgaaatctgcattacactgcctcacgagacctactgcaacgatatggacatcctcgaacccattatcggagataagctgtccgccagctttcagaatacacaaaccaaccagcttcctacgctgattgcctataaaaagggcaaaatctacaccgggcagatcaatgacattggaaacacagctctccagtgtggctctatccaagtcattaacgggagcaccatcggcacaggatcccccaagttcgattacatttgccatgccatgagacggaaggacgtgatcgtgcgcaaatgttttaatgacaactatcagtcttgcaccagactggagaagcggaatgatctgattccgtacagaaaaggcgacgtcatcgaagtgagcaagacagggtccaacatgggacagatgaccttcaaaatcgagcttggcgatattaattataagatcttcacgaagtctgttgacctgcaaatgagcgggatttgtgcgggatgcatcgattgtgctgagggcatttcctgctctatcaacgccgaagtgcctgccgagacagtctgtcactgcaaaaccaattgtgaagactttatcaacaatattgtgttcagcccccagatcaagaactacaatattaaagttcattgcaagtccaaagtggagaagatcaccgctcacatttgcgggcgcgatatcgacctccagctgacagtcaagccctataaccagaaaatcgatctcagccaactggacgaatctaattacattcgggaggaggatcttcagtgtggcacctggctgtgcaaggtgcagaaagaaggaatcgacattatgtttaagggcctcttctccgggctgggaagatattggacgatcctgatttacagcatcattggcgttgtgatcatcgtcattcttgtgtacatcctgctccctattgggcgcctgctcaaagcctttctgatcagacacgagattgaatatgcgatggagcagaagatcaaatga

SEQ ID NO: 14338 - RNA, 4263 nt, synthetic construct
  misc_feature 1..4263: note = derived and/or modified CDS sequence (opt5) from OROV(TVP-19244/DEI-216)__KP795073.1__GP
  source 1..4263: mol_type = other RNA
atggccaacctgatcattatcagcatgattctcggcatcgcttacgggcaccccctgtccacctctcagattggagacagatgcttcgccggcgggatcctttttaaggagatgaatctgagcgtgggactcggcgaaatctgtgtcaaagatgacatttccatcgttaagtctacaacggcgttcagcaaaaacgctctggcccttgaggccaccacaaagttttatcggtccttcattgtgaaagattggtctgaatgcaatcctgtgctggacaagtttgggaacttcatggtcctcaatgtggatgacaacggacatctggttccgaagatgtacacctgtcgcgctgcctgcgatatcagactgaataaagacaacgctgagattatcctcagctccacaaagctgaatcactttgaaattgtgggcaccacaagcacctctggctggttcaaaaacacgatcaccaataaccttgagcatacatgtgagcacgtcaccgtgaattgcgggcaaaagtccgttaaatttcatgcctgtttccggcagcaccgcggatgcatcagatttttcaagggcacatatatgccctacagcatgattgaagcgatgtgtgtgaacatcgagctgattatcctcaccctgtatatttttgccgctatcatcttcgcccttattatcacgaagtcttacattgcttatctgctcctgcctctgttctaccccgtcacatggctctacgggaaagtgtataagcggatcaattcctgccctaactgtctgcttgccagccacccctttacctcttgccctaaaatttgcatctgtggatcccgcttcagctgcacagaagcgctgaaggtgcatagaatgggcaaagattgtctcgggtacaagtccctgtctaaagcccggcagatgtgcaagagcaagtcctggagctttaccgctgccatccttaccggactgattctcatggagttcgtctctccgatcgctggcgagcgcatgtataaactggaagaactggccgacgattacattgaactcacagagcaggttaacatcctgggcaaggaaattaaaatccttaagcaatccattatcgtgatgctggccatcattctcatcctgcttctgagcgagaatattatctttaactatctcttctctacgctgtacagaagctgttccatgtgcgggctgattcactatcggcccggactcaaagtggactctaccaagacaaataagtgtggcagctgcatctgtgggtttgatgagcagcagtccagcggattcgaatacgaggtctttctgaaagacatgcatgtgcagcgcgaatcttgcaagttcggccctagagttaaccactttcggaataccaaaatccttctgttcacagtggctatttgtacctccttttacacggtctatgcggacgaggattgcctcagcaagaacatccgcattacataccaagaactgcacaattgcatcgggccccatattatgggagacacctgtatgtctaaatccgagctgtatagcgatcttctctccaagaacctgatcaccgagtacgacaagaaatatttcgaacctgatacagtgaatgaccagttcaacaagatcgagtttgcccaggatgctcacagaatgattctgctcgaacggatcctgtacaaaaccgagtgcgaaatgctttctctgaagaaaaatagcggcccctataacgttgcctggagaacatacctcaagaatcataacattgacctgtgttcccgccacaattacaagatgatctgccagtgtattaacacgcattctatgtgcaaaaacaccgatatcgacttcaataaggagatcgagacatattacaaagccaacgctgccgcgtatcggagcgattttaataccattatcgacacactgaagaccgctttcagaggccttacgaaagtgctcattgaaaactacatcgagaaggacgattccgacgccctgaaagccctgtttagcaatattaccgattctgtccaagacaactatcagatggtgggggtcctcaagttcgcttccaagctgcttaatatcagcctgggacgcacaacccggtctgcccagcactccattatgacaaacgaaatcccgaaaagcaatccttttaccgattactcttatagctccgtgaacatcaaggagtgtatgagccccgagtctctcaaatgcttcaagaaaagagactccgctcctcacatgaatcatctgctgtgtaagatggataacaagtacaaagcctttgactggcccgaaattgagacggttcaaaagggccagaaactttgcctcggggatagccactgtaatctggagttcacagcgatcaccgccgacaagattatgtccctgacaaactgctacaaagagtcttttaccgctcagcccgccgatatgcagaccggaatcaagaagtgcagcgctgacgaaattggcgagtgtatcacactcgaggataaatcctggcctatcgtgttctgcggggacaagtattactattctgacggcaaagaacatgccaaggatggaagcattaataactactgtctggcgaacaaatgctccgagcaacgctttccgatccacaagaattggttcaagaaatgtaactgggacaagacgcacaaagagttcaccacaatgcggcagattaattataacgatatcacctcttacagaaaggccattgaaagcgaaatcggcacagaccttatgacccatcactataaacccacgaagaatctgcctcatgtcgtgccccgctaccactccatcgatgttcaggggacagagagcaccgagggaattatcaacggctttattcagaataccatccctgctatttctgggctcggagtgggctaccatctggggttcaaaggcaaccaactgtttgacatcgtcattttcgtgaagaaggccgtgtataaagctcagtaccagaaggtttatacaaccggaccctccatcagcatcaatattgaacacaacgagaaatgcacaggccactgtccggaaaagatccctgccaaagaggggtggcttacgttttctaaggaacatacctccagctggggatgcgaggagtacggctgtctcgccattgatacagggtgcctgtatggatcttgtcaggacgtcatccggcccgaactggatatttacaagaaaatcggctccgaggctagcctcatcgaaatttgcatcaccctgcctcacgagacatattgcaatgacatggatattcttgagcccatcattggggacaagctgtccgcgagcttccaaaacacccagacgaatcagctccctaacctgatggcctacaaaaagggcaaagtgtacaccggacagatcaatgatgtgggcaacacagctctgcaatgtgggtctatccaggtcgtgaacggaagcaccattggctccgggaatcccaagtttgactatatctgccatgccatgagacgcaaggacgttattgtgcggaaatgtttcaacgataattaccagtcttgcacaagacttaacccgcggaatgacctgatcccttatcgcaagggagatattatcgaaattagcaaaaccggctccaacatggggcaaatgacatttaagatcgagctcggcgacatcaattacaaaattttcaccaagtctgtcgatctgcagatgagcggaatctgtgccggctgcattgactgtgctgaagggatctcctgctctattaacgccgatgtgagcgcggagacggtttgtcactgcaagacaaattgtgaagactttatctccaacatcgtgattagcccccagatcaaaacctataatattaaggtccattgcaaatctaaggtgaaaaagatcaccgctaacatttgcggaagaaatatcgatctccagctgacagttaagccctacaaccagaaaatcgacctttcccaactggatgagagcaattatattaaggaggaagacctccagtgtggcacctggctgtgcaaagtgcagaaggaggggatcgacattgtcttcaaaggactgttctctggccttggcaagtactgggccatcctgatttactccatcattgggatcatcgtggtgattctcctgatctatgtcctcctgcctattggacggcttctgaaagcctttctcatcaagaacgaaattgagtacacgatggaacaaaagatcaaatga

SEQ ID NO: 14339 - RNA, 4263 nt, synthetic construct
  misc_feature 1..4263: note = derived and/or modified CDS sequence (opt5) from OROV(TVP-19249/GML-444672)__KP795076.1__GP
  source 1..4263: mol_type = other RNA
atggccaacctgatcattttcagcatcattctcggcatcgcttacgggcaccccctgtccacctctcagattggagacagatgctttgccggcgggagccttttcaaggagatgaatctgtccgtgggactcggcgaaatctgtgtcaaagatgacatctctattgttaagagcacaacggcgttttccaaaaacaccctggctcttgaggccacaaccaagttctatcggtcttttatcgtgaaagattggagcgaatgcaatcctgtgctggacaagctcgggaacttcatggtcctgaatgtggatgacaacggacatctggttccgcgcatgtacacatgtagagccgcttgcgatattcggctcaataaggacaacgccgagatcattctgtccagcaccaaacttaatcactttgaaatcgtgggcacaacctctacgtccggctggttcaagaacaccattacaaataacctggagcatacctgtgagcacgtcacagtgaattgcgggcaaaagagcgttaagtttcatgcttgtttccgccagcacagaggatgcatccggtttttcaaaggcacctatatgccctactctatgatcgaagccatgtgtattaacatcgagctcattatcctgacgctttatatttttgcggccatcatcttcgctctgattatcacaaagtcctacattgcctatctcctgctgcctctcttctaccccgtgacctggctgtacgggaaggtctataaacgcatcaatagctgctctaactgtcttctggcttcccacccttttacaagctgccccaagatttgcatctgtggatccagattctcttgcaccgaagccctcaaagtgcatcggatgggcaaggattgtctggggtacaaaagcctttccaaggcgcgccagatgtgcaaaagcaagtcttggtcctttaccgccgctatcctgacaggactcattctgatggagttcgtgagccctatcgccggcgagagaatgtataagctggaggaactcgctgacgattacattgaaatggccgagcgggtcggcatgctggaaaaagagatcaaggttcttaaacagtttacgattgtgatgctggtgatcattctcatcctgcttctgttcgagaacaccatctttaattatctcttcaacacactgtaccgctcttgtagcatgtgcgggctgattcactatagaccgggactcaaggtcgacctgaccaaaacaaataagtgtggctcctgcatctgtgggtttgatgaacaacagtctagcggattcgagtacgaagtgtttcttaaggacatgcatattcagcgggagtcctgcaaattcggcccccgcgttaaccactttagaaataccaagatccttctcttcacgattgccatctgtacgagcttctacaccgtgtatgctgacgaagattgcctgtctaaaaacatcaagattacctaccaggagctgcacaattgcatcgggccttatattatgggagacacatgtgtctccaaaagcgagctttactctgatctcctgtccaagaacctgatcaccgaatatgacaagaaatactttgagcccgatacagtgaatgaccaattcaacaagattgaatttgcgcaggatgcccatcggatgatcctcctggagagaatcctttataaaacggaatgcgagatgctgagcctcaagaaaaattccggcccttacaacgttgcttggcgcacctacctgaagaatcacaacattgacctgtgttctcggcataattataagatgatctgccagtgtattaacatgcacagcatgtgcaaaaacacagatatcgacttcaataacgagattgaaacctactataaggccaatgccgctgcctacagatccgatttttatacaatcatcgacacccttaaaacggcgttccgcggcctcaccaaggtgctgattgagaactacatcgaaaaagacgattctgacgctctgaaggccctctttagcaatattacaaactccgtccaggataattatcaaatggtgggggtcctgaaattcgccagcaaacttctgaacatctctctcggacggtccaccagaagcgctcagcattctattatgacaaatgagatccccaagtccaacccgtttaccgactacagctactctagcgtgaatattaaagagtgtatgtcccctgaaagcctgaagtgcttcaaaaagcgcgattctgttccccacacgaaccatctgctttgtaaaatggacaataagtataaggcctttgattggcctgagatcgaaacagtgcagaaaggccaaaagctctgcctgggggactcccactgtaacctggagttcaccgctatcacagccgataaaattatgagcctcaccaattgctacaaggaatcctttaccgcgcagcccgccgacatgcagacaggaatcaaaaagtgctctgctgatgagattggcgagtgtatcacgctggaagacaaggcctggcccattgtcgtgtgcggggataaatattactatagcgacggcaaggagcacgctaaagacggatccatcaacaactactgtcttgccaataagtgctctgaacagcggttccctatccataaaaactggttcaagaagtgtaattgggataaaacccacaaggagtttacaaccatgagacaaattaactataatgacatcacaagctaccgcaaagcgattgaatccgagatcggcaccgatctgatgacgcaccattacaagccgaccaaaaacctcccccacgttgtgcctcggtatcattctattgacgtccaggggacagagagcaccgaaggaatcatcaatggcttcattcagaacacaatccccgccatttccgggctgggagtgggctaccacctggggtttagaggcaatcagcttttcgatatcgtgatttttgttaagaaagctgtctataaggcccaataccagaaggtgtataccacaggacctagcatctctattaacatcgagcataatgaaaaatgcacgggccactgtcccgagaagatcccggctaaagaagggtggctcaccttctccaaggagcacacaagctcttggggatgcgaggaatacggctgtctggccattgacaccgggtgcctgtatggatcctgtcaggatgtgatccgccctgagctcgacatttacaaaaagatcggcagcgaagcctctctgattgagatctgcatcacacttccccatgagacctactgcaacgatatggacattctggaacctatcattggggataagctctccgctagctttcagaatacgcaaaccaaccagctgcccgtcctgatggcgtataaaaagggcaaagtgtacacaggacagatcaatgacgttggcaacaccgcccttcagtgtgggtccattcaagtggtcaacggaagcacaatcggctctgggaatcctaagttcgattatatctgccacgctatgcggagaaaagacgtgattgttcggaagtgttttaacgacaattaccagagctgcacccgcctggatgccagaaacgacctcatcccctatcggaagggagatattatcgagatttccaaaacaggctctaatatggggcagatgaccttcaagatcgaactgggcgacattaactacaaaatctttacaaagagcgtggatctccaaatgtccggaatctgtgccggctgcattgactgtgctgaggggatctcttgcagcattaatgccgatgtctccgcggaaacagtgtgtcattgcaaaaccaactgtgaggacttcatctctaatattgttatcagcccgcagatcaagacctataacattaaggtgcactgcaaatccaaggtcgagaaaatcacagctaatatttgcggaagaaacatcgatctgcagcttaccgtgaagccttacaatcagaaaattgacctgagccaactcgatgaatctaactacatcaaggaggaagacctgcagtgtggcacgtggctgtgcaaggtgcagaaagaggggatcgacattgtcttcaagggactgttttccggcctgggcaaatattggacaatcctcatttacagcatcattgggatcattgttatcgtgctgctcatctatgtgctgcttcccattggacgcctgctcaaggccttcctgatcaaaaatgaaattgagtacaccatggagcagaagatcaaatga

SEQ ID NO: 14340 - RNA, 4263 nt, synthetic construct
  misc_feature 1..4263: note = derived and/or modified CDS sequence (opt5) from OROV(TVP-19254/GML-480914)__KP795082.1__GP
  source 1..4263: mol_type = other RNA
atggccaacctgatcattatcagcatggtgctctccgtcgcttacggccaccccctgtctaccagccagattggggacagatgcttcgccggaggcaatctttttaaggagatgaacctgtccgttgggctcggagaaatctgtgtgaaagatgacatttctatcgtcaagagcacaacggcgttctccaaaaataagcctgctctggaggccaccacaaaattttatcggtctttcatcgtgaaggattggagcgaatgcaacccggtgcttgacaagtttggcaatttcatggttctgtccgtggatgacaacgggcatattatccccaaaatgtacacctgtcgcgccgcttgcgatattagactcaataaggacaacgccgagatcattctgagctctacaaaactgaatcactttgaaatcgtcggaaccacatccaccagcggctggttcaagaacacgattaccaataacctcgagcatacatgtgagcacgtgaccgttaattgcggccaaaaatctgtgaagtttcatgcttgtttccggcagcaccgcgggtgcatcagatttttcaagggaacatatatgccttactccatgatcgaagccatgtgtgtcaacattgagctgatcattcttaccctgtatatctttgcggccattatcttcgctctcatcattacgaaaagctacgtggcctatctgcttctgcccctcttctaccctgtgacatggttttacggcaaggtctataaaaagatcaattcttgccccaactgtctgctggcttcccaccctttcaccagctgcccgaaaatttgcatctgtgggtcccggttttcttgcacagaagccctcaaggttcatcgcatgggaaaagattgtctgggctacaagagcctttccaaggcgagacagatgtgcaaaagcaagtcttggtccttcaccgccgctattctgaccgggctcatcctgatggagtttatcagccccattgccggagagcggatgtataaacttgaagaactggctgacgagttcatcaagctcacagaacaggtgaacattctggaacgcgagatggaggtgctgaaacaatctgtcatcgtgatgctcgccattatcctggttcttctgctctttgaaaatatgattttcaacagactgtttcggatcttctaccgcagctgttccatgtgcggccttatccactatagacctggcctgaagattgatctcacgaagaccaatcggtgtgggtcttgcatctgtggatttgacgagcagcagagctccggcttcgaatacgagatttttctgaaagatatgcatatccagaaggaaagctgcaaattctctccccgcgtgaaccacttcagaaatattaaggccctgctctttgctctggtcatctgtgcgacaatctataccgtgtacgccgacgaggactgcctttccaaaaacattaagatcacataccaagagctgcacaattgcattgggcctaagatcatgggagatacctgtgttagcaaatctgaactctattccgacctgttcagcaagaacctggtgacggagtacgataaaaagtattttgaacccgacacaattaatgatcagttcaacaaaatcgagtttgctcaggacgcccatcggatgatccttctcgaacgcattctgtacaagaccgagtgcgagatgctgtccctcaagaaaaattctggcccgtataacgtcgcctggagaacctacctgaagaatcacaacatcgatctttgtagccggcataattataaaatgatttgccagtgtatcaacacacactccatgtgcaagaacaccgacattgattacaataaagaaatcgagacatactataagtctaacgctgccgcgtacagagctgacctgaatacgatcattgataccctcaaaacagccttccgcgggctgaccaaggtgctgatcgaaaactatattgagaaggacgacagcgatgcccttaaagctctcttttccaatatcacagacagcgtccaagataactaccagatgattggaatcctgaagttcgcctctaaactgctcgacattaatctgggccggtccaccagaagcgctcatcactctatcatgacgaacgagatccctaagtccaatccctttaccgattatagctactctaacgtgaatattaaagaatgtatgagccctgagtcccttaagtgcttcaagaaacgcgacagcacaccccacaccaaccatctgctctgtaagatcgataataaatataaggcctttgactggcccgaaattgagacaatccagaaaggccaaaagctgtgcctgggggattctcactgtaaccttgagttcaccgcgattacggccgacaagatcatgtccctcacaaattgctacaaagagagctttaccgctcagcctgccgatatgcaggctggaatcaagaaatgctccgccgacgagattggcgaatgtacaaccctggaggataagacctggccgatcgttttctgcgggggaaaatactattactctgacagcaaggaacatgcgaaggacggctccattaacaactattgtctgacaaataaatgctctgagcagcggttccccatccacgaaaactggtttaagaaatgtaattgggataagacgcacaaagagttcagcaccatgaagcaaattaactacaatgacatcacatcctatagaaaagccatcgagtctgaaattgggaccgatctcatgacacatcactacaagcctaccaagaacctgccccatgtggtccctcgctatcacagcatcgacgtgcagggcacggagtccacagaaggacttattaatggctttatccagaacaccattcccgctatcagcgggctgggagttggctaccatctcaatttcaaagggaaccagctgtttgatattgtgatcttcgtcaagaaagccgtgtacaaggctcaatatcagaaagcctacaccacaggaccgtctatctccattaatatcgagcacaacgaacggtgcaccggccactgtcctgagaagattcccgccaaggaggggtggctgacatttagcaaagaacatacgtcttcctggggctgcgaggaatatggatgtcttgctatcgacaccggctgcctctacgggagctgtcaggatgtgattagacctgagctggacgtttataagaaaatcggatctgaggtctccctgatcgaaatttgcatcacactcccccacgagacctactgcaatgatatggacattctggaacctatcattggcgataaacttagcgcgtccttccagaacacacaaaccaatcagctgcccacgctcatcgcctataagaaggggaagatctacaccggacagattaacgacatcggcaacacagctctgcagtgtgggagcattcaagtgatcaatggctctaccattggaacaggcagcccgaaatttgattacatctgccatgccatgcgccggaaggacgtgattgtcagaaaatgtttcaacgacaattatcagtcctgcacccggctggagaagcgcaacgatcttatcccttacagaaaaggggacgtgatcgaagtttctaagacaggaagcaatatgggccagatgacctttaagattgagctgggggatatcaactataaaattttcacgaagtccatcgacctccaaatgtctggaatttgtgccggctgcatcgattgtgctgaggggatcagctgctccattaatgccgaagtgtctgcggagacagtctgtcactgcaaaaccaactgtgaagacttcatcaataacattgtgtttagcccccagatcaagaattacaacattaaagttcattgcaagtccaaggtggagaaaatcatcgctcacatttgcggcaaggatatcgacctgcagctcaccgtcaaaccctataatcagaagattgatctgagccaacttgacgaatctaactacatccgggaggaggatctgcagtgtggaacatggctctgcaaagtgcagaaggaaggcattgacatcattttcaaagggctgttttccggactgggcagatattggaccatccttatctacagcattatcggggttgtgattatcgtcattctggtgtacatcctcctgcctatcggacgcctcctgaaggccttccttattcggcacgagatcgaatatgccatggagcagaagattaaatga

SEQ ID NO: 14341 - RNA, 4263 nt, synthetic construct
  misc_feature 1..4263: note = derived and/or modified CDS sequence (opt5) from OROV(TVP-19256/IQE-7894)__KP795085.1__GP
  source 1..4263: mol_type = other RNA
atggccaacctgatcattatcagcatgattctcggcatcgcttacgggcaccccctgtccacctctcagattggagacagatgcttcgccggcgggagcctttttaaggagatgaatctgtccgtgggactcggcgaaatctgtgtcaaagatgacatctctattgttaagagcacaacggcgttctccaaaaacgctctggcccttgaggccaccacaaagttttatcggtctttcatcgtgaaagattggagcgaatgcaatcctgtgctggacaagtttgggaacttcatggtcctcaatgtggatgacaacggacatctggttccgaagatgtacacctgtcgcgctgcctgcgatattagactgaataaagacaacgctgaggtgatcctctccagcacaaagctgaatcactttgaaattgtcggcaccacatctacctccggctggttcaaaaacacgatcaccaataaccttgagcatacatgtgagcacgtgaccgttaattgcgggcaaaagagcgtgaaatttcatgcctgtttccggcagcaccgcggatgcattagatttttcaagggcgcgtatatgccctactctatgatcgaagccatgtgtgtcaacatcgagctgattatcctcacactgtatatttttgctgccatcattttcgctcttatcatcaccaagtcctacattgcctatctgctcctgcctctgttctaccccgtgacgtggctctacgggaaagtgtataagcggatcaatagctgccctaactgtctgcttgcgtctcacccctttacatcctgccctaaaatttgcatctgtggaagccgcttctcctgcaccgaagccctgaaggtccatagaatgggcaaagattgtctcgggtacaagtctctgagcaaagctcggcagatgtgcaagtccaagagctggtcttttacagccgctattcttaccggactgatcctcatggagttcgtttccccgatcgccggcgagcgcatgtataaactggaggagctggccgacgattacattgaactcgctgaacaggtgaacatcctgggcaaggaaattaaaatccttaagcaaagcattatcgtgatgctggcgattatcctcatcctgcttctgtctgagaatattatctttaactatctcttcaaaaccctgtacagaagctgttccatgtgcgggctgattcactatcggcccggactcaaggtcgacctgacaaagacgaataaatgtggctcttgcatctgtgggtttgatgagcagcagagctccggattcgaatacgaggtgtttcttaaggacatgcatgttcagcgcgaaagctgcaaattcggccctagagtgaaccactttcggaataccaagattctcctcttcacaatcgccatctgtacctctttttacacagtctatgctgacgaggattgcctgtccaaaaacattcgcatcacctaccaagaactgcacaattgcattgggccccatatcatgggagacacgtgtatgagcaagtctgagctttattccgatctcctgagcaagaacctgattacagagtacgacaaaaagtatttcgaacctgataccgtgaatgaccagttcaacaaaatcgagtttgcccaggatgcccacagaatgatcctcctggaacggattctttacaagaccgagtgcgaaatgctgtccctcaaaaagaactctggcccctataatgttgcttggagaacatacctgaagaatcataacatcgacctgtgtagccgccacaattacaaaatgatttgccagtgtatcaacacccattccatgtgcaagaacacagatattgacttcaataaagagatcgagacgtattacaaggccaacgcggctgcctatcggtctgattttaataccatcattgacacacttaaaaccgccttcagaggcctcacaaaggtgctgatcgaaaactacattgagaaagacgatagcgacgctctgaaggccctcttttccaatatcaccgatagcgtccaagacaactatcagatggtgggggtcctgaagttcgcttctaaacttctgaatatttccctcggacgcacgacccggagcgcccagcactctatcatgacaaacgaaattccgaagtccaatccttttaccgattacagctattctagcgtgaacatcaaagagtgtatgtcccccgagagcctgaagtgcttcaaaaagagagactctgttcctcacacaaatcatctgctttgtaagatggataacaaatacaaggtgtttgactggcccgaaatcgagaccgtccaaaaaggccagaagctctgcctgggggattcccactgtaatctggagttcacggcgattacagccgacaaaatcatgagcctcaccaactgctacaaggaatcctttacagctcagcccgccgatatgcagaccggaattaagaaatgctctgctgacgaaatcggcgagtgtattaccctggaggataagagctggcctatcgtgttctgcggggacaaatattactattccgaaggcaaggagcatgccaaagacggatctatcaataactactgtcttgcgaacaagtgcagcgaacaacgctttccgattcacaagaattggctgaaaaagtgtaactgggataaaacacacaaggagttcacgaccatgcggagaatcaattataacgacattacatcctaccgcaaagccatcgaatctgagattggcaccgatctcatgacacatcactataagcccaccaaaaatctgcctcatgttgtgccccggtaccacagcatcgacgtccaggggacggagtccacagaaggaatcattaacggcttcatccagaataccattcctgctatcagcgggctgggagtgggctaccatcttgggtttaagggcaaccagctgttcgatattgtgatctttgttaagaaagccgtctataaggctcaataccagaaagtgtataccacaggaccctctatttccatcaatatcgagcacaacgaaaagtgcaccggccactgtccggagaaaattcctgccaaggaagggtggctgacattcagcaaggagcatacgtcttcctggggatgcgaggaatacggctgtctggccatcgacaccgggtgcctctatggaagctgtcaggatgtgattagacccgagctggacatctacaaaaagattggctctgaggcttcccttatcgaaatctgcattacactgcctcacgagacctattgcaatgatatggacatcctcgaacccattatcggggataaactgagcgcgtcctttcagaacacacaaaccaatcagctgcctaaccttatggcctacaagaaaggcaaggtctacacgggacagattaatgacgtgggcaacaccgctctgcagtgtgggagcatccaagttgtgaacggatctacaatcggcagcgggaatcccaagttcgattatatttgccatgccatgcgccggaaagacgtcatcgtgagaaagtgttttaacgacaattaccagtcctgcacccggctcgatccgcgcaacgacctgattccttatagaaaaggagatatcgttgagatttctaagacaggcagcaatatggggcagatgaccttcaaaatcgaactcggcgacattaactacaagatctttacaaagtccgtggatctgcaaatgtctggaatctgtgccggctgcattgactgtgctgaggggatcagctgctccattaatgccgatgcgtctgctgaaaccgtctgtcactgcaaaacgaactgtgaggacttcatcagcaatattgtgatcagcccccagatcaagacatataacattaaagttcattgcaagtccaaagtggagaagatcaccgccaatatttgcggacggaacatcgatcttcagctgaccgtcaagccctacaatcagaaaattgacctctctcaactggatgaatccaactatatcaaggaggaagacctgcagtgtggcacatggctttgcaaagtgcagaaggaggggatcgacattgtgtttaaaggactgttcagcggcctcggcaagtactgggccatcctgatttactctatcattggggtcatcgttgtgattctcctgatctatgtgcttctgcctatcggaagactcctgaaggctttcctgattaaaaatgaaatcgagtacaccatggagcagaagattaaatga

SEQ ID NO: 14342 - RNA, 4263 nt, synthetic construct
  misc_feature 1..4263: note = derived and/or modified CDS sequence (opt5) from OROV(TVP-19257/IQT-1690)__KP795088.1__GP
  source 1..4263: mol_type = other RNA
atggccaacctgatcattatccccatgattctcggcatcgcttacgggcaccctctgagcacctcccaaattggagacagatgcttcgccggcgggtctctttttaaggagatgaatctgagcgtgggactcggcgaaatctgtgtcaaagatgacatctccattgttaagtctacaacggcgttcagcaaaaacgctctggcccttgaggccaccacaaagttttatcggtccttcatcgtgaaagattggtctgaatgcaatccggtgctggacaagtttgggaacttcatggtcctcaatgtggatgacaacggacatctggttcccaagatgtacacctgtcgcgctgcctgcgatattagactgaataaagacaacgctgagatcattctcagctccacaaagctgaatcactttgaaatcgtgggcaccacaagcacctctggctggttcaaaaacacgattaccaataaccttgagcatacatgtgagcacgtcaccgtgaattgcgggcaacggtccgttaagtttcatgcctgtttccgccagcacagaggatgcatccggtttttcaaaggcacatatatgccttacagcatgatcgaagcgatgtgtgtgaacattgagctgatcattctcaccctgtatatctttgccgctattatcttcgcccttatcattacgaagtcttacatcgcttatctgctcctgcccctgttctaccctgtcacatggctctacgggaaggtgtataaacgcattaattcctgccccaactgtctgcttgccagccacccttttacctcttgcccgaagatctgcatttgtggatccagattcagctgcacagaagcgctgaaagtgcatcggatgggcaaggattgtctcgggtacaaatccctgtctaaggcccgccagatgtgcaaaagcaagtcctggagctttaccgctgccatccttaccggactgatcctcatggagttcgtctctcccattgctggcgagagaatgtataagctggaggaactggccgacgattacatcgaactcgccgagcaggttaacattctgggcaaagaaatcaagattcttaaacaatccatcattgtgatgctggctatcatcctcattctgcttctgagcgagaatatcatttttaactatctcttcaatacactgtaccggtcttgtagcatgtgcgggctgatccactatcgccctggactcaaggtggacctgacgaaaaccaacaagtgtggctcctgcatttgtgggtttgatgagcagcagtctagcggattcgaatacgaggtctttcttaaggacatgcatgtgcagagagaatcctgcaaattcggcccccgggttaatcactttcgcaacacaaagatcctcctgttcatcattgcgatctgtaccagcttttacacagtgtatgccgacgaggattgcctgtctaaaaatattagaatcacctaccaagaactgcacaactgcattgggcctcatatcatgggagacacgtgtatgtccaagagcgagctttattctgatctcctgtccaaaaatctgatcacagagtacgacaagaagtatttcgaacccgataccgtcaacgaccagttcaataaaattgagtttgctcaggatgcccaccggatgatcctcctggaacgcattctttacaagaccgagtgcgaaatgctgagcctcaaaaagaactccggcccgtataatgtggcctggagaacatacctgaaaaaccataatatcgacctgtgttctcggcacaactacaagatgatttgccagtgtatcaacacccatagcatgtgcaagaatacagatatcgacttcaacaaagagattgagacgtattacaaggctaatgccgcggcttatagatccgattttaacaccatcattgacacacttaaaaccgccttccgcggcctcacaaaggttctgatcgaaaattacattgagaaagacgattctgacgccctgaaggctctctttagcaacatcaccgattccgtgcaagacaattatcagatggtcggggtgctgaaattcgccagcaaacttctgaacatttctctcggacggacgaccagatccgctcagcacagcatcatgacaaatgaaatccctaagtctaacccctttaccgattactcctatagctctgtcaatattaaagagtgtatgagccctgagtccctgaagtgcttcaaaaagcgcgacagcgctccccacacaaaccatctgctttgtaaaatggataataagtacaaggcgtttgactggcccgaaatcgagaccgtgcaaaaaggccagaagctctgcctgggggattctcactgtaacctggaatttacggccattacagctgacaaaatcatgtccctcaccaattgctacaaggagagcttcacagcccagcctgctgatatgcagaccggagttaaaaagtgctccgccgacgaaattggcgagtgtatcaccctggaggataagtcttggccgatcgtgttctgcggggacaaatattactatagcgacggcaaggaacatgcgaaagatggatccattaacaactactgtcttgccaataagtgctctgagcaacggtttcccatccacaaaaactggttcaagaagtgtaattgggacaaaacacacaaggagttcacgaccatgagacagattaactataatgatatcacaagctaccgcaaagctattgaatccgaaatcggcaccgacctgatgacacatcactataagcctaccaaaaacctcccccatgtcgtgcctcggtaccactctatcgatgttcaggggacggagagcacagagggaattatcaatggctttattcagaacaccatccccgccatttccgggctgggagtgggctaccatctggggttcaagggcaatcaactttttgacatcgtcattttcgtgaaaaaggctgtgtataaggcccagtaccagaaagtttataccacaggaccgagcatctctatcaacattgaacacaatgagaagtgcaccggccactgtcctgaaaagatccccgccaaggaggggtggctcacattttccaaagaacatacgagctcttggggatgcgaggagtacggctgtctggctattgataccgggtgcctgtatggatcctgtcaggacgtcatcagacctgaactcgatatttacaagaagatcggcagcgaggcgtctctgcttgaaatctgcattacactgccccacgagacctattgcaacgacatggatatcctcgagcctattatcggggacaaactgtccgccagcttccaaaatacacagaccaaccagctgcccaatcttatggcttacaagaaaggcaaggtgtacacgggacagattaacgatgtgggcaacaccgccctgcaatgtgggtccatccaggtcgtgaatggaagcacaatcggctctgggaacccgaaatttgactatatttgccatgccatgcgccggaaggacgttatcgtgagaaagtgtttcaatgataactaccagagctgcacccggctcgaccctcgcaatgatctgattccctatagaaaaggagacatcattgaaatctccaagacaggctctaacatggggcaaatgacctttaaaattgagctcggcgatatcaattacaagatcttcacaaaaagcgtcgacctgcagatgtccggaatttgtgctggctgcatcgattgtgccgaagggatttcttgcagcatcaacgcggacgtgtccgctgagaccgtttgtcactgcaagacgaattgtgaagattttatttctaacatcgtgatcagcccccagattaagacatataatatcaaagtccattgcaagtccaaagtggagaagattaccgccaacatctgcggacggaatattgaccttcagctgaccgttaaaccttacaaccaaaagatcgatctcagccagctggacgagtctaattatatcaaggaagaggacctgcagtgtggcacatggctttgcaaagtgcagaaggaagggattgatatcgtcttcaaaggactgttctccggcctcggcaagtactgggccattctgatctacagcattatcgggattatcgtggtgatcctcctgatttatgtccttctgccgatcggaagactcctgaaagcctttctgattaagaacgagatcgaatacaccatggagcagaaaattaagtga

SEQ ID NO: 14343 - RNA, 4263 nt, synthetic construct
  misc_feature 1..4263: note = derived and/or modified CDS sequence (opt5) from OROV(TVP-19258/IQT-4083)__KP795091.1__GP
  source 1..4263: mol_type = other RNA
atggccaacctgatcattatcagcatgattctcggcatcgcttacgggcaccccctgtccacctctcagattggagacagatgcttcgccggcgggagcctttttaaggagatgaatctgtccgtgggactcggcgaaatctgtgtcaaagatgacatctctattgttaagagcacaacggcgttctccaaaaacgctctggcccttgaggccaccacaaagttttatcggtctttcatcgtgaaagattggagcgaatgcaatcctgtgctggacaagtttgggaacttcatggtcctcaatgtggataacaatggacatctggttccgaagatgtacacctgtcgcgctgcctgcgacattagactgaacaaagataatgctgagatcattctctccagcacaaagctgaaccactttgaaatcgtgggcaccacatctacctccggctggttcaaaaatacgattaccaacaatcttgagcatacatgtgagcacgtcaccgtgaactgcgggcaaaagagcgttaaatttcatgcctgtttccggcagcaccgcgcgtgcatcagatttttcaagggaacatatatgccctactctatgatcgaagccatgtgtgtgaatattgagctgatcattctcaccctgtatatctttgctgccattatcttcgctcttatcattacgaagtcctacatcgcctatctgctcctgcctctgttctaccccgcgacatggctctacggcaaagtctataagcggattaacagctgccctaactgtctgcttgcctctcacccctttacctcctgccctaaaatctgcatttgtgggagccgcttctcctgcacagaagctctgaaggtgcatagaatgggaaaagactgtctcggctacaagtctctgagcaaagcccggcagatgtgcaagtccaagagctggtcttttaccgctgccatccttaccgggctgatcctcatggagttcgtgtccccgattgccggagagcgcatgtataaactggaagaactggctgatgactacatcgaactcacagagcaggtcaatattctgggcaaggaaatcaaaattcttaagcaaagcatcattgttatgctggcgatcatcctcattctgcttctgtctgagaacatcatttttaattatctcttcaacacgctgtacagaagctgttccatgtgcggcctgatccactatcggcccgggctcaaagtggatctgaccaagacaaataagtgtggatcttgcatttgtggctttgacgagcagcagagctccgggttcgaatacgaggtgtttcttaaagatatgcatgtccagcgcgaaagctgcaagttcggacctagagtgaaccactttcggaataccaaaatccttctcttcacaatcgccatttgtacctctttttacacggtttatgctgacgaggactgcctgtccaagaacatccgcattacataccaagaactgcacaattgcatcggcccccatattatgggggatacctgtatgcctaaaagcgagctttattctgacctcctgtccaagaacctgatcaccgagtacgataagaaatatttcgaacccgacacagtgaatgatcagttcaacaagatcgagtttgcccaggacgcccacagaatgattctcctggaacggatcctttacaaaaccgagtgcgaaatgctgagcctcaagaaaaattccggaccgtataacgtcgcttggagaacatacctgaagaatcataacattgatctgtgttctcgccacaactacaagatgatctgccagtgtattaatacgcatagcatgtgcaaaaacaccgacatcgatttcaataaggagatcgagacatattacaaagccaacgcggctgcctatcggtccgactttaataccattatcgatacacttaagaccgccttcagaggcctcacgaaagtgctgattgaaaactacatcgagaaggacgactctgatgctctgaaagccctctttagcaatattaccgactccgttcaagataactatcagatggtgggcgtcctgaagttcgctagcaagctgctgaatatctctctcgggcgcacaacccggtccgcccagcacagcattatgacaaacgaaatccctaaatctaatccctttaccgactactcctatagctctatcaacattaaggagtgtatgagccctgagtccctgaaatgcttcaagaaaagagatagcgcgccccacacgaatcatctgctttgtaagatcgacaacaagtacaaagcctttgattggcccgaaattgagacagtgcaaaagggacagaaactctgcctgggcgactctcactgtaatctggagttcaccgctatcacagccgataagattatgtccctcaccaactgctacaaagagagctttaccgctcagcctgccgacatgcagacagggatcaagaagtgctccgcggatgaaatcggagagtgtattacgctggaggacaaatcttggccgatcattttctgcggcgataagtattactatagcgacgggaaagaacatgccaaggacggctccatcaacaattactgtcttgctaacaaatgctctgagcaacgctttcccattcacaagaattggttcaagaaatgtaactgggataagacccacaaagagttcacaaccatgcggcagatcaattataacgacatcacaagctacagaaaggccattgaatccgaaatcggaaccgatctgatgacgcatcactataaacctacaaagaatctcccccatgtcgtgcctcgctaccactctattgacgttcagggcaccgagagcaccgaggggatcattaacggatttatccagaatacaattcccgctatctccggcctgggggtgggataccatctgggcttcaaagggaaccaactttttgatatcgtcattttcgtgaagaaggccgtttataaagcccagtaccagaaggtgtataccacaggcccgagcatctctattaatatcgaacacaacgagaaatgcacgggacactgtcctgaaaagattcccgctaaagagggctggctcaccttttccaaggaacatacaagctcttgggggtgcgaggagtacggatgtctggcgatcgacaccggctgcctgtatgggtcctgtcaggatgtcatccggcctgaactcgacatttacaagaaaatcggaagcgaggcctctctgattgaaatctgcattacacttccccacgagacctattgcaatgatatggacatcctggagcctatcattggcgataagctctccgctagcttccaaaacacgcagaccaatcagctgcccaacctgatggcctacaaaaaggggaaagtgtacacaggccagatcaacgacgtgggaaataccgcccttcaatgtggctccattcaggttgtcaacgggagcacaatcggatctggcaatccgaagtttgattatatttgccatgctatgagacgcaaggacgtgatcgtgcggaaatgtttcaacgacaattaccagagctgcaccagactggatcctcggaacgacctcattccctatcgcaagggggatatcatcgaaatttccaaaacaggatctaatatgggccaaatgacctttaagatcgagctgggggacattaactacaaaatcttcacgaaaagcgtcgatctccagatgtccggcatttgtgccggatgcatcgactgtgcggaaggcatctcttgcagcattaatgctgatgtgtccgccgagacagtttgtcactgcaagaccaactgtgaagactttatctctaatattgtgatcagcccccagattaaaacctataacatcaaggtccattgcaaatccaaggtggagaaaatcacagccaatatttgcgagagaaacatcgatctgcagcttaccgttaagccttacaatcaaaagattgacctgagccagctcgatgaatctaactatatcaaagaggaagacctgcagtgtgggacgtggctgtgcaaggtgcagaaagagggaattgacatcgtcttcaagggccttttctccgggctgggaaaatactgggctattctcatctacagcatcattggcatcattgtggttatcctgctcatttatgtgctgcttccgatcggccggctgctcagagcctttctgatcaagaatgaaattgagtacacaatggagcaaaagatcaagtga

SEQ ID NO: 14344 - RNA, 4263 nt, synthetic construct
  misc_feature 1..4263: note = derived and/or modified CDS sequence (opt5) from OROV(TVP-19259/IQT-7085)__KP795094.1__GP
  source 1..4263: mol_type = other RNA
atggccaacctgatcattatcagcatgattctcggcatcgcttacgggcaccccctgtccatttctcagatcggagacagatgcttcgccggcgggagcctttttaaggagatgaatctgtccgtgggactcggcgaaatctgtgtcaaagatgacatttctatcgttaagagcaccacagcgttctccaaaaacgctctggcccttgaggccacgaccaagttttatcggtctttcattgtgaaagattggagcgaatgcaatcctgtgctggacaagtttgggaacttcatggtcctcaatgtggatgacaacggacatctggttccgaagatgtacacatgtcgcgctgcctgcgatatcagactgaataaagacaacgctgagattatcctctccagcaccaagctgaatcactttgaaattgtgggcacaacctctacatccggctggttcaaaaacaccatcacgaataaccttgagcatacctgtgagcacgtcacagtgaattgcgggcaaaagagcgttaaatttcatgcctgtttccggcagcaccgcggatgcatcagatttttcaagggcacctatatgccctactctatgattgaagcgatgtgtgtgaacatcgagctgattatcctcacactgtatatttttgccgctatcatcttcgcccttattatcaccaagtcctacattgcttatctgctcctgcctctgttctaccccgtcacgtggctctacgggaaagtgtataagcggatcaatagctgccctaactgtctgcttgcctctcacccctttacatcctgccctaaaatttgcatctgtggaagccgcttctcctgcaccgaagcgctgaaggtgcatagaatgggcaaagattgtctcgggtacaagtctctgagcaaagcccggcagatgtgcaagtccaagagctggtcttttacagctgccatccttaccggactgattctcatggagttcgtctccccgatcgctggcgagcgcatgtataaactggaagaactggccgacgattacattgaactcgccgagcaggttaacatcctgggcaaggaaattaaaatccttaagcaaagcattgtggtgatgctggctatcatcctcattctgcttctgtctgagaatatcatttttaactatctcttcaataccctgtacagaagctgttccatgtgcgggctgatccactatcggcccggactcaaagtcgacctgacaaagacgaacaagtgtggctcttgcatttgtgggtttgatgagcagcagagctccggattcgaatacgaggtgtttcttaaagacatgcatgttcagcgcgaaagctgcaagttcggccctagagtgaatcactttcggaacaccaaaatccttctcttcacaatcgcgatttgtacctctttttacacagtctatgccgacgaggattgcctgtccaagaatatccgcattacctaccaagaactgcacaactgcatcgggccccatattatgggagacacgtgtatgagcaaatctgagctttattccgatctcctgagcaagaatctgatcacagagtacgacaagaaatatttcgaacctgataccgtgaacgaccagttcaataagatcgagtttgctcaggatgcccacagaatgattctcctggaacggatcctttacaaaaccgagtgcgaaatgctgtccctcaagaaaaactctggcccctataatgttgcctggagaacatacctgaagaaccataatattgacctgtgtagccgccacaactacaagatgatctgccagtgtattaacacccattccatgtgcaaaaatacagatatcgacttcaacaaggagatcgagacgtattacaaagctaatgccgcggcttatcggtctgattttaacaccattatcgacacacttaagaccgccttcagaggcctcacaaaagtgctgattgaaaattacatcgagaaggacgatagcgacgccctgaaagctctcttttccaacattaccgatagcgtccaagacaattatcagatggtgggggtcctgaagttcgcctctaagctgctgaacatctccctcggacgcacgacccggagcgctcagcactctattatgacaaatgaaatcccgaaatccaacccttttaccgattacagctattctagcgtgaatatcaaggagtgtatgtcccccgagagcctgaaatgcttcaagaaaagagactctgcccctcacacaaaccatctgctttgtaagatggataataagtacaaagcgtttgactggcccgaaattgagaccgttcaaaagggccagaaactctgcctgggggattcccactgtaacctggagttcacggccatcacagctgacaagattatgagcctcaccaattgctacaaagagtcctttacagcccagcccgctgatatgcagaccggaatcaagaagtgctctgccgacgaaattggcgagtgtatcaccctggaggataaaagctggcctatcgtgttctgcggggacaagtattactattccgacggcaaagaacatgcgaaggatggatctattaacaactactgtcttgccaataaatgcagcgagcaacgctttccgatccacaagaactggttcaagaaatgtaattgggacaagacacacaaagagttcacgaccatgcggcagattaactataatgatatcacatcctacagaaaggctattgaatctgaaatcggcaccgacctgatgacacatcactataaacccaccaagaacctccctcatgtcgtgccccgctaccacagcatcgatgttcaggggacggagtccacagagggaattatcaatggctttattcagaacaccatccctgccattagcgggctgggagtgggctaccatctggggttcaaaggcaatcaactttttgacatcgtcattttcgtgaagaaggctgtgtataaagcccagtaccagaaggtttataccacaggaccctctatctccatcaacattgaacacaatgagaaatgcaccggccactgtccggaaaagatccctgccaaagaggggtggctcacatttagcaaggaacatacgtcttcctggggatgcgaggagtacggctgtctggctattgataccgggtgcctgtatggaagctgtcaggacgtcatccggcccgaactcgatatttacaagaaaatcggctctgaggcgtccctgatcgaaatttgcatcacacttcctcacgagacctattgcaacgacatggatattctggagcccatcattggggacaagctcagcgcctccttccaaaatacacagaccaaccagctgcctaatctgatggcttacaaaaagggcaaagtgtacacgggacagatcaacgatgtgggcaacaccgcccttcaatgtgggagcatccaggtcgtgaatggatctacaattggcagcgggaaccccaagtttgactatatctgccatgccatgagacgcaaggacgttattgtgcggaaatgtttcaatgataactaccagtcctgcaccagactggacccgcggaatgatctcatcccttatcgcaagggagacattatcgaaatttctaaaacaggcagcaacatggggcaaatgacctttaagatcgagctgggcgatatcaattacaaaattttcacaaagtccgtcgacctccagatgtctggaatctgtgctggctgcattgattgtgccgaagggatcagctgctccattaacgcggacgtgtctgctgagaccgtttgtcactgcaagacgaattgtgaagattttatcagcaacatcgtgattagcccccagatcaaaacatataatattaaggtccattgcaaatccaaggtggagaaaatcaccgccaacatttgcggaagaaatatcgacctgcagcttaccgttaagccctacaaccaaaagatcgatctgtctcagctcgacgagtccaattatattaaagaagaggacctgcagtgtggcacatggctgtgcaaggtgcagaaagaagggatcgatattgtcttcaagggacttttcagcggcctgggcaaatactgggccatcctcatttactctatcattggggtgatcgtggtcatcctgctcatttatgttctgcttcctatcggacggctgctcaaggcttttctgattaaaaacgagatcgaatacaccatggagcaaaagattaagtga

SEQ ID NO: 14345 - RNA, 4263 nt, synthetic construct
  misc_feature 1..4263: note = derived and/or modified CDS sequence (opt5) from OROV(TVP-19262/OBS-9478)__KP795100.1__GP
  source 1..4263: mol_type = other RNA
atggccaacctgatcattatcagcatgattctcggcatcgcttacgggcaccccctgtccacctctcagattggagacagatgcttcgccggcgggagcctttttaaggagatgaatctgtccgtgggactcggcgaaatctgtgtcaaagatgacatctctattgttaagagcacaacggcgttctccaaaaacgctctggcccttgaggccaccacaaagttttatcggtctttcatcgtgaaagattggagcgaatgcaatcctgtgctggacaagtttgggaacttcatggtcctcaatgtggataacaatggacatctgattccgaagatgtacacctgtcgcgctgcctgcgacatcagactgaacaaagataatgctgagattatcctctccagcacaaagctgaaccactttgaaattatcggcaccacatctacctccggctggttcaaaaatacgatcaccaacaatcttgagcatacatgtgagcacgttaccgtgaactgcgggcaaaagagcgtcaaatttcatgcctgtttccggcagcaccgcggatgcattagatttttcaagggcacatatatgccctactctatgatcgaagcgatgtgtgtgaatattgagctgatcattctcaccctgtatatctttgccgctatcattttcgcccttatcattacgaagtcctacatcgcttatctgctcctgcctctgttctaccccgccacatggctctacgggaaagtttataagcggattaacagctgccctaactgtctgcttgcgtctcacccctttacctcctgccctaaaatctgcatctgtggaagccgcttctcctgcacagaagccctgaaggtgcatagaatgggcaaagactgtctcgggtacaagtctctgagcaaagctcggcagatgtgcaagtccaagagctggtcttttaccgccgctattcttaccggactgatcctcatggagttcgtctccccgattgccggcgagcgcatgtataaactggaagaactggccgatgactacatcgaactcacagaacaggtgaatattctgggcaaggaaatcaaaattcttaagcaaagcatcatcgtgatgctggctattatcctcattctgcttctgtctgagaacatcatttttaattatctcttcaacacgctgtacagaagctgttccatgtgcgggctgatccactatcggcccggactcaaagtcgatctgaccaagacaaataagtgtggctcttgcatctgtgggtttgacgagcagcagagctccggattcgaatacgaggtttttcttaaagatatgcatgtgcagcgcgaaagctgcaagttcggccctagagtgaaccactttcggaataccaaaattctcctgttcacaatcgcgatttgtacctctttttacacggtctatgccgacgaggactgcctgtccaagaacatccgcattacataccaagaactgcacaattgcatcgggccccatatcatgggagatacctgtatgcctaaaagcgagctttattctgacctcctgtccaagaacctgattaccgagtacgataagaaatatttcgaacccggcacagtgaatgaccagttcaacaagatcgagtttgctcaggatgcccacagaatgattctcctggaacggatcctttacaaaaccgagtgcgaaatgctgagcctcaagaaaaattccggcccgtataacgttgcctggagaacatacctgaagaatcataacattgacctgtgttctcgccacaactacaagatgatctgccagtgtatcaatacgcatagcatgtgcaaaaacaccgatattgacttcaataaggagatcgagacatattacaaagctaacgccgcggcttatcggtccgattttaataccattatcgacacacttaagaccgccttcagagggctcacgaaagtgctgattgaaaactacatcgagaaggatgactctgacgccctgaaagctctctttagcaatattaccgattccgtccaagacaactatcagatggtgggagttctgaagttcgccagcaaacttctgaatatctctctcggccgcacaacccggtccgctcagcacagcatcatgacaaacgaaattcctaaatctaatccctttaccgattactcctatagctctatcaacattaaggagtgtatgagccctgagtccctgaaatgcttcaagaaaagagacagcgcgccccacacgaatcatctgctttgtaagatcgataacaagtacaaagcctttgactggcccgaaattgagacagtgcaaaaggggcagaaactctgcctgggagattctcactgtaatctggagttcaccgccatcacagctgacaagatcatgtccctcaccaactgctacaaagagagctttaccgcccagcctgctgatatgcagacaggcattaagaagtgctccgccgacgaaatcggggagtgtattacgctggaggataaatcttggccgatcattttctgcggcgacaagtattactatagcgatggaaaagaacatgcgaaggacggctccatcaacaattactgtcttgccaacaaatgctctgagcaacgctttcccatccacaagaattggttcaagaaatgtaactgggacaagacccacaaagagttcacaattatgcggcagatcaattataacgatattaccagctacagaaaggctatcgagtccgaaattgggacagacctgatgacccatcactataaacctacgaagaatctcccccatgtcgtgcctcgctaccactctatcgatgtccagggaacagagagcaccgagggcattatcaacgggtttatccagaataccattcccgccatctccggactgggcgtggggtaccatctgggcttcaaaggaaaccaactttttgacattgttatcttcgtgaagaaggctgtctataaagcccagtaccagcgggtgtatacaaccggcccgagcatttctatcaatatcgaacacaacgagaagtgcacagggcactgtcctgaaaagattcccgccaaggagggatggctcacgttttccaaagaacataccagctcttggggctgcgaggagtacgggtgtctggctatcgatacaggatgcctgtatggctcctgtcaggacgttattagacctgaactcgatatctacaagaagattgggagcgaggcgtctctgatcgaaatctgcattacccttccccacgagacatattgcaatgacatggatatcctggagcctattatcggcgacaaactctccgccagcttccaaaacacccagacgaatcagctgcccaacctgatggcttacaagaaaggaaaggtgtacaccggccagattaacgatgtcgggaatacagcccttcaatgtggatccatccaggtggtgaacggcagcattatcgggtctggaaatccgaaatttgactatatctgccatgccatgcgccggaaggatgttattgtcagaaagtgtttcaacgacaattaccagagctgcacccggctggaccctcgcaacgatctcatcccctatagaaaaggcgacattatcgaaatttccaagacagggtctaatatgggccaaatgacctttaaaatcgagctgggagatatcaactacaagattttcacaaaaagcgtggacctccagatgtccggcatctgtgctgggtgcattgattgtgccgaaggaatctcttgcagcattaatgcggacgtgtccgctgagaccgtctgtcactgcaagacgaactgtgaagattttatctctaatatcgtgattagcccccagatcaagacatataacattaaagttcattgcaagtccaaagtggagaagatcaccgccaatatttgcgagcggaacatcgacctgcagcttaccgtcaaaccttacaatcaaaagattgatctgagccagctcgacgaatctaactatatcaaggaggaagatctgcagtgtggcacatggctgtgcaaagtgcagaaggaggggatcgacattgttttcaaaggacttttctccggcctgggcaagtactgggccatcctcatttacagcatcattgggatcatcgtggtcattctgctcatctatgtgctgcttccgattggaagactgctccgcgcttttctgatcaaaaatgaaattgagtacaccatggagcaaaagatcaaatga

SEQ ID NO: 14346 - RNA, 4299 nt, synthetic construct
  misc_feature 1..4299: note = derived and/or modified CDS sequence (opt5) from OROV/FPV(Aus Ch 16129)__KF697137.1__GP
  source 1..4299: mol_type = other RNA
atgaagttcgtgagcatcctgctctttgtctcctggctgggcgccacctaccagaaccccgtttctcacagacaaattggggagcggtgcttcgctggaggcagccttatcaaaacagtgaatcagacgtccggggtgtctgaagtctgtgtgcgcgacgatattagcatgatcaagtccattgttcataccacaaaagcctctgacaccgcggtgaacaattatatcagattttaccgggtcttcatcgtgaaggagtggcacgattgcaacccttttccggaccccaaaggaacattcatggttctggatgtgagctccaccaatcatctcgaacctattacatatacctgtcgcacgccctgcgagatcaccctggacaaggatagcgctgaagtcacactttcttcccagaagatgaaccactacgagattagcggctctaccatcaataacgggtggtttaaaaattccattagcgtgtctctggagcatacatgtgaacacatcaccgtgtcctgcggacagaagacggtcagattccacgcctgttttcggcaacatcgcagctgcacaagattctttaaaaactccatgatgcctgcccggatgaccgagtctatttgtcagaatctcgaaatcatcctgctgacatgcttcagctttgtttgtttcattttcctctgcatcattaccaagacctatgtggcttacgtgctgatccccgtcttttatcctttcacatacatttacggccgcctttatgacaaatactttaagctgtgcgagaactgtctcctggccgtgcacccgttcacgccctgcgagaccgtttgtgtgtgcggctcccagtatgctaatacagaacagcttagaacccatcggatgacaaacaattgtaaggggtacaaaagcctgtctaagtcccgcgccatgtgcaaaagcaagggatgttcttttgtcgtggcgatcttctgcagcatcattttcttctcctttatcacccctattaactctcaagagtataaactcagcgatctgcccgacgaatttacgagactggaggaagagaacacaatgctcaagatccggctgcttgttattaaaatcaccatctccgtgattagcgtcaccatcacagtgacctctctgacagagcgcaaggtctttcaggaactcttcaatgccatttacagacactgtcctttttgcggcatgatccaccggagacgcgggctgcgggtggttaactccacgaccaataagtgtggaacatgcatttgcggctataaagaggaaaccgagcatggggtggaatacgagatcttccttaagacaatgcaccaggagaacgtcaattgtatgttcaaacccagccagagacattttcgcaacttcaagattctgatcgcttttctcgccatgtgcatgatcattacctctgtgtccgctgatgaaaaacactgtctgaagtacaaggagccggttaaactgagcaatctcacggaatgccattccctgtggcttaacatcaccgagtgtcaaattaatcagtctacactgttcgaaaccctcaagggagagcagctggtgacagactttgataaacctgacttcaccatcatgggccaaaagtatgacattgccatggagcggatcgaaaacgcgcagaatcttcaccacatgatcctgctcgagtacctgcatgccaaaagcaactgcctgaagtataagcagctcaaatccaattctggcccctacaacattccttggagaacgtatatccacgggcatggactggatgtctgtggccagtacagctataaacttatttgcaagtgtatctccacagggatgcactgcgaaaataccgctctggacatttacaacgagatgcgccaattttacacaaacaatcaggagaactataatctcgatctgaacaccgtgatcaaggccatcggactggctatgcggggcattgggcagatgatcattgaagagttctttggagaaagccagatcgaggaactttctaatttcctcaacatgacctccaaaaatctgggcacaaacaagcaactgattggcctcatcaattttgggctgatgcttctggacatcaaccagacgaagacaccccagattgatcccaaacctagaaccctccaggcccgcagctctatcccgaccggaacagagattaccgactggacgaagggccaatccaaaatcaagacatgtgccgagtacagcaccctgacctgccagtcttggcggaaaacagtgaataccaagagcttcctgatgtgcaaagtttccagcaagtggcacgtctataactggcccgaaattcctacagtggtgagaaattctaaactttgtctcggggattaccattgcaacatggagtttacgcccatcgacgctgatgaagcgctgaagcagctgcgctgttataagaccgagttcgtcccttcccccgacggaatggatgaaagcattaaaaagtgcacactcgagaaattcggcgggtgtaccacagccaatggccactcctggaccatcatggtgtgcaacggacggtactatcagacgaacaccagagagcatgctaaggacggcctgcttaattcttactgttttgaaccgaagtgccaaagcgggcggcaccctatccataaatccttcctgaacaattgtatttggaaggagtctagccgccagatcattgaaacaagaaccatcgagtacaacaatattgaagactataaaaagtccgttgagtctgatatcaaaagcgacctcacaatccaccactttaagcccaccaagaacctgcctctggtgacacccacctacatttccgtcgtggccgatggaacgatggttagcgacggcatccagaatgcctatgtgaaagggacaattcctggaatctctggcgtcgctaccgggcttcatgtgaagacccccgatggcattctcctgatggacatcatcgtttacgtgcggaaagccctgtataaggcgaactacgagaaaatttattccacaggaccgaccatcggcattaatgtcaagcacaacgaaaagtgcacggggacatgtcctgagcatatccccaaagatgaaggatggctcaccttcagcaaggagcacacatctaattggggctgcgaggaatacgggtgctttgctattaactccggatgtctgtacggcagctgccaagacatcattagacccgagcttgatatctataaacagcagggggaggaacagaccctgctcgaactgtgtatcacactgcctcatgagaccttctgcaatgaccttgatgtgctcgagccggtgattacggacaagctgcaactggattttcagaccacacagtctgaccacctccccgaactggtcgcccttaaaaagggcctgatcctcaccggacagctgaacgacctgggcaatacagccgctatgtgtgggtccgttcaacttgtgaacaaaaccatttacggacagggcaaccctaagttcgattttatctgccacgccatgcgccggaaggacgtgattgtcagacgctgttatgataatcattacagcacgtgcgctctgctcaaacagagaaacgacctgctccacaaggaggtgaatgatcagatgtccatcacagttaacgggaaaaatctgggacttatcaacttccggctgaatctcggcgacctgaactataagctgtttgtgaatgaacccaacttcgagcttaccgggcaatgtgccggctgcattagctgtgcggatgaaatctcttgccagctgaatattatcgccgaccatgagttcacatgcaaagtcagctcctcttgtaacctctacattagcaatatgatgatcacccctgctaaccacatctataatctgaaggtgtcctgccgcgagcacgtttctaacattgatctcgccgtgtgtggacggagcttttccctgcatgctacccttaagcagcactctcaaaaactggacctcagcgccctggatgaaacaaatttcgtcaaggaggaagacctgagatgcggcacgtggctttgtaaagtgaaggatgaggggctgtcctttctcacccgcagcatcttcggatctctgggcacatactggtcctactttatttatgggctcatcttcatgattctgctttttatcgcgatttacttcctgtatcccctgtgcaaaagactcaagggactgcttgaagagaacgagcgggaatacctgatcgagagcaagatgaaatga

SEQ ID NO: 14347 - RNA, 4257 nt, synthetic construct
  misc_feature 1..4257: note = derived and/or modified CDS sequence (opt5) from OROV/IQTV(IQT9924)__KF697143.1__GP
  source 1..4257: mol_type = other RNA
atggactgcatcattttctacctgagctttttcgccgtggtcaccgctcaccccgtttcccatcaccaggtgggcgatagatgttttgccgggggaaacctcatcaaggacctgaataaaacagtgaacattggcgaggtctgcgtgcgggatgacatctctattatcaagagcacgaccgcgatccaaaaatcccttgatcatctgtctacacgcaccaagttctatagagtttacattgtgaaagaatgggctgagtgtaatcctatcattgactatgccgggaactttatcgtcatgaatattgatgacaacggacacctcgtgccgcggatgcatacatgccgcgccagctgtgatatcagactgaataagaacgacgctgaaattatcctttcctctcagaagaccaatcactacgagatcattggcacaaccacggttagcgggtggttcaaaaacaccatcaatctgcccctcgaacacacatgcgagcatattaccgtgaactgtggacagaagtccctgcggtttcacgcctgcttccgcatgcatagaggctgtacacggtttttcaaaaatacctatatgcctagcacgatgatcgagcacatgtgcgtcaacctggaactcattatctttacactgtacatcttcaccgctcttgtgtttgcctatattatcacaaagtcttacattgcgtacatcctgctccccctgttctatcctcttacctacgtgttcggcattatctattccaaactgaagcagtgtaagacctgcatgctcgccgctcacccctttacaaattgccctaaacgctgtgtctgcgggagcagattcaactgtacggaggccctgcgggttcatcgcctgggaagagattgccaaggctacaagtctctctccaaagctcggcagatgtgtaagagcaaatcttggtcctttatcattgccatcttcaccgggctgattcttatggaatttatcacaccgattcacggagagcgcacctataagctgagcgagctcgcggacgagttcatcgccatgaaaacagaagtgaccgtgatgcagagatccatttacaaccagaagatcctgaatatcgcccttctgacgctcgtcgtgctgattatcctgctcgaaacatatatttttaagatcctgttctctcttctgtaccggagctgctccatgtgtggcctcattcattacaaagttgggctgaagatcaaccttctgaccaccaataaatgcggaacatgtatctgcggctttagcgagcaacagtcttccggcttcgaatatgaggtgtttctcaaggatatgcacaaacagagagagagctgtaagtacttccccatgctgaaccattttcgcaatctgaagattctcaccacaatcctgcttctgattctcctggccacgtctgtcagctccgaatgcctgcagaaacctcttaagatcaaactcgaggacctgcacgaatgcattggggtgaacttcctggacaagcaatgttataatcggaaaaacctctacgagtctctgagaagcaagaatcttatctccgaagttgataagaaatatttcgagaacgctgacctggagggacagtttaagcgcatcgaatacgcccaggatgcccaccggatgattctcctggagagaatcctgtatagcaccgaatgcgagatgcatacaattcttaccaatggcggggcttacaacatcccctggcgcacatacctcaaaaatcacaacctgaatctgtgtggaaagcatgtgcacaaaatggtctgccaatgtgtgaacacccacacgcagtgcctctctaccggcattgactatcaggatgaaatcacaaagttctaccaggcggacggggattcctatcggagcgacctgtctatcattcttgagaccatctccacagcctttagaggactgaccaaggtcctcattgagacgtacatcgaacaagataacagcgagtccatgattaaactgctgaatacaatccagggcaaggtgcctaacaattatcagatgcttggcattctcaaattcgctatcaagatcatgaacattaatcagacccgcggggttcggtctgccagacatacaatcgtgagcaacgacattcccatgtccgaaccgttttctaatttcgaggtcagcaacatcaatattaaacaatgtctggagcctctgaccctcaagtgctttaccaaacgcggagatagcccccactccaaccatctgctttgtaaggaacagtctaagtacaaagtgttcgagtggcctgaagttgagacagtgacgaagaataacaaactgtgcctcggcgacacccactgtaatctgaagtttacagccaccacatccgacgaaatcatcaaactgcttaactgcttcagcgatacctataagcccaatcccggggagatggagattggactcaagaaatgcaacgctgaaaagatcggcgagtgtgtcacgctggaaaactctccttggccgattgtgtactgcgagaataaatactattactccgaagccaaggagcatgcgaaagacgggagcgtgaactcttattgtctgacaaataagtgcaccgaggatcggctccccatcaaccctgcttggtttaagagctgtaattgggaaaagaacattaaggagaccgccacaatcaaagagttcgtttacaatgacatcaagtcctatagaaaaagcctggaatctgaaattaacaccgatcttatgatccaccactaccggcccacaaagaatctgcctcatattaagcccatctataaatccctcagcattcagggctccgagacggtcgacggactgcagaactcttttatcgagggcgaaatgccggccattagcgggctggctaatggataccaccttatgtacaagggcacccaactgttcgatatcgtgatcttcattcgcaaagccgtgtataaggctaactactataaaatctacacaaccgggccttccattgccatcaatatggagcataacgaacagtgcacaggacactgtccctctaagattcctagcaaagagaattggctcaccttttccagagagcatacgtctagctggggctgcgaagagtatgggtgtctggcgatcgacaccggctgcctctacggatcctgtcaggatgtcatccggcccgaaattgacgtgtataaaaagagcggcacagagcagtctctgatcgaactttgcattacctccgcccacgagacattctgcaacgatctggacatcctcgagcctattatcggggagaaaatcagcgcttcttttcaatccacccagagcaaccagctgcccaatattatcgccttcagaaagggacaaattctgacaggcgctatcaacgatcttgggaataccggatctcagtgtggctccattcagctggttaacaatacgctcctgggggaaggcaacgtgaaatttgactacatctgccacgccatgcgccggaaggacgtcattatcagacgctgttacaatgatcatttcacaagctgcaacctcctgcagaaaagatccgaccttatcggaaatattaacggcaaggaactgcaaatcagcatgtctgggcggagcatgggatccatgaagtttaaaattgagctcggcgatatcaattataagctgtacaccgaaaacgcggacattaccatccgcggggagtgtggaggctgcatcgggtgtgccgaggctgtgtcttgcagcctggaagttgagtccgcctctgaaattctttgtaaagtggagtgcaattgtcagccgtatatcgaaaacattctgatcaagcctcagacaaaaacctacagcttcaaggctacgtgcctcgagaagtccaatacactggatattaaaatctgcggcaagcagatcattgctcccctcaccatcaaatcttataaccaaaagattgacctgagcaaacttgatgagtccaattacgtcaaggaagaggacctggcctgtaacacatggctgtgcaaggtgcagaccgaaggatttaacttcgtttttagcggcctcttcgctgggttcggaagatattggacaatcgcgatttacatcctgattgccgtggtcatcatccttattctgatctacattctcatgcccatctttcggctgattcgcaccttcctcatcaaaaatgagatcgagtatacgaccgaacagaagatgagatga

SEQ ID NO: 14348 - RNA, 4257 nt, synthetic construct
  misc_feature 1..4257: note = derived and/or modified CDS sequence (opt5) from OROV/IQTV(MIS-0397)__KJ866387.1__GP
  source 1..4257: mol_type = other RNA
atggactgcatcattttctacctgagctttttcgccgtggtcaccgctcaccccgtttcccatcaccaggtgggcgatagatgttttgccgggggaaacctcatcaaggacctgaataaaacagtgaacattggcgaggtctgcgtgcgggatgacatctctattatcaagagcacgaccgcgatccaaaaatcccttgatcatctgtctacacgcaccaagttctatagagtttacattgtgaaagaatgggctgagtgtaatcctatcattgactatgccgggaactttatcgtcatgaatattgatgacaacggacacctcgtgccgcggatgcatacatgccgcgccagctgtgatatcagactgaataagaacgacgctgaaattatcctttcctctcagaagaccaatcactacgagatcattggcacaaccacggttagcgggtggttcaaaaacaccatcaatctgcccctcgaacacacatgcgagcatattaccgtgaactgtggacagaagtccctgcggtttcacgcctgcttccgcatgcatagaggctgtacacggtttttcaaaaatacctatatgcctagcacgatgatcgagcacatgtgcgctaacctggaactcattatctttacactgtacatcttcaccgcccttgtctttgcgtatattatcacaaagtcttacattgcctacatcctgctccccctgttctatcctcttacctacgtgttcggcattatctattccaaactgaagcagtgtaagacctgcatgctcgctgcccacccctttacaaattgccctaaacgctgtgtgtgcgggagcagattcaactgtacggaggctctgcgggtccatcgcctgggaagagattgccaaggctacaagtctctctccaaagcccggcagatgtgtaagagcaaatcttggtcctttatcattgcgatcttcaccgggctgattcttatggaatttatcacaccgattcacggagagcgcacctataagctgagcgagctcgccgacgagttcatcgctatgaaaacagaagttaccgtgatgcagagatccatttacaaccagaagatcctgaatatcgcccttctgacgctcgtggtcctgattatcctgctcgaaacatatatttttaagatcctgttctctcttctgtaccggagctgctccatgtgtggcctcattcattacaaactggggcttaagatcaacctgctcaccaccaataaatgcggaacatgtatctgcggctttagcgagcaacagtcttccggcttcgaatatgaggtgtttctgaaggatatgcacaaacagagagagagctgtaagtacttccccatgctgaaccattttcgcaatctcaagattctgaccacaatccttctgctcattctgctggctacgtctgttagctccgaatgccttcagaaacctctcaagatcaaactggaggacctgcacgaatgcattggggtgaacttcctcgaccggcaatgttataatagaaaggatctgtacgagtctcttcgcagcaaaaacctgatctccgaagtcgacaagaagtatttcgagagcgccgatctcggaggccagtttaaacggatcgagtacgcccaggacgctcacagaatgattctgctggaacgcatcctttattctaccgagtgcgaaatgcatacaattctcaccaatgggggagcgtacaacatcccctggcggacatacctgaagaatcacaacctgaatctctgtggcaaacatgtgcacaagatggtttgccaatgtgtgaacacccacacgcagtgcctgtccaccgggattgattatcaggacgagatcacaaaattctaccaggccgatggagacagctatagatctgatctttccatcattctggaaaccatcagcacagcttttcgcggcctcaccaaggtcctgattgagacgtacatcgagcaagacaattccgaatctatgattaagctgcttaacacaatccagggcaaagtgcctaacaattatcagatgctcgggattctgaagttcgccatcaaaatcatgaacattaatcagacccggggagtcagaagcgcccgccatacaatcgtgtccaacgatattcccatgtctgagccgtttagcaatttcgaagcctccaacatcaatattaagcaatgtagcgagcctctgaccctcaaatgctttaccaagcggggcgactctccccactccaaccatctgctttgtaaagagcagagcaagtacaaggttttcgaatggcctgagatcgaaacagtgacgaaaaataacaagctgtgcctcggggacacccactgtaatctgaaatttacagccaccacatctgatgagatcattaagctgcttaactgcttctccgacacctataaacccaatcccggagaaatggagatcggcctcaagaagtgcaacgcggagaaaattggggaatgtgtcacgctggagaatagcccttggccgatcgtgtactgcgaaaacaagtactattactctgaggctaaagaacatgccaaggatggcagcgttaactcctattgtctgacaaataaatgcaccgaggacagactccccattaaccctgcctggtttaagagctgtaattgggagaagaacatcaaagaaaccgctacaatcaaggagttcgtgtacaatgatattaaatcttatcggaagtccctggaaagcgagatcaacaccgaccttatgattcaccactaccgccccacgaaaaatctgcctcatatcaagcccatttataagtccctctctatccagggaagcgaaacagtcgatggcctgcagaactcctttattgagggggagatgccggccatctctggactggctaatggctaccaccttacctacaaagggacacaactgttcgacatcgtgattttcatcagaaaggccgtgtataaagcgaactactataagatttacaccacaggacctagcatcgccattaatatggaacataacgagcagtgcaccggccactgtccctccaaaatcccttctaaggaaaattggctcacgtttagccgggagcatacctccagctgggggtgcgaggaatatggctgtctggctatcgatacaggatgcctctacggctcttgtcaggacgttattagacccgagatcgatgtctataaaaagtccgggaacgaacagagcctgattgagctttgcatcacctctgcccacgaaacattctgcaatgacctggatattctcgagcctatcatcggagagaagatttccgctagctttcaatctacccagtccaaccagctgcccaacatcattgccttccgcaaaggccaaatcctgacaggggcgattaatgaccttggaaacaccggcagccagtgtgggtccatccagctggtgaataacacgctcctgggcgaaggaaatgtgaagtttgactacatttgccacgccatgcggagaaaagatgtcatcatccgcagatgttacaacgaccatttcacaagctgcaatctcctgcagaagcggtctgatcttattggcaacatcaatgggaaagagctgcaaattagcatgtccggacgctctatgggcagcatgaagtttaagatcgaactcggggacattaactataaactgtacaccgagaatgctgatatcaccatcagaggagaatgtggcgggtgcattggctgtgccgaggctgtgtcctgctctctggaggttgaaagctcctctgagatcctttgtaaggtggaatgcaactgtcagccgtatattgagaatatcctgattaaacctcagacaaagacctacagcttcaaagccacgtgcctcgaacggtccaacacactggacatcaagatctgcggaaagcagattatcgctcccctcaccattaaaagctataatcaaaagatcgatctgtctaaacttgacgagtccaactacgtcaaggaggaagatctggcttgtaatacatggctgtgcaaagtgcagaccgagggctttaacttcgtttttagcggactcttcgcggggttcggccgctattggacaattgccatctacattctgatcgctgtggtcatcattcttatcctgatttacatcctcatgcccatttttagactgatccggaccttcctcatcaagaacgaaattgagtatacgaccgagcagaagatgcgctga

SEQ ID NO: 14349 - RNA, 4257 nt, synthetic construct
  misc_feature 1..4257: note = derived and/or modified CDS sequence (opt5) from OROV/MDDV(FMD 1303)__KF697145.1__GP
  source 1..4257: mol_type = other RNA
atggccttcctgctcatctacgtggtcctggctgccgcggttgctagccaccccctttccaaccatcagattggcgacagatgctttgccgggggaaatctgatccgggagctcaacaagaccgtgaatattggcgaactgtgtgtgcgcgatgacatctctatgattaaaagcacaacggccatccaaaagtccgtcgggcacctttctaccagaacaaaattctatcgggtgtacatcgttaaggagtgggctgaatgcaaccctattatcgattttgccggaaatttcattatcatgaacattgacgagaatggccatctggtgccgaaaatgcacacctgtcgcgctagctgcgatatcagactcaacaaggacgatgccgaaattatcctgtcctctcagaagacaaatcattatgagatcattgggaccacaagcatctccggatggtttaaaaacaccattaatctgcccctcgagcacacgtgtgaacacatcaccgtcaactgcggccagaaaagcctgcggttccatgcgtgttttcgcatgcacagaggctgcacacggttctttaaaaatacctacatgccttctacaatgattgagaccatgtgtgtgaaccttgaactgatcatcttcacgctctatatcttttccgccgctgttttcgcctacgtgattacaaagagctatattgcttacatcctgcttcccgtcttttaccctattacctatatcctggggtctatctactcccgcttcaaacagtgcaagacatgtatgctcgccgcgcatcccttcaccagctgccctaagaaatgcgtgtgtggatctagatttaattgcaccgaggccctgcgggtgcaccgcctgggcaaggactgtcaagggtataaatccctcagcaaggctagacagatgtgcaaatccaagtcttggagcttcattatcgccgtctttacaggactgattcttatggagttcatcacgccgatttccggcgaacggatgtacaaactgagcgagctcgctgaagagtttatcgaaatgaaggaggaggcctctgccctgaagaaagctattaacaaccttaagctgctcaatgttctgctgtccgcgatcgccaccctcgtggtggtcatggaaacatatatcttcaaaagcctgtttaaccttctgtaccgctcttgtagcatgtgcgggctcattcactataagatcggactgagagtgaatcttctgaccacaaaccggtgtgggacctgcatttgtggcttcaatgagcagcagtcctctggctttgaatacgagatcttcctcaaagatatgcataagcaaagagaaagctgcaagtactttcccatgctgaaccacttccgcaatgttaaaattctgacggtgtttctcctgcttacaatgctgaccgcttccgccagctctgagtgtctccagaagcctctgaaaatcaagctggaggaccttcatgaatgcatcggagtcaacttcctcaatcggcagtgctataactcccaggagctgtaccaaagcctgaaatctaagaatctcgtgtccgaagttgataagaaatatttcgacaacaagaatctggaggatctttttaaaagaattgaatacgcccaggacgctcaccgcatgatcctgctcgagcggattctgtatagcaccgagtgtgaaatgcatacaatcctgaccaacggcggggcctacaatattccctggagaacatatcttaagaaccacaacctcaatctgtgcggaaaacacgtgcataagatggtctgtcagtgcatcaacacgcacacccaatgtctgtccacaggcatcgactaccaggatgagattaccaagttctaccaggcggacggggattcttatcgcgctgacctcagcgtgatcctgcagacaattgccaccgcctttcggggaatgacgaaagtccttatcgaaacctacattgagcaagataattccgagtctatgatcaagctgctcaacacaatcaaagaaaaggtgcctaataactatcagatgctgggcattctgaatttcgctatcaaaattatgagcgttaaccagaccagaggcgtgcgctccgcccggcatacaatcattagcaatgacatccccatgtctgagaccttttccaacttcgaagtcagcaatattgatgtgaagcagtgcacggacccgcttacactcaaatgttttaccaagagaggggatgctcctcactctaaccatctgctgtgcaaggagcaaaataaatacaaggttttcgaatggcccgagatcgagacagtgatgaaaaacaataagctctgtctgggagacacccactgcaaccttaaatttgccgcgatcgcctccgatgaagtcattaagctgctcaactgtttcagcgacacctataagcctaatcccggcgagatggaagtgggggctaaaaagtgcaacgccgacaaaatcggagagtgcattacactggaaaataacccctggcctatcgtgtactgtgagacgaagtattactactctgatgctaaagagcacgccaaggacggcaatgttaacagctattgcctgaccaataagtgtaacgaagatcgctttccgattaatcccacatggttcaaatcctgcagctgggaccggaacgtcaaggagaccacaaccatcaaagaatttgtgcataatgatatctctgcgtacagaaagtcccttgagagcgaaatttccacggacctcctgatccaccattatcggcctacaaagaacctgccccacattatgcctgcctacaagtctctcaccatccaggggagcgagaccgtggatggcctgcaaaattccttcattgagggagaaatgcccgctatctctggccttgccaacgggtatcacctgaagtacaaaggaatcgagctgttcgacattgtcatctttattcgcaaggctgtgtataaagccaattactacaagatctatacaaccggcccgagcgttgccattaacatggaacataacgagcagtgtacagggtcctgccctaaaaagatccccgctaaagagaattggctgacgttctctaaggaacacaccagctcctggggatgtgaggaatacggctgcctggcgattgatacagggtgtctttatggcagctgccaggacgtgatcagacctgaggtcgatgtgtacaagaaagcctctgctgaacagtccctgatcgagctctgtattaccagcgcccatgagacattttgcaacgacctggatatcctcgaacccattatcggagacaagatttctgccgctttccagtccacccaggttaatcaactgcctaacatcatcgcctttaaaaagggccagattttcacgggggcgatcaatgaccttggaaacaccggcagccagtgcgggtctattcaactgatcaataacacactcctgggagagggcaatgtgaaatttgattatatttgtcacgctatgaagcggaaggacgtcatcgtgagacgctgctacaacgatcatttcgcctcctgtaatctgcttcagaaacggagcgacctggttgggaccctcaacggcaaggaactccaggtgtccatgagcggaagatctatgggcagcatgaaatttaaggtcgagctcggggatatctcctataaactgtacacagaaaatgccgacatttctatcagcggagagtgcggcgggtgtattaactgcgctgaggccatctcctgtgcgcttgaaattgattctagcaccgaggtgctgtgcaagctcgaatgttcctgccagccctacatccaaaatattctgatcaagcctcaggtgaaaaagtattctttcaaagctacatgttttgagaagcgcaacagcctggaagtcaccgtttgcaaaaagcagcacacgatcccgcttacaattaagtcctacaatcagaaaatcgacctgagcagactcgatgagtctaactatgtgcgggaggaagacctgacctgcaacacctggctctgtaaggtggagaaagaaggaattggcgtcatgttctccgggctgttcgccggctttggaaagtactggagcatcgccatttatgctcttatcgccctggtgatcttcctgattctcatctacattctggttcccatctttcgccttattagaacattcctgatcaaaaatgaggtggagtataccacggaacaaaagatgcggtga

SEQ ID NO: 14350 - RNA, 4257 nt, synthetic construct
  misc_feature 1..4257: note = derived and/or modified CDS sequence (opt5) from OROV/MDDV(INHRR 17a-10)__KJ866390.1__GP
  source 1..4257: mol_type = other RNA
atggccttcctgctcatctacgtggtcctggctgccaccgttgcgagccaccccctttccaaccatcagattggcgacagatgctttgctgggggaaatctgatccgggagctcaacaagacagtgaatattggcgaactgtgtgtgcgcgatgacatctctatgattaaaagcacgaccgccatccaaaagtccgtcgggcacctttctacaagaaccaaattctatcgggtgtacatcgttaaggagtgggccgaatgcaaccctattatcgattttgctggaaatttcattatcatgaacattgacgagaatggccatctggtgccgaaaatgcacacatgtcgcgccagctgcgatatcagactcaacaaggacgatgctgaaattatcctgtcctctcagaagaccaatcattatgagatcattgggacaaccagcatctccggatggtttaaaaacacgattaatctgcccctcgagcacacctgtgaacacatcacagtcaactgcggccagaaaagcctgcggttccatgcctgttttcgcatgcacagaggctgcacccggttctttaaaaatacatacatgccttctaccatgattgagacgatgtgtgtgaaccttgaactgatcatcttcacactctatatcttttccgcggccgttttcgcttacgtgattaccaagagctatattgcctacatcctgcttcccgtcttttaccctattacatatatcctggggtctatctactcccgcttcaaacagtgcaagacctgtatgctcgctgcccatcccttcaccagctgccctaagaaatgcgtgtgtggatctagatttaattgcacagaggcgctgcgggtgcaccgcctgggcaaggactgtcaagggtataaatccctcagcaaggccagacagatgtgcaaatccaagtcttggagcttcattatcgctgtctttacgggactgattcttatggagttcatcaccccgatttccggcgaacggatgtacaaactgagcgagctcgccgaagagtttatcgaaatgaaggaggaggcttctgccctgaagaaagccattaacaaccttaagctgctcaatgttctgctgtccgctatcgcgacactcgtggtggtcatggaaacctgtatcttcaaaagcctgtttaaccttctgtatcgctcttgcagcatgtgtgggctcattcactacaagatcggactgagagtgaatcttctgacaaccaaccggtgcggcacgtgtatttgcggcttctccgagcagcagtctagcgggtttgaatatgagatcttcctcaaagatatgcataagcaaagagaatcctgtaagtactttcccatgctgaatcacttccgcaacgttaaaattctgacagtgtttctcctgcttaccatgctgaccgccagcgcttcttccgagtgcctccagaagcctctgaaaatcaagctggaggaccttcatgaatgcatcggagtcaatttcctcaaccggcagtgttacaatagccaggagctgtatcaatctctgaaatccaagaacctcgtgagcgaagttgataagaaatacttcgacaataagaacctggaggatctttttaaaagaattgaatatgcccaggacgcccaccgcatgatcctgctcgagcggattctgtactccacagagtgcgaaatgcataccatcctgacaaatggcggggcttataacattccctggagaacgtaccttaagaatcacaacctcaacctgtgtggaaaacacgtgcataagatggtctgccagtgtatcaatacccacacacaatgcctgtctaccggcatcgactatcaggatgagattacaaagttctaccaggccgacggggatagctaccgcgcggacctctccatcattctggaaaccatcgctacggcctttcggggaatgaccaaagtgcttattgagacatatatcgagcaggataactctgaaagcatgatcaagctgctcaataccattaaagagaaggtccctaacaattaccaaatgctgggcatcctgaacttcgccattaaaatcatgtccgtgaatcagacaagaggcgttcgcagcgctcggcataccattatctctaacgacattcccatgtccgaaacgtttacaaatttcgaggtgagcaacatcgatgtcaagcagtgtaccgacccgcttacactcaaatgctttaccaagagaggggatgcccctcactctaatcatctgctgtgtaaggaacagaacaaatataaggtgttcgagtggcccgagatcgaaaccgttatgaaaaataacaagctctgcctgggagacacacactgtaatcttaaatttgctgccattgcgtccgatgaggtgatcaagctgctcaactgcttcagcgacacgtacaagcctaaccccggcgaaatggaggtcgggaccaaaaagtgcaatgccgacaaaattggagaatgtatcacactggagaacaatccctggcctattgtgtattgcgagaccaagtactattactctgatgctaaagaacacgccaaggacggcaacgtgaatagctactgtctgacaaacaagtgcaatgaggatcgctttccgatcaaccccacctggttcaaatcctgtagctgggaccggaatgttaaggaaacgacaaccatcaaagagtttgtccataacgatatttctgcttatagaaagtcccttgaaagcgagatctccaccgacctcctgattcaccattaccggcctacaaagaatctgccccacatcatgcctgcctataagtctctcaccattcaagggagcgagacagtggatggcctgcagaactccttcatcgaaggagacatgcccgcgatctctggccttgccaatgggtaccacctgaagtataaaggaattgagctgttcgatatcgtgatttttatcaagaaagctgtctacaaggccaactattacaaaatttacacgaccggcccgagcgtggctatcaatatggaacataacgagcagtgcacagggtcctgtcctaagaaaattcccgccaaggagaactggctgaccttctctaaggaacacacaagctcctggggatgcgaggaatatggctgtctggccatcgacaccgggtgcctttacggcagctgtcaggatgttatccgccctgagattgacgtgtataaaaaggcttctgcggaacaatccctgatcgagctctgcattacgagcgcccatgagaccttttgcaatgatctggacatcctcgaacccattatcggagacaaaatctctgctgccttccagtccacacaggtcaaccagctgcctaatattatcgcctttaagaaaggccaaattttcaccggggctatcaacgatcttggaaatacaggcagccagtgtgggtctattcagctgatcaacaataccctcctgggagagggcaacgtgaagtttgactacatctgccacgccatgaagagaaaagatgttattgtgcggagatgttataatgaccatttcgcgtcctgcaacctgcttcaaaagcgcagcgatctggtcgggacactcaatggcaaagaactccaggtgtccatgagcggacggtctatgggcagcatgaagtttaaagttgagctcggggacatctcctacaagctgtataccgaaaacgctgatatttctatcagcggagagtgtggcgggtgcattaattgtgccgaggccatctcctgcgctcttgaaattgactctagcacggaggtgctgtgtaagctcgaatgctcctgtcagccctacatccagaacatcctgattaaaccgcaagtcaagaaatactctttcaaggccacatgctttgagaaaagaaatagcctggaagtgaccgtgtgcaagaagcagcacaccatccctcttacaattaaatcctataaccagaagatcgatctgagccgcctcgacgagtctaattacgtcagagaggaagatctgacctgtaacacgtggctctgcaaagttgagaaggaaggaattggcgtgatgttctccgggctgttcgcgggctttggaaaatattggagcatcgctatctacgcccttattgccctggtgatcttcctgattctcatctatattctggtccccatctttcggcttatccgcacattcctgattaagaacgaggtggagtacaccacagaacagaagatgagatga

SEQ ID NO: 14351 - RNA, 4257 nt, synthetic construct
  misc_feature 1..4257: note = derived and/or modified CDS sequence (opt5) from OROV/Perdoes virus(BeAn789726)__KP691625.1__GP
  source 1..4257: mol_type = other RNA
atgttcatccagtttaacctggccttcttttgcctcagcattgtgtgtggccaccccctgaccaaggaccatatcggggatagatgcttcgctggaggcaatctttttaaagagattacacaaacgaccgggctgtccgaaatctgtattaaggacgatatctctatcattaaaagccaggtcgagatcaagaaacagtcctctgaagttacatacgccgtgaagttctatcgggtgtacctcgtcaaggagtggagcgaatgcaaccctattcaggaccaacacggatccatcatgattctggatgtgaccaatacaggccttatcgttccgaaaatgtatacctgtcgcgcggcttgcgacattacactggataaggacaacgccgaggtggtctttatctctcagaaaaataacaattacgagctcgccgggaccacggtgatgcatggatggttcaagaacgttgtgagcatcaaactggaacacacctgtgagcatctgacagctacctgcggccagaagacagtcaagtttcacgcctgtttcagacagcaccgggcttgcgcccgctttctcaaaaccacgtatatgcccattgtgatggtggaatccctgtgtagcaatcttgagctggtcatcttcattacatacatctttgtttgcctcgcgttcgccttcattatcaccagaacatatgtggcttacctgcttatccctgtgttttaccccttcacctatgcctacggcaagatgtatctgaaatgcgtcaagacctgtcctaactgcctcctggctatgcatccctttacaaattgtacgaacctgtgcatttgtgggtctcggttctccaataccgagagcctcaaagtgcaccgcctgggaaactgctacggctataaggccctttctggggcgagatccatgtgtaaaagcaaggtttcttcctttacaaccgccatgttctttggaatcattatcctgagcttcattgctcctctcaatggcgaacggctgtacaaactttccgagctgccggatgaatatatcgagatggaatctacaatcgaggggagcaagcaaaaggagaccattgtggacatcattaactacacggccctcgtcctgatcctgattacaatcctcctgcagggcattcttgaaaactacatctttcgcctgaaattcagattttgctccttctgtgatatgatccatatgaagaaaaatctcaagatttttagcaacatgaccaataagtgcggaacctgtatctgcggcttcaaccaggagattcggtctgggttcgactatgaagtgtttatcaaagatatgcacgtttcccgcgagagctgcaagtacaattatcacaaaaactactctttctatattaagatgctgcttgtggtcctgctcgtgcccctgatcggaacaaccgctgccgaagacacaaaatgtctgaagtacgacctcaataagaacatcgaggatctgaaagactgctatggccttaagctgaatattgataaacatgacacggtcgagaacgcctacaagaatctcgtggatcagaaactggttagcgaactggacagacttgatctcaacatcatgctggggtccaaggagtctatttttgaagctatcgagaccagcatgaatattcaccaaatggtgttcctggaatacctcgcgtataagacagaccctaaactgtccgagatcaagcagaacaccggaccctacaatatcgcctggcggacatttattcatggcaacagccttgaggtctgtgggaactatccttacaaactgatctgctattgtattaatcagaagacccactgcgaaaactctacggtggattacggaatccaaattcagcccttctataatcagcatccgaactcctacaaaagcgacatggaggctctcatcaagaccgttcagatcgcctttcgcggcattatcaaagtgctgattcaatactatgtcgaaaataacaagacatctgagctgtccaatcttctcaccgagctgagaaacgtgatgggcaataacatccagatgaaggggattctgaaatacctcgaaacatatctgaagaaacctcttctgatggcccggaccatcagaattgctgccaaggtggatacgagcggagacccctacaataacttctccacatctaaagagaatatcaccaagtgtatcaagattcagaaactccgctgcatcacaaagctgacccggattgaacacaactatatcctgtgtggcgacagcgagaaaaagctgtaccagtggcctgcgaaacccaccattgttgatgacaatgatgcttgcctcggggacaagcactgtcatctgccctttatccctatcggaaacgatgaagccattaagacagtcaactgctatgtggaggtgtacgagcaaaatccgggcgacatgaactcctaccagaaaaagtgcgatgccatgaatgtcgggacgtgtctgaccatcaaaaacgaaaattggcccattgtgcagtgcaagacaggcaaatattactatgctgacggaagaatccacgccaaggatggcaccattaacacatactgtttctctgagaagtgcaatgctgaccgctatcctatccatcaggattacatcaacagctgtaattggcaagaaaccattaaagactttcagcacgttcgggagttcgtgcacctcgatatcgaatcctataagaaagccattgagagcgacatcaagacggacctggtcgtgcataaatttagacccgttaagaaccttcctcacgtgattcccatctacaaatctattacagtccaggggaccgagacctccgatggaatccagaatgcgttcatccaaggcagcatgccggccatttctgggctggctaacggataccatctcttcacacctgactccaagcagctgtttgatgtggttctgttccttcgcaaggccagctataaagctgaataccggaagatctattctaccggccccacaattgggatcaatgtggagcacaacgaaaaatgcacgggcagctgtcctaagaccattgacaaaaaggataattggctcacattttccaaggagcataccagccagtggggatgcgaagagtacggctgtctggccatcaacacagggtgcgtcttcggatcttgtcaagacatcattagacccgagatcgatgtgtataaaatgcacggcgcggaacgctccgtggtcgagctgtgcattaccctccctcacgaaacgtactgcaacgacctggatgttcttgagcccatcattggggacaagatccaggccgcttttcagaccgtgcagagcaatcatatgccgcggctgatggccatcaaaaacaataaggctttcacaggacaaattaacgatctcggctccaccgcctcttattgtgggagcgtgcagaaatttaatgagacaatcattggccagggagaccctaagttcgattacgtctgccaccttctgaagagaaaagacatcattgtgcgccggtgttactccaacaattatgaatcttgcaaacttctgacccccagagccgacatcattgttgataagaagggcgagagcctccaggcttccatcgtggggctgaacctcggacaaatgaattttaaaatcatgctgggcgacattaactacaagcagtatacagaatctaataaccttgaggcgaccgggcagtgtgtcggatgcgtggattgtagcgaagacatcgtttgcaatctgaagattgagtcccagagcgagtctgtgtgtaacatcaaatccgattgcaatctctacctgagctctatgctgattcaacccacggtcggcgaatataaccttaagatgtcctgtaatgccaaactggacaaggtgaacatcgagatctgcaaacagaagttcgttctccctctgacaattaagagccataaccagaaaatcgatctctctaagctggacgaatccaattacattcgggaggaagatcttaaatgcgacaccatgatctgtaaggtgaaagatgaggggctgagctttattaccaactccctcttcggcggaatcagctatttctggaagatcctgatttctagcctgatcgtcatttttcttatcattctgttctactacgtgggcctcccgatcctgcgcctcattaaagactatctgaaggagaatgaacttgagtacctggctgaagggaagtga

SEQ ID NO: 14352 - RNA, 4257 nt, synthetic construct
  misc_feature 1..4257: note = derived and/or modified CDS sequence (opt5) from OROV/Perdoes virus(BeAn790177)__KP691628.1__GP
  source 1..4257: mol_type = other RNA
atgttcatccagtttaacctggccttcttttgcctcagcattgtgtgtggccaccccctgaccaaggaccatatcggggatagatgcttcgctggaggcaatctttttaaagagattacacaaacgaccgggctgtccgaaatctgtattaaggacgatatctctatcattaaaagccaggtcgagatcaagaaacagtcctctgaagttacatacgccgtgaagttctatcgggtgtacctcgtcaaggagtggagcgaatgcaaccctattcaggaccaacacggatccatcatgattctggatgtgaccaatacaggccttatcgttccgaaaatgtatacctgtcgcgcggcttgcgacattacactggataaggacaacgccgaggtggtctttatctctcagaaaaataacaattacgagctcgccgggaccacggtgatgcatggatggttcaagaacgttgtgagcatcaaactggaacacacctgtgagcatctgacagctacctgcggccagaagacagtcaagtttcacgcctgtttcagacagcaccgggcttgcgcccgctttctcaaaaccacgtatatgcccattgtgatggtggaatccctgtgtagcaatcttgagctggtcatcttcattacatacatctttgtttgcctcgcgttcgccttcattatcaccagaacatatgtggcttacctgcttatccctgtgttttaccccttcacctatgcctacggcaagatgtatctgaaatgcgtcaagacctgtcctaactgcctcctggctatgcatccctttacaaattgtacgaacctgtgcatttgtgggtctcggttctccaataccgagagcctcaaagtgcaccgcctgggaaactgctacggctataaggccctttctggggcgagatccatgtgtaaaagcaaggtttcttcctttacaaccgccatgttctttggaatcattatcctgagcttcattgctcctctcaatggcgaacggctgtacaaactttccgagctgccggatgaatatatcgagatggaatctacaatcgaggggagcaaacaaaaggagaccattgtggacatcattaactacacggccctcgtcctgatcctgattacaatcctcctgcagggcattcttgaaaactacatctttcgcctgaaattcagattttgctccttctgtgatatgatccatatgaagaaaaatctcaagatttttagcaacatgaccaataagtgcggaacctgtatctgcggcttcaaccaggagattcggtctgggttcgactatgaagtgtttatcaaagatatgcacgtttcccgcgagagctgcaagtacaattatcacaaaaactactctttctatattaagatgctgcttgtggtcctgctcgtgcccctgatcggaacaaccgctgccgaagacacaaaatgtctgaagtacgacctcaataagaacatcgaggatctgaaagactgctatggccttaagctgaatattgataaacatgacacggtcgagaacgcctacaagaatctcgtggatcagaaactggttagcgaactggacagacttgatctcaacatcatgctggggtccaaggagtctatttttgaagctatcgagaccagcatgaatattcaccaaatggtgttcctggaatacctcgcgtataagacagaccctaaactgtccgagatcaagcagaacaccggaccctacaatatcgcctggcggacatttattcatggcaacagccttgaggtctgtgggaactatccttacaaactgatctgctattgtattaagcagaaaacccactgcgaaaattctacggtggattacggaatccaaattcagcccttctataaccagcatcctaattcctacaagagcgacatggaggctctcatcaaaaccgttcagatcgcctttcgcggcattatcaaggtgctgattcaatactatgtcgaaaacaataagacatctgagctgtccaaccttctcaccgagctgagaaatgtgatgggcaacaatatccagatgaaagggattctgaagtacctcgaaacatatctgaaaaagccgcttctgatggcccggaccatcagaattgctgccaaagtggatacgagcggagacccctacaacaatttctccacatctaaggagaacatcaccaagtgtatcaaaattcagaagctccgctgcatcacaaaactgacccggattgaacacaattatatcctgtgtggcgacagcgagaagaaactttaccagtggcctgcgaagcccaccattgttgatgacaacgatgcttgcctcggggacaagcactgtcatctgccctttatccctatcggaaatgatgaagccattaaaacagtcaactgctatgtggaggtgtacgagcaaaacccgggcgacatgaactcctaccagaagaaatgcgatgccatgaatgtcgggacgtgtctgaccatcaagaatgaaaactggcccattgtgcagtgcaaaacaggcaagtattactatgctgacggaagaatccacgccaaggatggcaccattaatacatactgtttctctgagaaatgcaacgctgaccgctatcctatccatcaggattacatcaatagctgtaactggcaagaaaccattaaggactttcagcacgttcgggagttcgtgcacctcgatatcgaatcctataaaaaggccattgagagcgacatcaaaacggacctggtcgtgcataagtttagacccgttaaaaatcttcctcacgtgattcccatctacaagtctattacagtccaggggaccgagacctccgatggaatccagaacgcgttcatccaaggcagcatgccggccatttctgggctggctaatggataccatctcttcacacctgactccaagcagctgtttgatgtggttctgttccttcgcaaagccagctataaggctgaataccggaaaatctattctaccggccccacaattgggatcaacgtggagcacaatgaaaagtgcacgggcagctgtcctaaaaccattgacaagaaggataactggctcacattttccaaagagcataccagccagtggggatgcgaagagtacggctgtctggccatcaatacagggtgcgtcttcggatcttgtcaagacatcattagacccgagatcgatgtgtataagatgcacggcgcggaacgctccgtggtcgagctgtgcattaccctccctcacgaaacgtactgcaacgacctggatgttcttgagcccatcattggggacaaaatccaggccgcttttcagaccgtgcagagcaaccatatgccgcggctgatggccatcaagaataacaaggctttcacaggacaaattaatgatctcggctccaccgcctcttattgtgggagcgtgcagaagtttaacgagacaatcattggccagggagaccctaagttcgattacgtctgccatctgctgaaaagaaaggacatcattgtgcgccggtgttactccaataactatgaatcttgcaaacttctgacccccagagccgacatcattgttgataagaaaggcgagagcctccaggcttccatcgtggggctgaatctcggacaaatgaactttaagatcatgctgggcgacattaattacaagcagtatacagaatctaacaatcttgaggcgaccgggcagtgtgtcggatgcgtggattgtagcgaagacatcgtttgcaacctgaaaattgagtcccagagcgagtctgtgtgtaatatcaagtccgattgcaacctctacctgagctctatgctgattcaacccacggtcggcgaatataatcttaaaatgtcctgtaacgccaagctggacaaagtgaatatcgagatctgcaagcagaagttcgttctccctctgacaattaaaagccacaaccagaagatcgatctctctaaactggacgaatccaactacattcgggaggaagatcttaagtgcgacaccatgatctgtaaagtgaaggatgaggggctgagctttattaccaattccctcttcggcggaatcagctatttctggaaaatcctgatttctagcctgatcgtcatttttcttatcattctgttctactacgtgggcctcccgatcctgcgcctcattaaggactatctgaaggagaacgaacttgagtacctggctgaagggaaatga

SEQ ID NO: 14353 - RNA, 4284 nt, synthetic construct
  misc_feature 1..4284: note = derived and/or modified CDS sequence (opt5) from OROV/UTIV(BeAn84785)__KF697155.1__GP
  source 1..4284: mol_type = other RNA
atgttcctgatctttattctcatccagattgccgctagcacacccctgtcccctcaacaggtgggcgacagatgcttcatcgggggatctcttattaaggagatcaaccagagcaccggcctgggggaagtctgtatcaaagatgacatttccatcattaagtctatcaatattcagaaaaagatcagcaacgatcaagttcagaatacggtgaaattttacaagacctatattgcccgggagtggcacgactgcaacccgatcttcgatgaacatggatcctttatggtgttcgacatctctaatacaggcagcattatccccaagatgcacacctgtcgcgcgcagtgcgagattacactcaacaaagataatgctgaagtcatctttacctccgccaagacaaaccattacgaggtgagcgggaccacgaccgttaatggatggttcaaacagacaatttctgtgtccctggagcacacctgtgaacatatcatcgccagctgcggccaaaagtctcttaaatttcacgcttgtttcagacagcaccggtcctgcgtccgctttttcagaaacagctatctgccttacaagatgattgagtctctctgtatcaatattgaactgatcattatcctgtgctatgccctcctgtgttttatcttcgcttacattatcacaaagacctatattgcctaccttctgatccccctcttctaccctattacgtatatctacggcaaaatttataacaagtactttaaacggtgcaagtcctgcctgcttgcggtgcatcccctgacaaattgtaacaaaacctgcgtttgtgggtgccgcttcaatagcacagaggccctcaaggtgcacagactgggaaaagactgtaacggctttaaggctctgtccaaggcccggttcctctgcaaatctaccgggcctagctttaccatctgtttcctgacaggaatgcttatcctgtcctttattacgccgatcaacagcgagaagctctataaactggaagaacttcccgatgactacattaatctggaaaaccagctctctgagtgcaataacaataagcagatcacccgcgctctggccgtcgcgtgtattctgggcaacatcctcttcgtgctgtttttcaaatttatctataataaacttattaacaatatctacagaacatgcaacctgtgtaatatggtgcatcaccggaagaacctcaaaatttactccgaatttaccaataagtgcgggacatgcgtctgtggatttaacgaggagatccgcagcggcttcgattatgaagttttcattaaagacatgcacatctttagagataattgcctgttcaagttttactctaaatatagcatcatttacatctgtattatcattcttgtgatcaacctgcaactcggcatgaccctggccgaggaaacggagacaaactgcctgaatctccctatctccgctcagaccctggacattgtgaagtgttatgggcttaacctgaatatcaccgaaaacaagcagaaatctgacctcattagcgagctgaagtcccaaaagacaatcaccgatcatgacattcccgatttcaatatcattgacatgaagacagagagcgcctttgagaaaatcgagacggctgaaaacatccaccggatggccttcctggagtacattctttataagatggaatctaagctcaataccatcaaaacaaactccggaccttacaatgtcgcctggcgcacctacattaagtatcataacctggatgcttgcggcaaatacccccacaagacaatctgtacctgcattaatgcgcatctgagctgttctcagccgacggtggactccaacagcgagatcaaaaccttttattccaatcaccagtctgccttcaagaacgatatcaatgttctcattgagacaatcagcattgcttttagagggatcattaaagtgtccatcaacctgcttctgaagaacaataagatcgacgaactcaaagagctgctgaccaacatttctaagaaacttgatacaaatatccagatgaagggcattctcctgttcaccgccgaacaactgaaaacgcaggagacaaccgtcaagagcatgcagcagacacggatggccatcattgtgaagcctctcgagtccatgaccggagacaaatttgataacttcagcaccacaaatagaaacatcacgaagtgcaaagaagctaagtctctgtcctgttacatgacccgcaaaaatagcattaacaagtatcttctgtgcaatctcgacgggtacaagatcttttcttggcccgagaaacctacactgtccatcaacaataacatttgcatcggagacagccactgtaatctgtatttcaagcccattcttaacgatgaagccatcaaaaccattaattgctacaagggcgacttcacacccaaccctatggatatgggctctgcgatcaaaaagtgtgaggctaaggaaatcggggactgcctcgttggagataacaatatgtggccgattatccaatgtagcaacgagaaatactattacgccgacggcaagaatcatgccaaagagggggatattaactcctattgcctgagcgaaaagtgtaataccgaccggtttcccatccacaacgagtggttcaaatcttgcaagtggatttccacgatcaaagaaagcatctccgtgaaggagtttgtccatctggatattgaatcttacaagaaaggaatcgagagcgacattagaacagatctcatcattcacaagttccgccctgtgaaaaatctgccccacatcgctcctaagtataaatccattaccatctctggcatccttgtcgccgacgggattcagaacgcttttgtgagcggcgagatgcccgccatctccggactgggcattgggtacaatctctattctccggatggaaccaagctgttcgacatcgttctgtttcttcggaaggcgatttacaaaagctcctacaagctcatctataaaacaggccctaccatcgggattaacgtggaacataatgagcagtgtacaggaagctgcccctctacgatccctaagcaggaaggctggctgaccttctccaaagagcacacaagccaatgggggtgtgaagagtttggctgcctggccattgacaccggatgcctctacggctcttgtcaggatatcattagacccgagatgtccatctataagatgctgggggaagagatgacaagcatcgaaatttgccttaccacgcctaaggagacctactgtaacgacctggatctcctggagcccctgatcggagacaaaattgaagtctctttccagacagtgcagtccagccatatgccgaagatcattgctgttaaaaataacaaggtgtataccggccaaatcaatgatattgggaacacagccaatatctgcggatccgtccagatcattaacaaaaccgtgatcggccaggggaaccctaagtttgactacctttgtcacgctatgaagcgcaaagatgtgattgttcggaagtgctatgacaatcatttcgagacatgtaaactgctcgaagagagaagcgaaatcctgattaaccaacagtctgataccatcgccgcgagcatgtccggcaagaatctcggaatcatgaacttcaaatttgccctgggcgacattgattacaagacgttcacagaggacgcttcttttgatatcaaggggcagtgcgtcggatgtattaattgcatcgaggaaattgtgtgtgagcttaacatcgtgagcacctcctctatcctgtgcaccattaaaacaccctgcgaaaattaccacaacagcctcgagatcaatcccgccaccacgaagtatcacattaaaatgtcctgtcctcataacatcgacaagatgaaaattacaatctgctctaaggacctggaaatgccgctgacccttaaacagcacgatcaaaagattgacctgagcaagctcgatgagtccaattacatcaaagaggaagacctgcgctgtagcacatggctctgcaaggtcaaagaggaaggcatcgggttcattttctctggaatcttcggcaactttgggaagtattggaccattttcctgatcgtgcttgttattctggctacaggcctcctgggaatctttgtgatctacccctgttgcaaacggctgagaggcttccttgagattaatgatatcgcctatctggccgaacagaagatgaagtga

SEQ ID NO: 14354 - RNA, 3231 nt, synthetic construct
  misc_feature 1..3231: note = derived and/or modified CDS sequence (opt5) from HRTV(TN)__KJ740147.1__GP
  source 1..3231: mol_type = other RNA
atgatcgtgcccattgtcctgttcctcaccctgtgccctagcgagctttccgcctggggctctccgggggaccccatcgtttgtggagtgagaacagaaacgaacaagagcattcagatcgagtggaaagaaggccggtccgagaagctgtgccaaattgatcgcctcgggcacgtgacctcttggctgagaaatcatagctcctttcagggacttgtcggccaggtgaaagggcggccttctgttagctacttccccgaaggagcttcctatcctcgctggagcggcctgctctctccctgtgacgccgagtggctgggcatgatcgcggtgtccaaggctggggatacagacatgatcgtccctggaccgacctacaaaggcaagatttttgtggagagacccacatataacgggtacaagggatggggctgcgccgatgggaaaagcctgtctcactccggaacctattgtgaaacagacagctctgtttccagcggcctcatccagggcgatcgggtgctgtgggtcggggaggtggtgtgccaacgcggaacccctgtccccgaagacgttttctccgagcttgtgtctctgagccagtccgagtttcctgatgtgtgtaagattgacggcgtcgccctcaatcagtgcgaacaggagagcatcccccaaccgctggatgtggcttggattgacgttgggagatctcataaagtgcttatgcgggaacacaagacgaaatgggtccaggagtccagcgccaaggatttcgtgtgttttaaggttggacagggcccttgctctaaacaggaagaggacgactgtatgagcaaggggaactgccatggagatgaggtgttctgccgcatggctggctgttccgccagaatgcaagacaatcaggaaggctgccggtgtgagctgctccagaaacccggggaaatcattgtcaactacggaggcgtgtctgtccgccctacctgctatgggtttagcagaatgatggcgacactggaggtgcacaagcccgatcgggaactgaccggatgtacaggctgccacctcgagtgtatcgaagggggcgttaaaatcgtgaccctgacgtccgagcttcgcagcgccacagtctgcgcttctcatttctgtgcctccgctaagggaggcagcaaaaccacagacattctgtttcacaccggggccctcgtgggacccaattctatcagaattaccggccaactgcttgatgggtccaagttcagctttgacggacattgcatcttccctgatggctgtatggcgctggactgcacattctgcaaggagtttctccggaacccgcagtgttaccccgttaaaaagtggctgttcctggtggtcgtgattatgtgctgttactgcgccctcatgctgcttacgaatatcctgagagctatcggggtgtggggcacctgggtttttgcccctattaaactcgctctggcccttggactgcgcctcgccaagctgtccaaaaagggcctggtcgctgtggtgacacgggggcagatgatcgtcaacgatgaactccaccagattagagtggagcgcggagaacaaaatgagggccggcaggggtatggacccagaggccctatccgccactggctgtactctcccgcgcttattctgatcctcaccacaagcatctgttccgggtgcgacgagctggttcatgccgaatctaagagcattacctgtaaatccgctagcggcaacgagaaggaatgctctgtgacgggacgggccctgcttccggccgtcaatcctggccaggaggcttgtctccacttctccatgcccgggagccctgattctaaatgcctgaagatcaaagtgaagtccattaacctgagatgtaagcaggccagctcttattacgttcccgaggcgaaagctcgctgcacaagcgtgcggagatgccgctgggccggagactgtcaatccggctgccctacctattttagctctaattccttcagcgacgattgggccaaccggatggacagagctgggctcggaatgtccggctgttctgatgggtgcggcggagccgcttgtggctgctttaacgccgcgcccagctgtatcttctggcggaagtgggtcgaaaatccgtccaaccgcgtgtggaaagtttctccttgcgccagctgggtgctggctgccaccattgagcttacactgccctccggggaagtcaagaccctcgagcccgtgacaggacaggctacgcagatgtttaaaggcgtggccatcacctacctggggtctagcattgaaatcgtcggaatgacaagactgtgtgagatgaaggagatgggcaccggcatcatggcgcttgccccttgcaatgacccggggcatgctattatgggaaacgttggcgaaatccagtgttccagcattgagtctgccaagcacatccggtccgatgggtgcatttggaatgctgacctcgtgggaatcgaactgagagtggatgacgccgtctgcttcagcaaactgacatctgtggaggccgttgctaacttttccaagatccccgcgaccattagcggcgtgcgcttcgatcaagggaatcatggagaatctcggatctatggctcccctctcgacattacgagagtcagcggcgagttttccgtgagcttccgcgggatgagactgaaactttctgagatcagcgcctcctgtaccggagaaattacaaacgtttctggctgctacagctgtatgaccggggcttccgtgtctatcaagctgcacagctccaaaaatacaaccggacacctcaagtgcgattctgacgagacggccttcagcgtcatggaaggcacacatacctaccggccccacatgtcctttgataaagccgtgatcgacgaggaatgtgttctgaactgcgggggacatagctctaagctgcttctcaagggctccctggtgttcatggacgtccctcgctttgtggatggcagctatgtgcagacataccactctaaagtccccgctgggggaagagttcctaatcccgtggactggctgaacgccctcttcggcgatgggattacccggtggatcctgggaattatcggcgtgcttctggcgtgtgtcatgctctttgtggttgtggtcgctattacccgcagactgatcaaggggctgacacagcgggccaaagtggcctga

SEQ ID NO: 14355 - RNA, 3231 nt, synthetic construct
  misc_feature 1..3231: note = derived and/or modified CDS sequence (opt5) from HRTV(Patient2)__JX005844.1__GP
  source 1..3231: mol_type = other RNA
atgatcgtgcccattgtcctgttcctcaccctgtgccctagcgagctttccgcctggggctctccgggggaccccatcgtttgtggagtgagaacagaaacgaacaagagcattcagatcgagtggaaagaaggccggtccgagaagctgtgccaaattgatcgcctcgggcacgtgacctcttggctgagaaatcatagctcctttcagggacttatcggccaggtcaaagggcggccttctgtgagctacttccccgaaggagcttcctatcctcgctggagcggcctgctctctccctgtgacgccgagtggctgggcctgatcgcggtttccaaggctggggatacagacatgattgtgcctggaccgacctacaaaggcaagatctttgtcgagagacccacatataacgggtacaagggatggggctgcgccgatgggaaaagcctctctcactccggaacctattgtgaaacagacagctctgtgtccagcggcctgattcagggcgatcgggttctttgggtgggggaggtcgtgtgccaacgcggaacccctgtgcccgaagacgtcttctccgagctggtttctctcagccagtccgagtttcctgatgtgtgtaagatcgacggcgtggccctgaatcagtgcgaacaggagagcattccccaaccgcttgatgtcgcttggatcgacgtggggagatctcataaagttctgatgcgggaacacaagacgaaatgggtgcaggagtccagcgccaaggatttcgtctgttttaaggtgggacagggcccttgctctaaacaggaagaggacgactgtatgagcaaggggaactgccatggagatgaggttttctgccgcatggctggctgttccgccagaatgcaagacaatcaggaaggctgccggtgtgagctcctgcagaaacccggggaaattatcgtgaactacggaggcgtctctgtgcgccctacctgctatgggtttagcagaatgatggcgacactggaggtccacaagcccgatcgggaactcaccggatgtacaggctgccacctggagtgtatcgaagggggcgtgaaaattgttacccttacgtccgagctgcgcagcgccacagtgtgcgcttctcatttctgtgcctccgctaagggaggcagcaaaaccacagacatcctctttcacaccggggccctggtcggacccaattctattagaatcaccggccaacttctggatgggtccaagttcagctttgacggacattgcattttccctgatggctgtatggcgctcgactgcacattctgcaaggagtttctgcggaacccgcagtgttaccccgtgaaaaagtggctgttcctcgttgtggtcatcatgtgctgttactgcgccctgatgcttctgacgaatatcctcagagctattggggtgtggggcacctgggtgtttgcccctatcaaactggctcttgccctgggactccgcctggccaagctgtccaaaaagggcctcgttgctgtcgtgacacgggggcagatgattgtgaacgatgaactgcaccaggtcagagtggagcgcggagaacaaaatgagggccggcaggggtatggacccagaggccctatccgccactggctttactctcccgcgctgattctcatcctgaccacaagcatctgttccgggtgcgacgagctggttcatgccgaatctaagagcattacctgtaaatccgctagcggcaacgagaaggaatgctctgtgacgggacgggcccttctcccggccgtcaatcctggccaggaggcttgtctgcacttctccgtgcccgggagccctgattctaaatgcctgaagatcaaagttaagtccattaacctcagatgtaagcaggccagctcttattacgtgcccgaggcgaaagctcgctgcacaagcgtccggagatgccgctgggccggagactgtcaatccggctgccctacctattttagctctaattccttcagcgacgattgggccaaccggatggacagagctgggctgggaatgtccggctgttctgatgggtgcggcggagccgcttgtggctgctttaacgccgcgcccagctgtatcttctggcggaagtgggtggaaaatccgtccaaccgcgtttggaaagtgtctccttgcgccagctgggtccttgctgccaccattgagctgacactcccctccggggaagtgaagaccctggagcccgtgacaggacaggctacgcagatgtttaaaggcgtcgccatcacctacctggggtctagcattgaaatcgttggaatgacaagactttgtgagatgaaggagatgggcaccggcatcatggcgctcgccccttgcaatgacccggggcatgctattatgggaaacgtgggcgaaatccagtgttccagcattgagtctgccaagcacatccggtccgatgggtgcatttggaatgctgacctggtgggaatcgaactgagagtcgatgacgccgtgtgcttcagcaaactcacatctgttgaggccgtggctaacttttccaagatccccgcgaccattagcggcgtccgcttcgatcaagggaatcatggagaatctcggatctatggctcccctctggacattacgagagtgagcggcgagttttccgttagcttccgcgggatgagacttaaactgtctgagatcagcgcctcctgtaccggagaaattacaaacgtgtctggctgctacagctgtatgaccggggcttccgtctctatcaagctccacagctccaaaaatacaaccggacacctgaagtgcgattctgacgagacggccttcagcgtgatggaaggcacacatacctaccggccccacatgtcctttgataaagccgttatcgacgaggaatgtgtgctgaactgcgggggacatagctctaaacttctcctgaagggctccctggtcttcatggacgtgcctcgctttgtggatggcagctatgtccagacataccactctaaggttcccgctgggggaagagtgcctaatcccgtggactggctcaacgccctgttcggcgatgggattacccggtggatccttggaattatcggcgtcctgctcgcgtgtgtgatgctgtttgttgtggtcgtggctattacccgcagactgatcaaggggcttacacagcgggccaaagttgcctga

SEQ ID NO: 14356 - RNA, 3231 nt, synthetic construct
  misc_feature 1..3231: note = derived and/or modified CDS sequence (opt5) from HRTV(Patient1)__JX005845.1__GP
  source 1..3231: mol_type = other RNA
atgatcgcccccgtggtcctgttctttaccctctgccctagccagctgtccgcttggggctctccgggggaccccattgtttgtggagtgagaacagagacgaacaagagcatccaaattgaatggaaagagggccggtccgaaaaactttgccagatcgatcgcctggggcacgtgacctcttggctcagaaatcatagctccttccagggactgattggccaggtcaaggggcggccttctgtgagctactttcccgagggagcctcctatcctcgctggagcggccttctgtctccctgtgacgcggaatggctcggcctgatcgctgtttccaaggccggggatacagacatgatcgtgcctggaccgacctacaaaggcaagattttcgtcgagagacccacatataacgggtacaagggatggggctgcgccgatgggaaaagcctgtctcactccggaacctattgtgagacagacagctctgtgtccagcggcctcatccaaggcgatcgggttctgtgggtgggggaagtcgtgtgccagcgcggaacccctgtgcccgaggacgtcttttccgaacttatttctctgagccagtccgagttccctgatgtttgtaaggtggacggcgtggctctcaatcagtgcgagcaagaaagcatcccccagccgctggatgtcgcctggattgacgtggggagatctcataaagttcttatgcgggagcacaagacgaaatgggtgcaggaatccagcgctaaggattttgtctgtttcaaggtgggacagggcccttgctctaaacaagaggaagacgactgtatgagcaaggggaactgccatggagatgaggttttctgccgcatggccggctgttccgcgagaatgcaggacaatcaggagggctgccggtgtgaactgctccaaaaacccggggagatcattgtgaactacggaggcgtctctgtgcgccctacctgctatgggttcagcagaatgatggccacactggaagtccacaagcccgatcgggagctgaccggatgtacaggctgccacctcgaatgtatcgaagggggcgtgaaaatcgttaccctgacgtccgagcttcgcagcgctacagtgtgcgcctctcatttttgtgcttccgccaagggaggcagcaaaaccacagacattctgttccacaccggggcgctcgtcggacccaagtctatcagaattaccggccagctgcttgatgggtccaagtttagcttcgacggacattgcatcttccctgatggctgtatggccctggactgcacattttgcaaagaatttctccggaatccgcagtgttaccccgtgaagaaatggctgtttctggttgtggtcgtgatgtgctgttactgcgctctcatgctgcttacgaacattctgagagccatcggggtgtggggcacctgggttttcgctcctatcaagctcgtcctggcccttggactgcgcctcgccaaactgtccaagaagggcctggtggctgtggtcacacgggggcagatgattgtgaatgatgagctccaccaaatcagagttgaacgcggagagcagaacgaaggccggctggggcacggacccagaggccctgtgcgccattggctttattctcccgcgctgattctcatcctgaccacaagcatttgttccgggtgcgacgagctggtccacgccgagtctaaaagcatcacctgtaagtccgctagcggcaatgaaaaagagtgctctgtgacgggacgggcccttctcccggccgttaaccctggccaggaggcttgtctgcatttttccatgcccgggagccctgattctaagtgcctgaaaatcaaggtgaagtccattaatctcagatgtaaacaggccagctcttactatgtccccgaggcgaaggctcgctgcacaagcgtgcggagatgccgctgggccggagactgtcaatccggctgccctacctacttcagctctaactcctttagcgacgattgggccaatcggatggacagagctgggctgggaatgtccggctgttctgatgggtgcggcggagccgcttgtggctgcttcaacgccgcgcccagctgtatcttttggcggaaatgggttgagaacccgtccaatcgcgtgtggaaggtctctccttgcgccagctgggtgcttgctgccattatcgaactgaccctcccctccggggaggtgaaaacactggaacccgtcaccggacaggctacacagatgttcaagggcgttgccattacgtatctggggtctagcatcgagattgtgggaatgaccagactttgtgaaatgaaggagatgggcacaggcatcatggcgctcgccccttgcaacgacccggggcacgctatcatgggaaatgtgggcgagattcagtgttccagcatcgaatctgccaaacatattcggtccgatgggtgcatctggaacgctgacctggtcggaattgagctgagagtggatgacgccgtttgctttagcaagctcacctctgtggaagccgtcgctaatttctccaaaatccccgcgatcattagcggcgtgcgctttgatcaagggaaccacggagagtctcggatctacggctcccctctggacattacaaaggttagcggcgagttctccgtgagcttcagagggatgcgccttaaactgtctgaaatcagcgcctcctgtaccggagagattacgaatgtctctggctgctatagctgtatgaccggggcttccgtgtctatcaagctccacagctccaaaaacacaaccggacatctgaagtgcgattctgacgaaacagcctttagcgttatggagggcacccacacgtacagaccccatatgtccttcgataaggccgtggtcgacgaagagtgtgtgctgaattgcgggggacacagctctaaacttctcctgaagggctccctggtgtttatggacgtccctcggttcgttgatggcagctacgtgcagacatatcactctaaagtgcccgctgggggacgcgtccctaaccccgtggactggctcaatgccctgtttggcgatgggatcaccagatggattcttggaatcattggcgttctgctcgcgtgtgtgctgctgttcgtcgtggttgtggctatcacacggcgccttattaaggggctcacccagagagccaaagtcgcctga

SEQ ID NO: 14357 - RNA, 3942 nt, synthetic construct
  misc_feature 1..3942: note = derived and/or modified CDS sequence (opt5) from PTV(PAN472868)__NC_027201.1__GP
  source 1..3942: mol_type = other RNA
atgatcttcaccattctgaacgtgctcacaagagccatgctggtcatgagcatgtactcccttacgacctgggactctacaagccggaatgatatgtgcttttccaacgactctcccctggagggcctcgtttattactgggaaacccacagcaagaaacatgattataagaaacaggagtcccaacgctgtagagtgggggactctgataagaaaatgatcacaaatgtgaccattatcagcctgatttccgaaatccaaaagagcatctctgagctttccctgagctgcggaaacgacgataattctacaggccaggtcctcaccttcaacgggctggaagacacgattcagggagattacatcgtggactgtgttaccggcctgtatcagtccgatattggggtgggagtcggcctcggcaagacacaccatgaccaccaacaggtgaaaaataaggctgttgtgatcgatgagaaagagcggatgattagctttctggaaacccagcagtctgagaacgacatcaagatgcaggtccttatgtccgaaattgagcagctgaaaaatcagctcagcaagaagcgcaacgagagagggcaagaaaaacgggacgccgagaaggtgatgtccgatctgatggcgcgcaattctgaccttagaaaacataacgatatcctgacagctgaaatcagccagatggagaataacaataccattcagcggaacaagaacgtgatgtccacgacagtcgttcctgccatcctcagcgtggccctgctgtcttccagcattgctccgatcatggccgcttctcccgacagccctatgattaatccctggcctcacgccaaaaaccgcgtgggaaccggcatgtacaagtatgatgaaaatgacgattccgggtgcagacccatccggtacggagtctcttgtatcggcttcgactttatgctcaaaatggataagtaccctttctttaacgcgttcattgggcacaagacaccgctggagagctttgccgacaaaatcattgagaaggaagaggaaacctgcgagatcggaaccaataaagaatttaagtgtttcgaggagcgcgcttatattaaaggcacatgccccacgaacatcaatgccgtgcattacatcgataacaagggcaaacttagatatgttaagtgtaaggaaaatctggagatgaccgaagactgcgctttctgtcggaaaattaagaaaaaggccgggcaatccatccaggtgcagaagacaagcgtccctctccaggacgcgatttgccaagagaactctgatacctactccggacccaaaatcccttttaagggcgtgtgcaaaattgggctgatcaagtataaagaatgtaagttcaagacaagctcttacgagaccgtttccttcattacgcttaaagagaagggaaaaatctatatcgaacacctgatgctcaagaatattgaggtggtcacaaacgtgagctttgtctgctacgaacatgccggccaggacgagcaggaggtggaacaccgcgctctgaaaagagtttccgtgaatgattgtaagatcgtcgacaactctaaacagaagatttgcaccggggatcacatcttctgtgagaagtacgactgcagcacctcctatcccgatgtgacatgtattcatgccccgggatctggccctctgtacatcaatctcatgggcagctggatcaaaccccaatgcgttgggtatgaacgggtgctggtcgacagagaggtgaagcagcctcttctggctcccgaacagaactgtgatacctgcgtgtccgagtgtctcgacgagggagttcacattaaaagcacaggctttgaaatcacgtctgccgtcgcctgctcccatgggagctgcatttctgctcaccaggaggcgtccaccagcgtgatcgtgccctaccctggactgcttgcctctgtcggcgggcgcattggcatccatctgagccacacatccgatagcgcttctgtgcacatggttgtggtctgtccgccccgggactcctgcgccgcccataactgtctcctgtgctatcacggaatcctgaattaccaatgtcatagcaccctctccgctattctgacatctttccttctgatcctctttatttataccgtgttcagcgttacgaccaacatgctgtacgtgctgagacttatccctaagcagctcaaatcccccgtcggctggctgcgcctgtttattaattggctcctgacagcccttcggatcaagaccagaaacgtgatggggcgcatcaatcagcggattggatgggttgatcaccacgacgtggaaagacctcgccatcgggagcccatgagacgcttcaagacaaccctgctcctgacgctgatcatgatgacaggcgggaacgcgtgctctaataccgtcgtggctaacagcaaacagacacggtgtgtgcaagaaggatcctctaccaagtgcagcattaccgccacaatcacgcttagagccggcgtcattggggctgagtcctgttttatcattaaaggcccgatggagaatcagcagaagaccatcagcatcaaaacaatttcttccgaaaccgtttgccgggagggaagctctttctggacatccctctacatccctagctgtctgtcttcccgcagatgccacctggtgggcgactgcgtggggaacaagtgtcaaagctggcgggatgaccagctctccagagaatttagcggagtcaaggataatcatattatgaacgagaataaatgcttcgaacagtgtggcgccatcgggtgcggatgttttaacattaatccctcttgcctgtatgtgcacgcttaccttaagagcgcccgcaacgaggcggttcgggtgttctcctgttctgactgggtccatagagtgagcttcgaggttaaaggccctgatggggaaaccgagctggtgacgctcggctccctgggaacaaagtttctgaactggggcaccctttctctcagcctggacgccgaagggatctccggaaccaattctatcagcttcctggagtccagcaaaggcgggtttgctctctatgatgagggatactctgaaattccccgcgagggcttcctgggggaaatcagatgctccagcgagtctgccgctatttccgcccacaagagctgtatccgggcgcctggccttattaagtataaacccatgacagaccagatcgaatgcaccgcctccctggtcgatccgtttgctatcttcctcaagggatctctgcctcaaacacgcaacggccagacgtttaccagcacaaaagacaagaaaaccgtgcaggccttcacaaatggggctattaaggccctgctttccatcaacctcgatgaccacgagattgtttttatcaataaagtgagaagctgtgatgccaccttcctgaacgtctctggatgctactcctgcgactatggcgctcatgtgtgtgtgaaggtcaagagctctgagagcgcggactttttcgccgaatccgaggataaaacgaccgttctgtcttttcccattcagagcgggacacacgactactgccaagtgctccatttccagaagcccctggtggatgaacggctttcctactcttgtggaagcgagcctaaactgatcgtcattaagggcaccctcgtgtatatgggcgtttacgacttccgcaataaaacagggggatccagcaccgtggtcaacccgtctgaaggcgcttggtccatcagcaattggttttccgggctgctggattggcttggaggccccatgaaggccatcctgaagattctcgggttcatcgccattggaatcgtgtgctttattctgttcatgatcctcatcagaattgctgttaactctatcaatattaaaaagaaaaactga

SEQ ID NO: 14358 - RNA, 3942 nt, synthetic construct
  misc_feature 1..3942: note = derived and/or modified CDS sequence (opt5) from PTV(Adames)__KR912209.1__GP
  source 1..3942: mol_type = other RNA
atgatcttcaccattctgaacgtgctcacaagagccatgctggtcatgagcatgtactcccttacgacctgggactctagctcccggaatgatatctgcttttctaacgacagccccctggagggcctcgtttattactgggaaacacactccaagaaacatgattataagaaacaggggtctcaaaagtgtcgcgtgggagacagcgataaaaagatgatttccaatgtgaccatcattagcctgatctctgagatccagaagtccattagcgaactttctctgtcctgcggcaacaatgacaacagcacagggcaggtcctcaccttcaatggactggaggatacaatcagaggcgactacattgtggattgtgttaccgggctgtatcagtctgacatcggagtgggcgtcggcctcgggcggattaaccacgatcatcaacaggtgaaaaataaggctgttgtgatcgacgaaaaagagaagatgatttccctgcttgagacgcagcagagcgaaaacgatatcaaaacccaagtcctgatgtccgagatcgaacagctcaagaatcagctgtctaagcgcagaaacgagcggggacaggagaaacgcgacgccgaaaaacttatgagcgacctgatggcgagaaattccgatctccggaaccacaatgtgattctgacagacgagatcagccaaattaagaacaacatcaccattcatcgcaatagaaacatgatgtctacaaccgtggtccctgctatcctgtccgttgccctcctgagctctagcgtgggcccgatcacggccgctccccctgattccacaatgattaatccctggcctcacgccaagaaccgggtggggaccggaatgtacaaatatgacgaaaatgatgagtctggctgccgccccatcagatacggggtcagctgtattggatttgacttcatgcttaagatggataaataccctttcttcaacgcttttatcggccacaagacaccgctggaatccttcgccgacaagattatcgagaaagaggaagagacctgcgaaatcggcaccaataaggagtttaaatgtttcgaggaacgggcgtatattaaggggacatgccccacgaacatcaatgccgtgcattacattgataacaaaggaaagctccgctatgttaagtgtaaagagaatctggaaatgaccgaggactgcgctttttgtagaaagatcaaaaagaaagccggccagagcgtgcaggtccaaaagacatctgtgcctcttcaggatgctatttgccaggaaaactccgacatctacagcgggcccaagattcctttcaaaggagtttgcaagatcggcctgatcaaatataaggagtgtaaatttaagacctcttcctacgaaacaattagcttcatcaccctcaaggggaaaggaaagatttatatcgagcacctgatgctgaaaaatattgaggtggtcacgaacgtgtccttcgtctgctacgaacatgccggccaggacgagcaagaagtggagcaccgggcgctcaagagagtttctgtgaatgattgtaaaatcgtcgacaacagcaagcagaaaatctgcacaggcgatcacatcttttgtgagaagtacgactgctccacctcttatcccgatgtgacctgtattcatacaccggggagcggacctctgtacattaaccttatgggctcctggatcaagccccagtgcgttgggtatgaacgcgtgctggtcgaccgggaggtgaaacagcctctcctggtgcccgaacaaaattgtgatacctgcgttagcgagtgtcttgacgaaggagtccacattaagtctacaggcttcgagatcacgtccgccgtggcttgcagccatgggtcttgcatctccgcccaccaggaggctagcacctctgtgattatcccctaccctggcctgctcgccagcgtcggaggcagaattgggatccatctgtcccacacaagcgattctgcctccgtgcacatggttgtggtctgtccgccccgcgacagctgcgctgcgcataactgtctgctctgctatcacggcattctgaattaccagtgtcattccaccctttctgccatcctgaccagctttctcctgatcctgttcatttatacagctttttccgtgacgaccaacgttctttacgtgctccggctgatccctaaacagctgaagtctcccgtcggatggctcaaactgttcgtgaattggcttctgacagccctcagaattaagacccgccgggttatggggagaatcaaccaacgcattggatgggtggatcaccacgacgtcgaacggcctagacatcgcgagcccatgcggagatttaagacaaccctgctgcttacgctcatcatggtgacaggcgggaatgcctgcagcaacaccgtggtcgctaattccaaacagacacggtgtgttcaggaaggctctaacaccaagtgcagcattaccgccacaatcacgctgcgcgcgggagtgatcggcgctgagtcctgtttcattatcaaagggccgatggaaaatcagcaaaagaccattagcatcaaaacaatttcttccgagaccgtgtgcagagagggaagctctttttggacatccctgtacatccctagctgtctctcttcccggagatgccacctggtcggcgattgcgtggggaacaagtgtcagagctggcgcgacgaccagctttcccgggaatttagcggagttaaggataatcatatcatgaacgagaataaatgctttgaacaatgtggcgccattgggtgcggctgtttcaacatcaacccctcttgcctgtatgtgcacgcctacctcaagagcgctagaaatgaggccgtccgcgtgttttcctgttctgactgggttcatagagtgagcttcgaagtcaaaggacctgatggcgagatggagctggtgaccctggggtcccttggaacgaagttcctcaactggggcacactgtctctgagcctcgacgctgaagggatttccggaaccaattctatcagctttctggagtccagcaaaggcgggttcgccctttatgatgaaggctactctgagattccccgggagggatttctgggcgaaatccgctgctccagcgagtctgcggccatctccgctcacaagagctgtattagagcccctgggctcatcaagtataaacccatgaccgaccagattgaatgcacagcttccctggttgatccgttcgccatctttctgaagggatctcttcctcagacccggaacggccagacattcacgagcaccaaagacaagaaaacagtgcaagcgtttaccaatggggccattaaggctctcctgtccatcaacctggatgaccacgagattatcttcatcaataaagtcaagagctgtgatgccacatttctcaacgtgtctggatgctactcctgcgactatggcgctcatgtgtgtgtcaaggttaaaagctctgaaagcgccgatttctttgccgagtccgaggacaagaccacggtgctgtctttccccattcagagcggcacccgcgactactgccaggtgcttcactttcagaaacccctggtcgatgaaagactctcctactcttgtgggagcgagcctaagctgatcgtgattaaaggaacactggtttatatgggcgtgtacgacttccgggataagaccgggggatccagcacagtcatcaatccgtctgaaggcacctggtccattagcaactggttctccgggcttctggactggctcggaggccccatgaaggctatcctgaaaatcctcggctttattgcgatcgggattgtgtgcttcatcctgtttatgattcttatccgcatcgccgttaattctattaacatcaagaaaaagaattga

SEQ ID NO: 14359 - RNA, 3942 nt, synthetic construct
  misc_feature 1..3942: note = derived and/or modified CDS sequence (opt5) from PTV(Balliet)__KR912213.1__GP
  source 1..3942: mol_type = other RNA
atgatcttcaccattctgaacgtgctcacaagagccatgctggtcatgagcatgtactcccttacgacctgggactctacaagccggaatgatatgtgcttttccaacgactctcccctggagggcctcgtttattactgggaaacccacagcaagaaacatgattataagaaacaggagtcccaacgctgtagagtgggggactctgataagaaaatgatcacaaatgtgaccattatcagcctgatttccgaaatccaaaagagcatctctgagctttccctgagctgcggaaacgacgataattctacaggccaggtcctcaccttcaacgggctggaagacacgattcggggagattacatcgtggactgtgttaccggcctgtatcagtccgatattggggtgggagtcggcctcggccgcacacaccatgggcaccagcagatgaagaataaagctgtggttatcgacgagaaggagagaatgattagcctgcttgaaacccagcagtctgagaacgatatcaaaatgcaagtgctgatgtccgaaattgagcagctcaagaatcagctgagcaaaaagcggaacgagcgcggacaggaaaagagagacgccgagaaagtcatgtccgaccttatggcgcgcaattctgatctgcggaagcataacgacatcctcacagctgaaatcagccaaatgaaaaataagaacaccattcagagaaataaaaacacggtgtccacaaccgtggtccctgccatcctgagcgttgccctgctctcttccagcgtggctccgattatcgccgctccccctgattctcccatgattaacccttggccccacgccaagaatcgggtgggcacagggatgtacaaatatgacgagaacgatgacagcggatgccgccctatcagatacggcgtctcctgtatcgggtttgatttcatgctgaagatggacaagtacccgtttttcaatgcgtttattggacacaaaacaccccttgaatctttcgccgataagatcattgagaaagaggaagagacctgcgaaatcggcaccaacaaggagtttaaatgtttcgaggaacgggcttatattaagggcacgtgccctaccaatatcaacgccgtgcattacatcgacaataaggggaaactgcgctatgttaagtgtaaagagaacctcgaaatgacagaggattgcgctttttgtagaaagattaaaaagaaggccggacagagcgtgcaagtccagaaaacctccgtgcccctgcaggacgcgatctgccaggaaaatagcgacacatactctggccctaagattcccttcaaaggggtttgcaagatcggacttattaaatataaggagtgtaagtttaaaacctccagctacgaaacggtgtctttcatcacactgaaggagaaaggcaagatttatatcgagcacctcatgctgaaaaacatcgaagtcgtgaccaatgtctccttcgtgtgctacgagcatgttgggcaagatgaacaggaggtggagcaccgggccctgaagagagtcagcgtgaacgactgtaaaattgttgataattccaagcagaagatctgcaccggagaccacgtgttttgtgaaaaatacgattgctctacaagctatccggacgtcacctgtattcatgctcctggctccggccccctctacatcaacctgatggggtcttggattaagcctcagtgcgtgggatatgagcgcgtgcttgttgatcgggaagtcaaacaacccctgctcgcccccgagcagaattgtgacacatgcgtgagcgaatgtctggatgagggcgtgcacatcaagtccacggggttcgagatcaccagcgctgtcgcctgctctcatggatcctgcattagcgcccaccaggaaccttctacatccgtgatcgttccgtaccccggccttctggctagcgttgggggcagaattggaatccatctctctcacaccagcgactccgcgagcgtccacatggtggttgtgtgtcctccccgcgattcttgcgccgctcataactgtctgctgtgctatcacggcattctcaactaccagtgtcattccacactgagcgccatccttacctcctttctgctcatcctgttcatttatacggtcttttctgtgaccacaaatatcctgtacgttcttcggctcattcctaaacaactcaagagccccgtggggtggctgaagctgttcatcaactggctgcttaccgccctgagaattaaaacacgcaatgtcatgcggagaatcaaccagcgcatcggatgggtggaccaccacgatgtggagcggccgagacatcgcgaacctatgcggagatttaagaccacgctcctgctgacacttattatgatgaccggcgggaatgcttgctccaacacagtcgttgccaattctaaacagacccggtgtgtgcaggagggaagcaacaccaagtgctccatcacagcgacgattaccctccgcgctggcgtgatcggggccgaatcttgtttcattatcaaaggccccatggagaatcaacagaagacaattagcatcaagaccatctccagcgagacagtctgcagagaaggatcttccttttggaccagcctgtacattccttcttgtctgtccagccggagatgccacctcgtgggcgactgcgttgggaacaaatgtcagtcttggcgcgacgatcaactgtcccgggagttcagcggagtgaaggacaatcatatcatgaacgaaaataaatgctttgagcagtgtggcgccattgggtgcggatgtttcaacatcaatccctcctgcctttatgtccacgcttacctcaagagcgccagaaacgaagctgtgcgcgtgttttcttgtagcgattgggtgcatagagtctccttcgaggtgaaaggccctgacggggagacggaactggttacactgggctctctgggaaccaagttccttaactggggcaccctcagcctgtccctggatgccgaggggatttctggaacaaatagcatctcctttctcgaatctagcaagggcgggttcgcgctgtatgacgagggatacaacgagatcccccgggaaggctttcttggggagattcgctgctccagcgaatctgccgctatctccgcccacaaaagctgtattagagctccgggcctgatcaagtataaacctatgaccgatcagattgagtgcacagcctctctcgtggaccccttcgcgatctttctgaagggatccctgccccagacgcggaatggccaaaccttcacaagcaccaaagataagaaaacagtccaggcctttaccaacggggctatcaaggcccttctctccattaatctggacgatcacgaaatcgtgttcattaacaaggtgaaaaattgtgacgctacgtttctgaacgtctctggatgctacagctgcgattatggcgcccatgtttgtgtgaaggtgaaatccagcgagtctgccgacttctttgctgagtccgaagacaagaccacagtcctcagcttccctatccagtctgggacccacgattactgccaggtgctgcattttcaaaaaccgcttgttgacgagcgcctgagctactcctgtggatctgaacccaagctcattgtgatcaagggcacactggtctatatgggcgtgtacgatttcagaaataaaaccgggggaagctccacagttgtgaacccttctgagggcgcgtggagcatttccaattggttcagcgggctgcttgactggctgggaggccccatgaaggccatcctcaaaatcctggggtttattgctatcggaattgtctgcttcgtgctctttatgatcctgattcggatcgccgtcaactctatcaatattaagaaaaagaactga

SEQ ID NO: 14360 - RNA, 3942 nt, synthetic construct
  misc_feature 1..3942: note = derived and/or modified CDS sequence (opt5) from PTV(PaAR2381)__KP272005.1__GP
  source 1..3942: mol_type = other RNA
atgatcttcaccattctgaacatcctcacaagagccatgctggtgatgagcatgtactcccttacgacctgggactctacaagccggaatgatatgtgcttttccaacgactctcccctggagggcctcgtctattactgggaaacccacagcaagaaacatgattataagaaacaggagtcccaaaagtgtcgcgttggggactctgataaaaagatgattagcaatgtgacaatcatttccctgatcagcgaaatccagaagtctatttccgagcttagcctgtcttgcggaaacgacgataattccaccggccaggtgctcacattcaacgggctggaagacaccatcagaggagattacattgtcgactgtgtgacgggcctgtatcagagcgatatcggggttggagtgggcctcggccggacccaccatgaccaccatcaagtcaaaaataaggctgtggttattgatgagaaagagcgcatgatctctctgcttgaaacacagcagtccgagaacgacattaagatgcaagtgctgatgagcgaaatcgagcaactcaaaaatcagctgtccagaaagcggaacgagcgcgggcaggaaaagagagacgccgagaaagtcatgtctgatcttatggcgcggaatagcgacctgcgcaagcacaacgatatcctcaccgctgaaatttcccagatgaaatacaataacacaatccaaagaagcaagaatgtgatgtctaccacggtggtccctgccattctgtccgttgccctgctcagctctagcgtggctccgatcatggccgctccccctgactcccccatgattaacccttggccccacgccaaaaaccgggtgggaacaggcatgtataagtacgatgacaatgatgactctgggtgccgccctatcagatacggagtcagctgtatcggctttgatttcatgctgaaaatggacaagtatccgtttttcaacgcgtttattgggcataagacaccccttgagtccttcgccgataaaatcattgaaaaggaggaggaaacatgcgagatcggaaccaataaagaatttaagtgtttcgaggaacgggcttacattaaaggaacctgccctacaaacatcaatgccgtgcactatatcgacaacaagggcaagctgcgctacgttaaatgtaaggagaatctcgagatgacggaagactgcgctttttgtagaaaaattaagaaaaaggccgggcagagcgtgcaggtccaaaagacctctgtgcccctgcaggatgcgatctgccaggagaactccgacaattatagcggacctaaaattcccttcaagggcgtttgccggatcgggcttattaaatacaaggaatgtaaatttaagacatcttcctatgagaccgtgagcttcatcacactgaaggaaaaaggaaagatttacatcgagcatctcatgctgaaaaacatcgaggtcgtgaccaatgtctccttcgtgtgctacgaacacgccggccaggatgagcaagaagttgagcacagagctctgaagcgcgtgtctgtcaacgactgtaaaattgtggataatagcaagcagaaaatctgcacgggggaccatgtgttttgtgagaagtatgattgctccacatcttacccggacgtgacctgtattcacgcccctggaagcggccccctctatatcaacctgatgggctcctggattaagcctcagtgcgtcgggtacgaacgggtgcttgtggatagagaggttaaacagcccctgctcgctcccgaacaaaattgtgatacctgcgtcagcgagtgtctggacgaaggagtgcatatcaagtctacaggcttcgagatcacctccgccgtggcctgcagccacgggtcttgcatttccgctcatcaggaggcgagcacatctgtcatcgtgccttatccgggacttctggccagcgttggcgggcgcattggcatccacctctcccacacgagcgactctgcttccgtgcatatggtcgtggtttgtccccctcgggatagctgcgaagcccacaactgtctgctgtgctaccatggcattctcaactatcagtgtcactccaccctgtctgccatccttaccagctttctgctcatcctgttcatttacaccgtgttttccgtcacaaccaatatgctgtacgtgcttagactcatccccaaacagctgaagtctcctgttggctggctgaaactcttcattaactggctgcttacggctctgcgcatcaagacccggaatgtgatggggagaattaaccaacgcatcggatgggtcgaccaccatgacgtggagcggcccagacaccgcgaaccgatgcggagatttaagacaaccctcctgctgacacttatcatgatgaccggcgggaatgcctgcagcaacacggtggtcgctaattccaaacagacacggtgtgttcaggagggatctaacaccaagtgcagcattacagctaccatcaccctccgcgccggcgtgattggggccgaatcctgtttcatcattaaaggccctatggagaatcagcaaaagacaatcagcattaaaacgatctcttccgagaccgtgtgcagagaaggaagctctttttggacatccctgtatatccccagctgtctgtcttcccggagatgccatctcgtcggcgattgcgtggggaacaagtgtcagagctggcgcgacgatcagctgtcccgggagttcagcggagttaaggacaatcacattatgaacgaaaataaatgctttgagcaatgtggcgctatcgggtgcggatgtttcaacattaatccttcttgcctttacgtgcatgcctatctcaagagcgctagaaacgaagccgtccgcgtgttttcctgttctgattgggttcacagagtgagcttcgaggtcaaaggccccgacggggagaccgaactggtgacactgggctccctgggaaccaagttccttaactggggcacgctctctctgagcctggatgcggaggggatctccggaacaaattctattagctttctcgaatccagcaaaggcgggttcgccctgtacgacgagggatattctgagatccctcgggaaggctttcttggggagatccgctgctccagcgaatctgctgccatttccgctcacaagagctgtatcagagcccccggcctgattaagtacaaaccgatgaccgatcagatcgagtgcaccgcgtccctcgttgaccctttcgccatttttctgaagggatctctgccccagacacggaacggccagaccttcacaagcacgaaagataagaaaaccgtgcaggcttttacaaatggggccatcaaggcgcttctctccatcaacctggacgatcatgaaattgtcttcatcaataaagttaagagctgtgacgccacctttctgaacgtgtctggatgctattcctgcgactacggcgcccacgtctgtgttaaggtgaaaagctctgagagcgctgatttctttgcggagtccgaagacaagacaaccgtgctctctttccccattcagagcgggacgcatgattactgccaggtcctgcactttcagaaacctcttgtggacgagcgcctgtcctattcttgtggaagcgaaccgaagctcatcgttattaaaggcaccctggtgtacatgggcgtctatgatttcagaaataagacagggggatccagcaccgtggttaacccctctgagggcgcctggtccatcagcaattggttctccgggctgcttgactggctgggaggccctatgaaggctattctcaaaatcctggggtttatcgccattggaatcgtgtgcttcattctctttatgatcatgattcggatcgccgtcaactctatcaatattaagaaaaagaactga

SEQ ID NO: 14361 - RNA, 3942 nt, synthetic construct
  misc_feature 1..3942: note = derived and/or modified CDS sequence (opt5) from PTV(PAN483391)__KP272008.1__GP
  source 1..3942: mol_type = other RNA
atgatcttcaccattctgaacatcctcacaagagccatgctggtgatgagcatgtactcccttacgacctgggactctacaagccggaatgatatgtgcttttccaacgactctcccctggagggcctcgtgtattactgggaaacccacagcaagaaacatgattataagaaacaggagtcccaacgctgtagagttggggactctgataagaaaatgattacaaatgtgaccatcattagcctgatctccgaaatccaaaagagcatttctgagctttccctgagctgcggaaacgacgataattctacaggccaggtgctcaccttcaacgggctggaagacacgatccggggagattacattgtcgactgtgtgaccggcctgtatcagtccgatatcggggttggagtgggcctcggccgcacacaccatgaccaccagcaggtcaagaataaagctgtggttattgatgagaaggagagaatgatcagcctgcttgaaacccagcagtctgagaacgacattaaaatgcaagtgctgatgtccgaaatcgagcagctcaagaatcagctgagcaaaaagcggaacgagcgcgggcaggaaaagagagacgccgagaaagtcatgtccgatcttatggcgcggaatagcgacctgcgcaagcataacgatatcctcacagctgaaattagccaaatgaaatacgacaataccatccagagaaacaagaatgtgatgtccacgacagtggtccctgccattctgagcgttgccctgctctcttccagcatcgctccgattatggccgcttctcccgatagccctatgatcaacccctggcctcacgccaaaaaccgggtgggaaccggcatgtataagtacgacgagaatgatgactccgggtgccgccccatcagatacggagtgtcttgtattggctttgatttcatgctgaaaatggacaagtatccgtttttcaacgcgtttatcgggcacaagacacctcttgaatctttcgccgataaaattatcgagaaggaggaagagacctgcgaaattggaaccaataaagagtttaagtgtttcgaggaacgggcttacatcaaaggcacatgccccacgaacatcaatgccgtccattatattgacaacaagggcaagctgcgctacgtgaaatgtaaggagaatctcgaaatgaccgaggactgcgctttttgtagaaaaatcaagaaaaaggccgggcagtccgttcaagtgcagaagacaagcgtccctctgcaggatgcgatttgccaggaaaactctgacacctattccggacccaaaatccctttcaagggcgtgtgcaaaattgggcttatcaagtacaaagagtgtaagtttaagacaagctcttatgaaaccgtttccttcattacgctgaaagagaagggaaaaatctacatcgagcacctcatgctgaagaatattgaagtggtcacaaacgtgagcttcgtctgctacgagcatgccggccaagatgaacaggaggtggagcaccgggctctgaaaagagtttccgtgaatgactgtaagatcgtcgataactctaaacagaagatttgcaccggggaccacgtgttttgtgaaaagtatgattgcagcacctcctaccccgacgttacatgtatccatgccccgggatctggccctctctatattaatctgatgggcagctggatcaaaccccagtgcgtggggtacgagaaggtccttgtggatcgcgaagtgaaacaacctctgctcgctcccgagcagaactgtgatacctgcgtttccgaatgtctggacgagggagtccacatcaagagcacaggcttcgagattacgtctgccgtggcctgctcccatgggagctgcatctctgctcaccaggaagcgtccaccagcgtgattgtcccctatcctggacttctggcctctgtgggcgggaaaatcggcattcatctcagccacacatccgacagcgcttctgttcacatggtggtcgtgtgtccgccccgggattcctgcgccgcccataattgtctgctgtgctaccacggaatcctcaactatcagtgtcatagcaccctgtccgctatccttacatcttttctgctcattctgttcatctacaccgtttttagcgtgacgaccaacatgctgtacgtccttagactcattcctaagcaactgaagtcccccgtgggctggctgcgcctcttcatcaattggctgcttacagccctgcggattaaaaccagaaacgttatggggcgcatcaatcagcggatcggatgggtggaccaccacgacgtcgagagacctcgccatcgggaacccatgagacgctttaagacaaccctcctgctgacgcttattatgatgacaggcgggaacgcgtgctctaataccgtggtggctaacagcaaacagacacggtgtgtccaggagggatccaataccaagtgctctatcaccgccacaattacgctcaaagccggcgttatcggggctgaaagctgtttcattatcaagggcccgatggagaaccaacagaagaccatttccatcaaaacaatcagctctgagaccgtgtgcagagaaggatccagcttttggacatctctgtatattccttcctgtctgagctctcggcgctgccacctcgtgggcgattgcgtcgggaataagtgtcagtcctggagagacgatcaactgagccgggagttctccggagtgaaagacaaccatatcatgaatgaaaacaagtgctttgagcagtgtggcgccattgggtgcggatgtttcaatatcaaccccagctgcctttacgttcacgcttatctgaaatctgccagaaatgaagcggtgcgcgtctttagctgttccgattgggtgcatcgggtttctttcgaggtgaagggccctgacggggagaccgaactcgtcacgctgggcagcctgggaacaaagttccttaactggggcaccctctccctgtctctggatgccgaggggattagcggaaccaactccatctcttttctcgaaagctccaaaggcgggttcgctctgtacgacgagggatatagcgagatccccagagaaggctttcttggggagattcgctgttcttccgaaagcgccgctatctctgcccacaagtcctgcattagagcgcctggcctgatcaaatacaagcccatgacagatcagattgagtgcaccgccagcctcgtggacccgttcgctatctttctgaaaggatccctgcctcagacacggaatggccaaacgttcacctctacaaaggataaaaagaccgttcaggcctttacaaacggggctatcaaggcccttctcagcattaatctggacgatcacgaaatcgtgttcattaacaaagtccgctcctgtgacgccacctttctgaatgtgagcggatgctattcttgcgactacggcgctcatgtgtgtgtcaaggttaaatccagcgagtctgcggatttctttgccgagagcgaagacaagacgaccgtgctctccttccccatccagtctgggacacacgattactgccaggtgctgcattttcaaaaaccccttgtcgacgagagactgagctattcctgtggatctgaacctaagctcattgtgatcaagggcaccctggtttacatgggcgtgtatgatttccggaacaaaacagggggaagctccaccgtcgtgaatccgagcgagggcgcttggtctatttccaactggttcagcgggctgcttgactggctgggaggccccatgaaggccatcctcaaaatcctggggtttattgccatcggaattgtttgcttcatcctctttatgattctgatccgcatcgctgtcaattccattaacatcaagaaaaagaattga

SEQ ID NO: 14362 - RNA, 3942 nt, synthetic construct
  misc_feature 1..3942: note = derived and/or modified CDS sequence (opt5) from PTV(GML902876)__KP272011.1__GP
  source 1..3942: mol_type = other RNA
atgatcttcaccattctgaacgtgctcacaagagccatgctggtcatgagcatgtactcccttacgacctgggactctacaagccggaatgatatgtgcttttccaacgactctcccctggagggcctcgtttattactgggaaacccacagcaagaaacatgattataagaaacaggagtcccaaaagtgtcgcgtgggggactctgataaaaagatgatcagcaatgtgacaattatctccctgattagcgaaatccagaagtctatctccgagcttagcctgtcttgcggaaacgacgataattccaccggccaggtcctcacattcaacgggctggaagacaccattagaggagattacatcgtggactgtgttacgggcctgtatcagagcgatattggggtgggagtcggcctcggccggacccaccatgaccaccatcaagtgaaaaataaggctgttgtgatcgatgagaaagagcgcatgatttctctgcttgaaacacagcagtccgagaacgacatcaagatgcaggtcctgatgagcgaaattgagcaactcaaaaatcagctgtccagaaagcggaacgagcgcgggcaggaaaagagagacgccgagaaagtgatgtctgatcttatggcgcggaatagcgacctgcgcaagcacaacgatatcctcaccgctgaaatctcccagatggagaataacaatacaattcaaagaaacaaaaacgtgatgagcaccacggtcgttcctgccatcctgtctgtggccctgctctccagctctattgctccgatcatggccgctagccccgactcccctatgattaatccctggcctcacgccaagaaccgggtgggaacaggcatgtacaaatatgatgaaaatgacgattctgggtgccgccccatcagatacggagtcagctgtatcggctttgacttcatgctgaagatggataaataccctttcttcaacgcgtttattgggcataagaccccgcttgagtccttcgccgacaagatcattgagaaagaagaggaaacatgcgagatcggaaccaataaggaatttaaatgtttcgaggagcgggcttatattaaggggacctgccccacaaacatcaatgccgtgcactacatcgataacaaaggcaagctgcgctatgttaagtgtaaagaaaatctcgagatgacggaagactgcgctttttgtagaaagattaaaaagaaagccggccagagcatccaggtgcaaaagacctctgtccctctgcaggacgcgatttgccaggagaactccgatacatacagcggacccaagatccctttcaaaggcgtgtgcaagattgggcttatcaaatataaggaatgtaaatttaagacctcttcctacgagacagttagcttcattaccctgaaggagaaaggaaagatctatatcgaacatctcatgctgaaaaatattgaggtggtcacgaacgtgtccttcgtctgctacgaacacgccggccaggacgagcaagaggtggaacaccgggctctgaagagagtttctgtgaatgattgtaaaatcgtcgacaacagcaagcagaaaatttgcacaggggatcatatcttttgtgagaagtacgactgctccacctcttatcccgatgtgacctgtattcacgccccgggaagcggccctctctacatcaatctgatgggctcctggatcaagccccagtgcgttgggtatgaacgcgtgcttgtcgaccgggaggtgaaacagcctctgctcgctcccgaacaaaactgtgatacatgcgtgagcgagtgtctggacgagggagttcatattaagtctaccggcttcgaaatcacatccgccgtcgcctgcagccacgggtcttgcatttccgctcatcaggaggcgagcacgtctgtgatcgtgccctaccctggacttctggccagcgtcggcgggagaattggcatccacctctcccacaccagcgattctgcttccgtgcatatggttgtggtctgtccgccccgcgacagctgcgccgcccacaactgtctgctgtgctatcatggaatcctcaattaccagtgtcactccacactgtctgctattcttaccagctttctgctcatcctgttcatttatacagtgttttccgttaccacgaacatgctgtacgtgcttcggctcatccctaaacagctgaagtctcccgtcggctggctgagactcttcattaattggctgcttaccgccctgcgcatcaaaacacggaacgtgatggggagaatcaatcaacgcattggatgggttgatcaccatgacgtggaacggcctagacaccgcgagcccatgcggagatttaagaccacactcctgctgacccttatcatgatgacgggcgggaacgcgtgcagcaatacagtcgtggctaactccaagcagacccggtgtgtgcaggaaggatctagcacaaaatgctccattaccgccaccatcacactccgcgccggcgtcattggggctgagagctgtttcatcattaagggcccgatggagaatcagcagaaaacgatctctatcaagaccatttccagcgaaacagtttgcagagagggatcttccttttggaccagcctgtacatcccttcttgtctgtccagccggagatgccatctcgtgggcgactgcgtggggaacaaatgtcaatcctggcgcgatgaccagctgagccgggaattttctggagtcaaggataatcacattatgaacgagaataagtgctttgaacaatgtggcgccatcgggtgcggatgtttcaacattaatcccagctgcctttatgtgcatgcttacctgaaatccgccagaaacgaggcggttcgcgtgttttcttgtagcgactgggtccacagagtgtccttcgaggttaagggccctgatggggaaacagagctcgtggccctgggctctctgggaaccaaattccttaactggggcacgctcagcctgtccctggacgctgaagggatctctggaacaaatagcatctcctttctcgagagctctaagggcgggttcgccctgtatgatgagggatactccgaaattccccgggagggctttcttggggaaatccgctgcagctctgagtccgctgccattagcgcgcacaaatcctgtatcagagcccctggcctgattaagtataagcccatgaccgaccagatcgaatgcaccgcttctctcgtcgatccgttcgccatctttctgaaaggaagcctgcctcagacacggaacggccagaccttcacatccacgaaggacaaaaagaccgtgcaggcttttacaaatggggccattaaagcccttctcagcatcaacctggatgaccatgagattgttttcatcaataaggtgaaatcttgtgatgctacctttctgaacgtctccggatgctacagctgcgactatggcgcgcacgtgtgtgtgaaggtcaagtctagcgagtccgccgacttctttgctgaatctgaggataaaacaaccgttctcagcttccccattcaatccgggacgcatgactactgccaggtgctgcactttcagaagccccttgtggatgaacgcctgtcttacagctgtggatccgagcctaaactcatcgtcattaagggcaccctggtgtatatgggcgtttacgacttcagaaataaaacagggggaagctctaccgtggtcaacccgtccgaaggcgcctggagcatctccaattggttctctgggctgcttgattggctgggaggccccatgaaggccatcctcaagattctggggtttatcgctattggaatcgtgtgcttcattctctttatgatcatgatccggattgccgttaacagcatcaatattaaaaagaaaaactga

SEQ ID NO: 14363 - RNA, 3942 nt, synthetic construct
  misc_feature 1..3942: note = derived and/or modified CDS sequence (opt5) from PTV(PAN479603)__KP272014.1__GP
  source 1..3942: mol_type = other RNA
atgatcttcaccattctgaacatcctcacaagagccatgctggtgatgagcatgtactcccttacgacctgggactctacaagccggaatgatatgtgcttttccaacgactctcccctggagggcctcgtctattactgggaaacccacagcaagcgccatgattataaaaagcaggagtcccaaaaatgtagagttggggactctgataagaaaatgattagcaatgtgacaatcatttccctgatcagcgaaatccagaagtctatttccgagcttagcctgtcttgcggaaacgacgataattccaccggccaggtgctcacattcaacgggctggaagacaccatccggggagattacattgtcgactgtgtgacgggcctgtatcagagcgatatcggggttggagtgggcctcggccgcacccaccatgaccaccatcaagtcaagaataaagctgtggttattgatgagaaggagagaatgatctctctgcttgaaacacagcagtccgagaacgacattaaaatgcaagtgctgatgagcgaaatcgagcaactcaagaatcagctgtcccggaaacgcaacgagagagggcaggaaaagcgggacgccgagaaggtcatgtctgatcttatggcgcgcaatagcgacctgagaaaacacaacgatatcctcaccgctgaaatttcccagatgaagtacgacaatacaatccaacggaacaaaaatgtgatgagcaccacggtggtccctgccattctgtctgttgccctgctctccagctctgtggctccgatcattgccgctccccctgatagccccatgatcaacccttggccccacgccaagaaccgcgtgggaacaggcatgtataaatacgacgataatgacgattccgggtgcagacctatccggtacggagtctcttgtattggctttgacttcatgctgaagatggataaatatccgtttttcaacgcgtttatcgggcataagacaccccttgagagcttcgccgacaagattatcgaaaaagaggaggaaacctgcgagattggaaccaataaggaatttaaatgtttcgaggaacgcgcttacatcaaggggacctgccctacaaacatcaatgccgtgcactatattgacaacaaaggcaagctgagatacgttaagtgtaaagagaatctcgagatgacggaagattgcgctttttgtcggaagatcaaaaagaaagccggccagtccgtgcaggtccaaaagaccagcgtgcccctgcaggacgcgatttgccaggagaactctgatacatattccggacctaagatccccttcaaaggcgtttgcaagattgggcttatcaaatacaaggaatgtaaatttaagaccagctcttatgagacagtgtccttcattaccctgaaggaaaaaggaaagatctacatcgagcatctcatgctgaaaaatattgaggtcgtgacgaacgtcagcttcgtgtgctacgaacacgccggccaggacgagcaagaagttgagcacagagctctgaagcgcgtgtccgtcaatgattgtaaaatcgtggacaactctaagcagaaaatttgcacaggggatcatgtgttttgtgagaagtatgactgcagcacctcctacccggatgttacctgtatccacgcccctggatctggccccctctatattaatctgatgggcagctggatcaagcctcagtgcgtcgggtacgaacgggtgcttgtggacagagaggttaaacagcccctgctcgctcccgaacaaaactgtgatacatgcgtctccgagtgtctggacgaaggagtgcatatcaagagcaccggcttcgagattacatctgccgtggcctgctcccacgggagctgcatctctgctcatcaggaggcgtccacgagcgtcattgtgccttatccgggacttctggcctctgttggcgggcgcatcggcattcacctcagccacacctccgatagcgcttctgtgcatatggtcgtggtttgtccccctcgggactcctgcgccgcccacaattgtctgctgtgctaccatggaatcctcaactatcagtgtcacagcacactgtccgctatccttacctcttttctgctcattctgttcatctacacagtgtttagcgtcaccacgaacatgctgtacgtgcttagactcattcccaaacagctgaagtcccctgttggctggctgaaactcttcatcaattggctgcttaccacactgcgcattaagacccggaacgtgatggggagaatcaatcaacgcatcggatgggtcgaccactttgatgtggaacggcccagacatcgcgagccgatgcggagattcaagacaaccctcctgctgacgcttattatgatgacaggcgggaacgcctgctctaataccgtggtcgcgaacagcaaacagacacggtgtgttcaggaaggatccaataccaagtgctctatcaccgctacaattacgctccgcgccggcgtgatcggggccgagagctgttttattatcaaaggccctatggaaaaccagcaaaagaccatttccatcaaaacaatcagctctgagaccgtgtgcagagagggatccagcttctggacatctctgtatattccctcctgtctgagctctcggagatgccacctcgtcggcgactgcgtggggaataagtgtcagtcctggcgcgatgaccagctgagccgggaattttccggagttaaggataaccatatcatgaatgagaacaaatgcttcgaacaatgtggcgctattgggtgcggatgttttaatatcaaccctagctgcctttacgtgcacgcctatctgaagtctgctagaaatgaggccgtccgcgtgttcagctgttccgactgggttcatagagtgtctttcgaagtcaaaggccccgatggggagaccgagctcgtgacgctgggcagcctgggaacaaagtttcttaactggggcaccctctccctgtctctggacgcggaagggattagcggaaccaactccatctctttcctcgagagctccaaaggcgggtttgccctgtacgatgaaggatatagcgagatccctcgggagggcttccttggggaaattcgctgttcttccgagagcgctgccatctctgctcacaagtcctgcattagagcccccggcctgatcaagtacaaaccgatgacagaccagattgaatgcaccgcgagcctcgttgatccttttgccatcttcctgaagggatccctgccccagacacggaatggccagacgtttacctctacaaaagacaagaaaaccgtgcaggctttcacaaacggggccatcaaggcccttctcagcattaatctggatgaccacgagatcgtctttattaaccgcgtgaaatcctgtgacgctaccttcctgaatgtgagcggatgctattcttgcgattacggcgcccatgtctgtgttaaggtgaagtccagcgaatctgctgactttttcgcggagagcgaggataaaacgaccgtgctctcctttcccatccagtctgggacacacgactactgccaggtcctgcatttccagaagcctcttgtggatgaaagactgagctattcctgtggatctgagccgaaactcattgttatcaagggcaccctggtgtacatgggcgtctatgacttccggaacaaaacagggggaagctccaccgtggttaatcccagcgaaggcgcctggtctatttccaactggtttagcgggctgcttgattggctgggaggccctatgaaggctatcctcaagatcctggggttcattgccatcggaattgtgtgctttatcctcttcatgattctgatccgcatcgccgtcaattccattaacatcaaaaagaaaaattga

SEQ ID NO: 14364 - RNA, 3942 nt, synthetic construct
  misc_feature 1..3942: note = derived and/or modified CDS sequence (opt5) from PTV(PAN478718)__KP272017.1__GP
  source 1..3942: mol_type = other RNA
atgatcttcaccattctgaacgtgctcacaagagccatgctggtcatgagcatgtactcccttacgacctgggactctagctcccggaatgatatgtgcttttctaacgacagccccctggagggcctcgtttattactgggaaacacactccaagaaacatgattataagaaacaggagtctcaacgctgtagagtgggggacagcgataagaaaatgatcaccaatgtgacaattatctccctgattagcgaaatccagaagtctatctccgagcttagcctgtcttgcggaaacgacgataattccaccggccaggtcctcacattcaacgggctggaagacaccattcggggagattacatcgtggactgtgttacgggcctgtatcagagcgatattggggtgggagtcggcctcggccgcacccaccatgaccaccaacaggtgaagaataaagctgttgtgatcgatgagaaggagagaatgatttctctgcttgaaacacagcagtccgagaacgacatcaaaatgcaagtcctgatgagcgaaattgagcagctcaagaatcagctgtccaaaaagcggaacgagcgcgggcaggaaaagagagacgccgagaaagtgatgtctgatcttatggcgcggaatagcgacctgcgcaagcataacgatatcctcaccgctgaaatctcccaaatgaaatacaataacacaattcagagaaataagaacatcatgagcaccacggtggtccctgccattctgtctgttgccctgctctccagctctgtggctccgatcatggccgctccccctgacagccccatgattaacccttggccccacgccaaaaatcgggtgggaacaggcatgtataagtacgatgacaacgatgactccgggtgccgccctatcagatacggagtctcttgtatcggctttgatttcatgctgaaaatggacaagtatccgtttttcaatgcgtttattgggcacaagacaccccttgagagcttcgccgataaaatcattgaaaaggaggaggaaacctgcgagatcggaaccaacaaagaatttaagtgtttcgaggaacgggcttacattaaaggaacctgccctacaaatatcaacgccgtgcattatatcgacaataagggcaagctgcgctacgttaaatgtaaggagaacctcgagatgacggaagactgcgctttttgtagaaaaattaagaaaaaggccgggcagtccgtgcaagtccagaagaccagcgtgcccctgcaggatgcgatctgccaggaaaattctgacacatattccggacctaaaattcccttcaagggcgtttgcaaaatcgggcttattaagtacaaagaatgtaagtttaagaccagctcttatgagacagtgtccttcatcaccctgaaagaaaagggaaaaatttacatcgagcacctcatgctgaagaacatcgaggtcgtgacgaatgtcagcttcgtgtgctacgaacatgccggccaagatgagcaggaagttgagcaccgggctctgaaaagagtgtccgtcaacgactgtaagattgtggattctagcaaacagaagatctgcacaggggaccacgtgttttgtgagaagtatgattgctccacctcttacccggacgtgacctgtattcatgcccctggaagcggccccctctatatcaatctgatgggctcctggattaaacctcagtgcgtcgggtacgaacgcgtgcttgtggatcgggaggttaagcaacccctgctcgctcccgaacagaactgtgacacatgcgtcagcgagtgtctggatgaaggagtgcacatcaaatctaccggcttcgagatcacatccgccgtggcctgcagccatgggtcttgcatttccgctcaccaggaggcgagcacgtctgtcatcgtgccttatccgggacttctggccagcgttggcgggagaattggcatccatctctcccacaccagcgactctgcttccgtgcacatggtcgtggtttgtccccctcgcgatagctgcgccgcccataattgtctgctgtgctaccacggcattctcaactatcagtgtcattccacactgtctgctatccttaccagctttctgctcatcctgttcatttacacagtgttttccgtcaccacgaacatgctgtacgtgcttcggctcatccccaagcaactgaaatctcctgttggctggctgaaactcttcattaattggctgcttaccgccctgagaatcaagacacgcaacgtgatggggcggattaatcagagaatcggatgggtcgaccaccacgacgtggaacgcccccggcatagagagccgatgcgccggtttaagaccacactcctgctgacccttatcatgatgacgggcgggaacgcgtgcagcaatacagtggtcgctaactccaagcagaccagatgtgttcaggaaggatctaatacaaaatgcagcattaccgccaccatcacactccgggccggcgtgattggggctgagtcctgtttcatcgtgaagggccctatggaaaaccaacagaaaacgattagcatcaagaccatttcttccgagacagtctgccgcgagggaagctctttttggacctccctgtatatccccagctgtctgtcttccagacggtgccacctcgtgggcgattgcgttgggaataagtgtcagagctggagagacgatcaactgtcccgcgagttcagcggagtgaaagacaaccatatcatgaatgagaacaagtgctttgaacagtgtggcgccattgggtgcggatgtttcaatatcaacccttcttgcctttacgtccacgcttatctgaaaagcgcccggaatgaggcggtgagagtgttttcctgttctgattgggttcatcgcgtcagcttcgaagtgaagggccccgacggggagacagagctcgttaccctgggctccctgggaacgaaattccttaactggggcacactctctctgagcctggatgccgaagggatttccggaaccaactctatcagctttctcgagtccagcaagggcgggttcgctctgtacgacgaaggatattctgagattcctagagagggctttcttggggaaatccggtgctccagcgagtctgccgctatctccgcccacaagagctgtattcgcgcgcccggcctgatcaaatacaagccgatgaccgatcagattgaatgcacagcctccctcgtggaccctttcgctatctttctgaaaggatctctgccccagaccagaaatggccaaacattcacgagcaccaaggataaaaagacagtccaggcctttaccaacggggctattaaagcccttctctccatcaatctggacgatcacgagatcgtgttcattaacaaggtgatcagctgtgacgccacatttctgaatgtctctggatgctattcctgcgactacggcgctcatgtttgtgtgaaggtgaaaagctctgaaagcgcggatttctttgccgagtccgaggacaagaccacggtcctctctttccccattcagagcgggacccacgattactgccaggtgctgcattttcaaaaacctcttgttgacgaacggctgtcctattcttgtggaagcgagccgaagctcatcgtgattaaaggcacactggtctacatgggcgtgtatgatttccgcaacaagaccgggggatccagcacagttgtgaatccctctgaaggcgcttggtccatcagcaactggttctccgggctgcttgactggctgggaggccctatgaaggccattctcaaaatcctggggtttatcgccattggaatcgtctgcttcattctctttatgatcctgattagaatcgctgttaattctatcaacattaagaaaaagaattga

SEQ ID NO: 14365 - RNA, 3942 nt, synthetic construct
  misc_feature 1..3942: note = derived and/or modified CDS sequence (opt5) from PTV(Balliet)__KP272023.1__GP
  source 1..3942: mol_type = other RNA
atgatcttcaccattctgaacgtgctcacaagagccatgctggtcatgagcatgtactcccttacgacctgggactctacaagccggaatgatatgtgcttttccaacgactctcccctggagggcctcgtttattactgggaaacccacagcaagaaacatgattataagaaacagaagtcccaacgctgtagagtgggggactctgataaaaagatgatcacaaatgtgaccattatcagcctgatttccgagatccaaaagagcatctctgaactttccctgagctgcggaaacgacgataattctacaggccaggtcctcaccttcaacgggctggaggacacgattcggggagattacatcgtggactgtgttaccggcctgtatcagtccgatattggggtgggagtcggcctcggccgcacacaccatgggcaccagcagatgaaaaataaggctgtggttatcgacgaaaaagagagaatgattctgcttctggagacccagcagagcgaaaacgatatcaagatgcaagtgctcatgtctgagattgaacagctgaaaaatcagctttccaagaagcggaacgagcgcggacaggagaaaagagacgccgaaaaggtcatgagcgacctgatggcgcggaatagcgatctccgcaaacataacgacatcctgacagctgagatctctcaaatgaagaataaaaacaccattcagagaaataagaacacggtgagcacaaccgtggtccctgccatcctgtccgttgccctcctgtcctcttccgtggctccgattatcgccgctccccctgatagccccatgattaacccttggccccacgccaaaaatcgggtgggcacagggatgtacaagtatgacgaaaacgatgactctggatgccgccctatcagatacggcgtcagctgtatcgggtttgatttcatgcttaagatggacaaatacccgtttttcaatgcgtttattggacacaagacacccctggagtccttcgccgataaaatcattgaaaaggaggaggaaacctgcgagatcggcaccaacaaagaatttaagtgtttcgaggaacgggcttatattaagggcacgtgccctaccaatatcaacgccgtgcattacatcgacaataaagggaagctccgctatgttaaatgtaaggagaacctggagatgacagaagattgcgctttttgtagaaaaattaagaagaaagccggacagtctgtgcaagtccagaagaccagcgtgccccttcaggacgcgatctgccaggaaaattccgacacatacagcggccctaaaattcccttcaagggggtttgcaaaatcggactgattaagtataaggaatgtaaatttaagacctcttcctacgagacggtgagcttcatcacactcaaagaaaagggcaaaatttatatcgagcacctgatgctgaagaacatcgaggtcgtgaccaatgtctctttcgtgtgctacgaacatgccgggcaagatgagcaggaagttgagcacaaagctctcaagcgggtgtccgtcaacgactgtaagattgtggataatagcaaacagaagatctgcaccggagaccacgtgttttgtgagaaatacgattgctccacatcttatccggacgttacctgtattcatgcccctggcagcggccccctgtacatcaaccttatggggtcctggattaagcctcagtgcgtcggatatgaaagagtgctggtggatcgcgaggttaaacaacccctcctggctcccgaacagaattgtgacacatgcgtctctgagtgtcttgatgaaggcgtgcacatcaagagcacggggttcgagatcacctccgccgtggcctgcagccatggatcttgcatttccgctcaccaggagcctagcacatctgtcatcgtgccgtaccccggcctgctcgcgtccgttgggggccggattggaatccatctgagccacacctctgacagcgcctccgtgcacatggtcgtggtttgtcctcccagagatagctgcgctgcccataactgtctgctctgctatcacggcattctgaactaccagtgtcattctacactttccgccatcctgaccagctttctcctgatcctgttcatttatacggtgttttccgtcaccacaaatatcctttacgtgctccgcctgattcctaagcaactgaaatctcccgttgggtggctcaagctgttcatcaactggcttctgaccgctctccggattaaaacaagaaatgtgatgggacgcatcaaccagcggatcggctgggtcgaccaccacgatgtggaaagaccgcgccatcgggagcctatgagacgctttaagaccacgctgctgcttacactcattatgatgaccgggggaaatgcctgcagcaacacagtggtcgctaattccaaacagacccggtgtgttcaggaaggctctaacaccaagtgcagcatcacagcgacgattaccctgagagccggggtgatcggcgccgagtcctgtttcattatcaagggacccatggaaaatcaacagaaaacaatttctatcaagaccatcagctccgagacagtgtgccgggagggcagctctttttggacctccctgtacattcctagctgtctctcttcccgcagatgccacctggtcggggactgcgtgggaaacaaatgtcagagctggcgggacgatcaactttctagagagttctccggcgttaaggacaatcatatcatgaacgagaataaatgctttgaacagtgtggggctattggatgcggctgtttcaacatcaatcccagctgcctgtatgtgcacgcctacctcaagtccgctcgcaacgaggccgtccgggtgtttagctgttctgattgggttcatagagtgagcttcgaagtcaaggggcctgacggcgagacggagctggtgacactgggatcccttggcaccaaattcctcaactgggggaccctgtctctgagcctcgatgcggaaggaatttccggcacaaattctatcagctttctggagtcctctaaagggggattcgccctttatgacgaaggctacaacgagatcccccgcgaggggtttctgggcgaaattagatgcagctccgagagcgctgccatctctgctcacaagtcctgtattcgggccccgggactcatcaagtataaacctatgaccgatcagattgaatgcacagcgagcctggttgaccccttcgccatctttctgaagggctctcttccccagacgcgcaatgggcaaaccttcacatccaccaaagataagaagacagtgcaggcttttaccaacggagccatcaaagctctcctgagcattaatctggacgatcacgagatcgtcttcattaacaaggtgaaaaattgtgacgccacgtttctcaacgtgtccggctgctactcttgcgattatggggcccatgtctgtgttaaggtgaaaagctccgaaagcgctgacttctttgcggagtctgaggacaagaccacagtgctgtccttccctatccagagcggaacccacgattactgccaggtccttcattttcaaaagccgctggtggacgaaagactctcttacagctgtggctccgagcccaaactgattgttatcaagggcacactggtgtatatgggggtctacgatttccggaataaaaccggaggctctagcacagtggttaacccttccgaaggggcctggtctattagcaattggttctccggacttctggactggctcggcgggcccatgaaggctatcctgaaaatcctcggatttattgccatcggcattgtgtgcttcgtcctgtttatgatccttattcgcatcgccgtgaacagcatcaatattaagaagaaaaactga

SEQ ID NO: 14366 - RNA, 3942 nt, synthetic construct
  misc_feature 1..3942: note = derived and/or modified CDS sequence (opt5) from PTV(Adames)__KP272029.1__GP
  source 1..3942: mol_type = other RNA
atgatcttcaccattctgaacgtgctcacaagagccatgctggtcatgagcatgtactcccttacgacctgggactctagctcccggaatgatatctgcttttctaacgacagccccctggagggcctcgtttattactgggaaacacactccaagaaacatgattataagaaacaggggtctcaaaagtgtcgcgtgggagacagcgataaaaagatgatttccaatgtgaccatcattagcctgatctctgagatccagaagtccattagcgaactttctctgtcctgcggcaacaatgacaacagcacagggcaggtcctcaccttcaatggactggaggatacaatcagaggcgactacattgtggattgtgttaccgggctgtatcagtctgacatcggagtgggcgtcggcctcgggcggattaaccacgatcatcaacaggtgaaaaataaggctgttgtgatcgacgaaaaagagaagatgatttccctgcttgagacgcagcagagcgaaaacgatatcaaaacccaagtcctgatgtccgagatcgaacagctcaagaatcagctgtctaagcgcagaaacgagcggggacaggagaaacgcgacgccgaaaaacttatgagcgacctgatggcgagaaattccgatctccggaaccacaatgtgattctgacagacgagatcagccaaattaagaacaacatcaccattcatcgcaatagaaacatgatgtctacaaccgtggtccctgctatcctgtccgttgccctcctgagctctagcgtgggcccgatcacggccgctccccctgattccacaatgattaatccctggcctcacgccaagaaccgggtggggaccggaatgtacaaatatgacgaaaatgatgagtctggctgccgccccatcagatacggggtcagctgtattggatttgacttcatgcttaagatggataaataccctttcttcaacgcttttatcggccacaagacaccgctggaatccttcgccgacaagattatcgagaaagaggaagagacctgcgaaatcggcaccaataaggagtttaaatgtttcgaggaacgggcgtatattaaggggacatgccccacgaacatcaatgccgtgcattacattgataacaaaggaaagctccgctatgttaagtgtaaagagaatctggaaatgaccgaggactgcgctttttgtagaaagatcaaaaagaaagccggccagagcgtgcaggtccaaaagacatctgtgcctcttcaggatgctatttgccaggaaaactccgacatctacagcgggcccaagattcctttcaaaggagtttgcaagatcggcctgatcaaatataaggagtgtaaatttaagacctcttcctacgaaacaattagcttcatcaccctcaaggggaaaggaaagatttatatcgagcacctgatgctgaaaaatattgaggtggtcacgaacgtgtccttcgtctgctacgaacatgccggccaggacgagcaagaagtggagcaccgggcgctcaagagagtttctgtgaatgattgtaaaatcgtcgacaacagcaagcagaaaatctgcacaggcgatcacatcttttgtgagaagtacgactgctccacctcttatcccgatgtgacctgtattcatacaccggggagcggacctctgtacattaaccttatgggctcctggatcaagccccagtgcgttgggtatgaacgcgtgctggtcgaccgggaggtgaaacagcctctcctggtgcccgaacaaaattgtgatacctgcgttagcgagtgtcttgacgaaggagtccacattaagtctacaggcttcgagatcacgtccgccgtggcttgcagccatgggtcttgcatctccgcccaccaggaggctagcacctctgtgattatcccctaccctggcctgctcgccagcgtcggaggcagaattgggatccatctgtcccacacaagcgattctgcctccgtgcacatggttgtggtctgtccgccccgcgacagctgcgctgcgcataactgtctgctctgctatcacggcattctgaattaccagtgtcattccaccctttctgccatcctgaccagctttctcctgatcctgttcatttatacagctttttccgtgacgaccaacgttctttacgtgctccggctgatccctaaacagctgaagtctcccgtcggatggctcaaactgttcgtgaattggcttctgacagccctcagaattaagacccgccgggttatggggagaatcaaccaacgcattggatgggtggatcaccacgacgtcgaacggcctagacatcgcgagcccatgcggagatttaagacaaccctgctgcttacgctcatcatggtgacaggcgggaatgcctgcagcaacaccgtggtcgctaattccaaacagacacggtgtgttcaggaaggctctaacaccaagtgcagcattaccgccacaatcacgctgcgcgcgggagtgatcggcgctgagtcctgtttcattatcaaagggccgatggaaaatcagcaaaagaccattagcatcaaaacaatttcttccgagaccgtgtgcagagagggaagctctttttggacatccctgtacatccctagctgtctctcttcccggagatgccacctggtcggcgattgcgtggggaacaagtgtcagagctggcgcgacgaccagctttcccgggaatttagcggagttaaggataatcatatcatgaacgagaataaatgctttgaacaatgtggcgccattgggtgcggctgtttcaacatcaacccctcttgcctgtatgtgcacgcctacctcaagagcgctagaaatgaggccgtccgcgtgttttcctgttctgactgggttcatagagtgagcttcgaagtcaaaggacctgatggcgagatggagctggtgaccctggggtcccttggaacgaagttcctcaactggggcacactgtctctgagcctcgacgctgaagggatttccggaaccaattctatcagctttctggagtccagcaaaggcgggttcgccctttatgatgaaggctactctgagattccccgggagggatttctgggcgaaatccgctgctccagcgagtctgcggccatctccgctcacaagagctgtattagagcccctgggctcatcaagtataaacccatgaccgaccagattgaatgcacagcttccctggttgatccgttcgccatctttctgaagggatctcttcctcagacccggaacggccagacattcacgagcaccaaagacaagaaaacagtgcaagcgtttaccaatggggccattaaggctctcctgtccatcaacctggatgaccacgagattatcttcatcaataaagtcaagagctgtgatgccacatttctcaacgtgtctggatgctactcctgcgactatggcgctcatgtgtgtgtcaaggttaaaagctctgaaagcgccgatttctttgccgagtccgaggacaagaccacggtgctgtctttccccattcagagcggcacccgcgactactgccaggtgcttcactttcagaaacccctggtcgatgaaagactctcctactcttgtgggagcgagcctaagctgatcgtgattaaaggaacactggtttatatgggcgtgtacgacttccggaataagaccgggggatccagcacagtcatcaacccgtctgaaggcacctggtccattagcaattggttctccgggcttctggattggctcggaggccccatgaaggctatcctgaaaatcctcggctttattgcgatcgggattgtgtgcttcatcctgtttatgattcttatccgcatcgccgttaactctattaatatcaagaaaaagaactga

SEQ ID NO: 14367 - RNA, 3942 nt, synthetic construct
  misc_feature 1..3942: note = derived and/or modified CDS sequence (opt5) from PTV(GML488831)__KP272032.1__GP
  source 1..3942: mol_type = other RNA
atgatcttcaccattctgaacgtgctcacaagagccatgctggtcatgagcatgtactcccttacgacctgggactctacaagccggaatgatatgtgcttttccaacgactctcccctggagggcctcgtttattactgggaaacccacagcaagaaacatgattataagaaacaggagtcccaacgctgtagagtgggggactctgataagaaaatgatcacaaatgtgaccattatcagcctgatttccgaaatccagaaaagcatctctgagctttccctgagctgcggaaacgacgataattctacaggccaggtcctcaccttcaacgggctggaagacacgattcggggagattacatcgtggactgtgttaccggcctgtatcagtccgatattggggtgggagtcggcctcggccgcgctcaccatgaccaccaacaggtgaagaataaggccgttgtgatcgatgagaaggagagaatgattagcctgcttgaaacacagcagtctgagaacgacatcaaaatgcaagtcctgatgtccgaaattgagcagctcaagaatcagctgagcaaaaagcggaacgagcgcgggcaggaaaagagagacgcggagaaagtgatgtccgatcttatggctcgcaattctgacctgcggaagcataacgatatcctcaccgccgaaatcagccaaatgaaatacaataacacaattcagagatccaagaatgtgatgagcaccacggtcgttcctgccatcctgtctgtggctctgctctccagctctgtggccccgattatggctgcgccccctgacagccccatgatcaacccttggccccacgccaaaaaccgggtcggaacaggcatgtataagtacgatgacaatgatgactccgggtgccgccctattagatacggagtgtcttgtatcggctttgatttcatgctgaaaatggacaagtatccgtttttcaacgcctttatcgggcacaagacaccccttgagagcttcgctgataaaattatcgaaaaggaggaggaaacatgcgagattggaaccaataaagaatttaagtgtttcgaggaacgggcctacatcaaagggacctgccctacaaacattaatgctgttcattatatcgacaacaagggcaagctgcgctacgtgaaatgtaaggagaatctcgagatgacggaagactgcgccttttgtagaaaaatcaagaaaaaggcgggccagtccgtccaagtgcagaagaccagcgtttctctgcaggatgccatttgccaggagaactccgacaattatagcggacccaaaatccctttcaagggcgtgtgcaaaattgggcttatcaagtacaaagaatgtaagtttaagacatcttcctatgagaccgtcagcttcattacactgaaagaaaagggaaaaatctacattgagcacctcatgctgaagaacatcgaggtggtcaccaatgtgtccttcgtttgctacgaacatgctggccaagatgagcaggaagtggagcaccgggccctgaaaagagtctctgtgaacgactgtaagatcgttgataatagcaaacagaagatttgcacgggggaccacgtgttttgtgagaagtatgattgctccacatcttaccccgacgtcacctgtatccatgctccgggaagcggccctctctatattaacctgatgggctcctggatcaaaccccagtgcgtggggtacgaacgcgtgcttgttgatcgggaggtcaagcaacctctgctcgcccccgaacagaattgtgatacctgcgtgagcgagtgtctggacgaaggagtgcacattaaatctacaggcttcgagatcacctccgccgtcgcttgcagccatgggtcttgcatctccgcgcaccaggaggccagcacatctgtgattgttccctatcctggacttctggctagcgtgggcgggagaatcggcattcatctctcccacacgagcgactctgcctccgtccacatggtggttgtgtgtccgccccgcgatagctgcgccgctcataactgtctgctgtgctaccacggaatcctcaactatcagtgtcattccaccctgtctgccattcttaccagctttctgctcatcctgttcatctacaccgtcttttccgtgacaaccaatatgctgtacgttcttcggctcattcctaagcaactgaaatctcccgtgggctggctgaaactcttcatcaactggctgcttacggcgctgagaattaagacccgcaatgtcatggggcggatcaaccagagaattggatgggtggaccaccacgacgtggaacgccctcggcatagagagcccatgcgccggtttaagacaaccctcctgctgacacttatcatgatgaccggcgggaatgcttgcagcaacacggtcgttgccaattccaagcagacaagatgtgtgcaggaaggatctaacaccaaatgcagcatcacagccaccattaccctccgggctggcgtgatcggggccgagtcctgtttcattatcaagggcccgatggaaaatcaacagaaaacaattagcatcaagacgatttcttccgagaccgtctgccgcgagggaagctctttttggacatccctgtatatccctagctgtctgtcttccagacggtgccacctcgtgggcgattgcgttgggaacaagtgtcagagctggagagacgatcaactgtcccgcgaatttagcggagtgaaagacaatcatatcatgaacgagaataagtgctttgaacagtgtggcgctattgggtgcggatgtttcaacatcaatccctcttgcctttacgtccacgcctatctgaaaagcgcgcggaacgaggccgtgagagttttctcctgttctgattgggtgcatcgcgtcagcttcgaagtgaagggccctgacggggagaccgagctcgttacactgggctccctgggaaccaaattccttaactggggcacgctctctctgagcctggatgctgaagggatttccggaacaaattctatcagctttctcgagtccagcaagggcgggttcgccctgtacgacgaaggatattctgagattcccagagagggctttcttggggaaatccggtgctccagcgagtctgctgccatctccgcgcacaagagctgtattcgcgcccctggcctgatcaaatacaagcccatgaccgatcagattgaatgcaccgcttccctcgtggacccgttcgccatctttctgaaaggatctctgcctcagacaagaaacggccaaaccttcacaagcacgaaggataaaaagaccgtccaggcttttacaaatggggccattaaagcccttctctccatcaacctggacgatcacgagatcgtgttcattaataaggtgcggagctgtgacgctacctttctgaacgtctctggatgctattcctgcgactacggcgcgcatgtttgtgtgaaggtgaaaagctctgaaagcgccgatttctttgctgagtccgaggacaagacaaccgtcctctctttccccatccagagcgggacgcacgattactgccaggtgctgcattttcaaaaaccccttgttgacgaacgcctgtcctattcttgtggaagcgagcctaagctcattgtgatcaaaggcaccctggtctacattggcgtgtatgatttcagaaataagacagggggatccagcaccgttgtgaacccgtctgaaggcgcctggtccatcagcaattggttctccgggctgcttgactggctgggaggccccatgaaggccattctcaaaatcctggggtttatcgctattggaatcgtctgcttcattctctttatgatcctgattcggatcgccgtgaactctatcaatattaagaaaaagaactga

SEQ ID NO: 14368 - RNA, 3942 nt, synthetic construct
  misc_feature 1..3942: note = derived and/or modified CDS sequence (opt5) from PTV(GML488778)__KP272038.1__GP
  source 1..3942: mol_type = other RNA
atgatcttcaccattctgaacgtgctcatcagagccatgctggtcatgagcatgtactcccttacaacgtgggactctaccagccggaatgatatgtgcttttccaacgactctcccctggagggcctcgtttattactgggaaacacacagcaagaaacatgattataagaaacaggagtcccaacgctgtagagtgggggactctgataagaaaatgattaccaatgtgacaatcattagcctgatctccgaaatccagaagtctatttctgagctttccctgagctgcggaaacgacgataattctaccggccaggtcctcacattcaacgggctggaagacaccatccggggagattacattgtggactgtgttacgggcctgtatcagtccgatatcggggtgggagtcggcctcggccgcacccaccatgaccaccaacaggtgaagaataaagctgttgtgattgatgagaaggagagaatgatcagcctgcttgaaacacagcagtctgagaacgacattaaaatgcaagtcctgatgtccgaaatcgagcagctcaagaatcagctgagcaaaaagcggaacgagcgcgggcaggaaaagagagacgccgagaaagtgatgtccgatcttatggcgcggaatagcgacctgcgcaagcataacggaatcctcaccgctgaaattagccaaatgaaatacaataacacagtgcagagatccaagaatgtcatgagcaccacggttgtgcctgccatcctgtctgtggccctgctctccagctctgtcgctccgattatggccgctccccctgatagccccatgatcaacccttggccccacgccaaaaaccgggtgggcacagggatgtataagtacgacgataatgacgattccggatgccgccctattagatacggcgtttcttgtatcgggtttgacttcatgctgaaaatggataagtatccgtttttcaacgcgtttatcggacacaagacaccccttgagagcttcgccgacaaaattatcgaaaaggaggaggaaacctgcgagattggcaccaataaagaatttaagtgtttcgaggaacgggcttacatcaaaggaacctgccctacaaacattaatgccgtgcattatatcgataacaaggggaagctgcgctacgtcaaatgtaaggagaatctcgagatgacggaagactgcgctttttgtagaaaaatcaagaaaaaggccggacagtccgtgcaagttcagaagaccagcgtgtctctgcaggacgcgatttgccaggagaactccgataattatagcggccccaaaatccctttcaagggggtctgcaaaattggacttatcaagtacaaagaatgtaagtttaagacatcttcctatgagaccgtgagcttcattacactgaaagaaaagggcaaaatctacattgagcacctcatgctgaagaacatcgaggtcgtgaccaatgtttccttcgtgtgctacgaacatgccgggcaagacgagcaggaagtcgagcaccgggctctgaaaagagtgtctgttaacgattgtaagatcgtggacagctccaaacagaagatttgcacgggagatcacgtcttttgtgagaagttcgactgctctacaagctatcccgatgtgacctgtatccatgccccgggctccggccctctctacattaatctgatggggagctggatcaaaccccagtgcgtgggatatgaacgcgttcttgtcgaccgggaggtgaagcaacctctgctcgctcccgaacagaactgtgatacctgcgtgtctgagtgtctggacgaaggcgtccacattaaatccacagggtttgagatcaccagcgccgtggcctgctctcatggatcctgcatcagcgctcaccaggaggcgtctacaagcgttattgtgccctaccctggccttctggcctccgtcgggggcagaatcggcattcatctcagccacacgtctgattccgctagcgtgcacatggttgtggtctgtccgccccgcgactcctgcgccgcccataattgtctgctgtgctatcacggcatcctcaactaccagtgtcattctaccctgagcgctattcttacatccttcctgctcatcctgtttatctataccgtgttctctgttacaaccaacatgctgtacgtgcttcggctcattcctaagcaactgaaaagccccgtcgggtggctgaagctctttatcaattggctgcttacggccctgagaattaagacccgcaacgtgatgggacggatcaatcagagaattggctgggtggatcaccacgacgtcgaacgccctcggcatagagagcccatgcgccggttcaaaacaaccctcctgctgacacttatcatgatgaccgggggaaacgcgtgctccaatacggttgtggctaactctaagcagacaagatgtgtgcaggaaggcagcaataccaaatgctccatcacagccaccattaccctccgggccggggtcatcggcgctgagagctgttttattatcaagtctccgatggaaaaccaacagaaaacaatttccatcaagacgattagctctgagaccgtgtgccgcgagggatccagcttctggacatctctgtacatcccttcctgtctgagctccagacggtgccacctcgttggcgactgcgtggggaataagtgtcagagctggagagatgaccaactgtctcgcgaatttagcggagtcaaagataaccatatcatgaatgagaacaagtgcttcgaacagtgtggcgccattgggtgcggatgttttaatatcaacccctcctgcctttatgtgcacgcttacctgaaatctgcccggaatgaggcggttagagtgttcagctgttccgactgggtccatcgcgtgtctttcgaagttaagggccctgatggggagaccgagctcgtgacactgggcagcctgggaaccaaatttcttaactggggcacgctctccctgtctctggacgccgaagggattagcggaacaaactccatcagcttcctcgagtcttccaagggcgggtttgctctgtatgatgaaggatacagcgagattcccagagagggcttccttggggaaatccggtgttcttccgagagcgccgctatctccgcccacaagtcttgcattcgcgcgcctggcctgatcaaatataagcccatgaccgaccagattgaatgcaccgccagcctcgtcgatccgtttgctatcttcctgaaaggatccctgcctcagacaagaaatggccaaacctttacaagcacgaaggacaaaaagaccgtgcaggccttcacaaacggggctattaaagcccttctctctatcaatctggatgaccacgagatcatttttatcaacaaggtgcggtcctgtgatgccaccttcctgaatgtcagcggatgctactcttgcgactatggcgctcatgtttgtgtgaaggtgaaaagctccgaatctgcggactttttcgccgagagcgaggataagacaaccgtcctctcctttcccattcagtctgggacgcacgactactgccaggtgctgcatttccaaaaaccccttgttgatgaacgcctgagctactcctgtggaagcgagcctaagctcatcgtgattaaaggcaccctggtctatatgggcgtgtacgacttcagaaacaagacagggggatcttccaccgttgtgaatccgagcgaaggcgcttggtccatctctaactggtttagcgggctgcttgattggctgggaggccccatgaaggccattatcaaaatcctcgggttcattgccatcggagtcgtgtgctttattctgttcatgatcctcattcggatcgctgtcaattccatcaacattaagaaaaagaattga

SEQ ID NO: 14369 - RNA, 3945 nt, synthetic construct
  misc_feature 1..3945: note = derived and/or modified CDS sequence (opt5) from PTV(Adames)__DQ363407.1__GP
  source 1..3945: mol_type = other RNA
atgatcttcaccattctgaacgtgctcacaagagccatgctggtcatgagcatgtactcccttacgacctgggactctagctcccggaatgatatctgcttttctaacgacagccccctggagggcctcgtttattactgggaaacacactccaagaaacatgattataagaaacaggggtctcaaaagtgtcgcgtgggagacagcgataaaaagatgatttccaatgtgaccatcattagcctgatctctgagatccagaagtccattagcgaactttctctgtcctgcggcaacaatgacaacagcacagggcaggtcctcaccttcaatggactggaggatacaatcagaggcgactacattgtggattgtgttaccgggctgtatcagtctgacatcggagtgggcgtcggcctcgggcggattaaccacgatcatcaacaggtgaaaaataaggctgttgtgatcgacgaaaaagagaagatgatttccctgcttgagacgcagcagagcgaaaacgatatcaaaacccaagtcctgatgtccgagatcgaacagctcaagaatcagctgtctaagcgcagaaacgagcggggacaggagaaacgcgacgccgaaaaacttatgagcgacctgatggcgagaaattccgatctccggaaccacaatgtgattctgacagacgagatcagccaaattaagaacaacatcaccattcatcgcaatagaaacatgatgtctacaaccgtggtccctgctatcctgtccgttgccctcctgagctctagcgtgggcccgatcacggccgctccccctgattccacaatgattaatccctggcctcacgccaagaaccgggtggggaccggaatgtacaaatatgacgaaaatgatgagtctggctgccgccccatcagatacggggtcagctgtattggatttgacttcatgcttaagatggataaataccctttcttcaacgcttttatcggccacaagacaccgctggaatccttcgccgacaagattatcgagaaagaggaagagacctgcgaaatcggcaccaataaggagtttaaatgtttcgaggaacgggcgtatattaaggggacatgccccacgaacatcaatgccgtgcattacattgataacaaaggaaagctccgctatgttaagtgtaaagagaatctggaaatgaccgaggactgcgctttttgtagaaagatcaaaaagaaagccggccagagcgtgcaggtccaaaagacatctgtgcctcttcaggatgctatttgccaggaaaactccgacatctacagcgggcccaagattcctttcaaaggagtttgcaagatcggcctgatcaaatataaggagtgtaaatttaagacctcttcctacgaaacaattagcttcatcaccctcaaggggaaaggaaagatttatatcgagcacctgatgctgaaaaatattgaggtggtcacgaacgtgtccttcgtctgctacgaacatgccggccaggacgatgagcaagaagtggagcaccgggcgctcaagagagtttctgtgaatgactgtaaaatcgtcgataacagcaagcagaaaatctgcacaggcgaccacatcttttgtgagaagtacgattgctccacctcttatcccgacgtgacctgtattcatacaccggggagcggacctctgtacattaaccttatgggctcctggatcaagccccagtgcgttgggtatgaacgcgtgctggtcgatcgggaggtgaaacagcctctcctggtgcccgaacaaaattgtgacacatgcgttagcgagtgtcttgatgaaggagtccacattaagtctacaggcttcgagatcacgtccgccgtggcttgcagccatgggtcttgcatctccgcccaccaggaggctagcacctctgtgattatcccctaccctggcctgctcgccagcgtcggaggcagaattgggatccatctgtcccacacaagcgactctgcctccgtgcacatggttgtggtctgtccgccccgcgatagctgcgctgcgcataactgtctgctctgctatcacggcattctgaattaccagtgtcattccaccctttctgccatcctgaccagctttctcctgatcctgttcatttataccgctttttccgtgacgaccaacgttctttacgtgctccggctgatccctaaacagctgaagtctcccgtcggatggctcaaactgttcgtgaattggcttctgacagccctcagaattaagacccgccgggttatggggagaatcaaccaacgcattggatgggtggaccaccacgatgtcgaacggcctagacatcgcgagcccatgcggagatttaagacaaccctgctgcttacgctcatcatggtgacaggcgggaatgcctgcagcaacaccgtggtcgctaattccaaacagacacggtgtgttcaggaaggctctaacaccaagtgcagcattaccgccacaatcacgctgcgcgcgggagtgatcggcgctgagtcctgtttcattatcaaagggccgatggaaaatcagcaaaagaccattagcatcaaaacaatttcttccgagaccgtgtgcagagagggaagctctttttggacatccctgtacatccctagctgtctctcttcccggagatgccacctggtcggcgactgcgtggggaacaagtgtcagagctggcgcgacgatcagctttcccgggaatttagcggagttaaggacaatcatatcatgaacgagaataaatgctttgaacaatgtggcgccattgggtgcggctgtttcaacatcaacccctcttgcctgtatgtgcacgcctacctcaagagcgctagaaatgaggccgtccgcgtgttttcctgttctgattgggttcatagagtgagcttcgaagtcaaaggacctgacggcgagatggagctggtgaccctggggtcccttggaacgaagttcctcaactggggcacactgtctctgagcctcgatgctgaagggatttccggaaccaattctatcagctttctggagtccagcaaaggcgggttcgccctttatgacgaaggctactctgagattccccgggagggatttctgggcgaaatccgctgctccagcgagtctgcggccatctccgctcacaagagctgtattagagcccctgggctcatcaagtataaacccatgaccgatcagattgaatgcacagcttccctggttgacccgttcgccatctttctgaagggatctcttcctcagacccggaacggccagacattcacgagcaccaaagataagaaaacagtgcaagcgtttaccaatggggccattaaggctctcctgtccatcaacctggacgatcacgagattatcttcatcaataaagtcaagagctgtgacgccacatttctcaacgtgtctggatgctactcctgcgattatggcgctcatgtgtgtgtcaaggttaaaagctctgaaagcgccgacttctttgccgagtccgaggacaagaccacggtgctgtctttccccattcagagcggcacccgcgattactgccaggtgcttcactttcagaaacccctggtcgacgaaagactctcctactcttgtgggagcgagcctaagctgatcgtgattaaaggaacactggtttatatgggcgtgtacgatttccgggacaagaccgggggatccagcacagtcatcaatccgtctgaaggcacctggtccattagcaactggttctccgggcttctggattggctcggaggccccatgaaggctatcctgaaaatcctcggctttattgcgatcgggattgtgtgcttcatcctgtttatgattcttatccgcatcgccgttaattctattaacatcaagaaaaagaattga

SEQ ID NO: 14370 - RNA, 3942 nt, synthetic construct
  misc_feature 1..3942: note = derived and/or modified CDS sequence (opt5) from PTV__M11156.1__GP
  source 1..3942: mol_type = other RNA
atgatcttcaccattctgaacgtgctcacaagagccatgctggtcatgagcatgtactcccttacgacctgggactctacaagccggaatgatatgtgcttttccaacgactctcccctggagggcctcgtttattactgggaaacccacagcaagcgccatgattataaaaagcaggagtcccaaagatgtcgggtgggggactctgataaaaagatgatcacaaatgtgaccattatcagcctgatttccgaaatccagaaaagcatctctgagctttccctgagctgcgtcaacgacgataattctacaggacaggtgctcaccttcaacggcctggaagacacgattcgcggggattacatcgttgactgtgtgaccggactgtatcagtccgatattggcgtcggggtgggactcggcagaacacaccatggccaccaacagatgaagaataaggctgttgtgatcgacgagaaagagcggatgattagcctgcttgaaacccagcagtctgagaacgatatcaagatgcaagtcctgatgtccgaaattgagcagctcaaaaatcagctgagcaagaaacgcaacgagagagggcaggaaaagcgggacgccgagaaggtgatgtccgaccttatggcgcgcaattctgatctgagaaaacataacgacatcctcacagctgaaatcagccaaatgaagaataaaaacaccattcagcggaataagaacacggtgtccacaaccgtcgttcctgccatcctgagcgtggccctgctctcttccagcgtggctccgattatcgccgctccccctgattctcccatgattaacccttggccccacgccaaaaatcgcgtcggaacaggcatgtacaagtatgacgagaacgatgacagcgggtgcagacctatccggtacggagtgtcctgtatcggctttgatttcatgctgaaaatggacaagtacccgtttttcaatgcgtttattgggcacaagacaccccttgaatctttcgccgataaaatcattgagaaggaggaagagacctgcgaaatcggaaccaacaaagagtttaagtgtttcgaggaacgcgcttatattaaaggcacgtgccctaccaatatcaacgccgttcattacatcgacaataagggcaagctgagatatgtgaaatgtaaggagaacctcgaaatgacagaggattgcgctttttgtcggaaaattaagaaaaaggccgggcagagcgtccaagtgcagaagacctccgttcccctgcaggacgcgatctgccaggaaaatagcgacacatactctggacctaaaattcccttcaagggcgtgtgcaaaatcgggcttattaagtataaagagtgtaagtttaagacctccagctacgaaacggtctctttcatcacactgaaagagaagggaaaaatttatatcgagcacctcatgctgaagaacatcgaagtggtcaccaatgtgtccttcgtttgctacgagcatgtgggccaagatgaacaggaggtcgagcacagagccctgaaacgcgtgagcgttaacgactgtaagattgtggataattccaaacagaagatctgcaccggggaccacgtcttttgtgaaaagtacgattgctctacaagctatccggacgtgacctgtattcatgctcctggatccggccccctctacatcaacctgatgggctcttggattaaacctcagtgcgtggggtatgagcgggttcttgtcgatagagaagtgaagcaacccctgctcgcccccgagcagaattgtgacacatgcgtgagcgaatgtctggatgagggagtccacatcaaatccacgggcttcgagatcaccagcgctgtggcctgctctcatgggtcctgcattagcgcccaccaggaaccttctacatccgttatcgtgccgtaccccggacttctggctagcgtcggcgggcgcattggcatccatctctctcacaccagcgactccgcgagcgtgcacatggttgtggtctgtcctccccgggattcttgcgccgctcataactgtctgctgtgctatcacggcattctcaactaccagtgtcattccacactgagcgccatccttacctcctttctgctcatcctgttcatttatacggtgttttctgttaccacaaatatcctgtacgtgcttagactcattcctaagcaactgaaaagccccgtcggctggctgaaactcttcatcaactggctgcttaccgccctgcgcattaagacacggaatgtgatgagacgcatcaaccagcggatcgggtgggtggaccaccacgatgtcgagagaccgcgccatcgggaacctatgagacggtttaagaccacgctcctgctgacacttattatgatgaccggaggcaatgcttgctccaacacagttgtggccaattctaagcagacccgctgtgtgcaggaggggagcaacaccaaatgctccatcacagcgacgattaccctcagagctggagtcatcggcgccgaatcttgtttcattatcaaggggcccatggagaatcaacagaaaacaattagcatcaagaccatctccagcgagacagtgtgccgggaaggatcttccttttggaccagcctgtacattccttcttgtctgtccagcagacgctgccacctcgttggagactgcgtgggcaacaagtgtcagtcttggcgggacgatcaactgtccagagagttcagcggggtcaaagacaatcatatcatgaacgaaaataagtgctttgagcagtgtggagccattggctgcgggtgtttcaacatcaatccctcctgcctttatgtgcacgcttacctgaaaagcgcccgcaacgaagctgttagagtgttttcttgtagcgattgggtccatcgggtgtccttcgaggttaagggacctgacggcgagacggaactcgtgacactggggtctcccggcaccaaattcctgaactggggaacccttagcctctccctggatgccgagggcatttctgggacaaatagcatctcctttctggaatctagcaagggaggcttcgcgctctatgacgaggggtacaacgagatcccgcgcgaaggatttctgggcgagattagatgctccagcgaatctgccgctatctccgcccacaagagctgtattcgggctcctgggcttatcaaatataagcccatgaccgatcagattgagtgcacagcctctctggtcgaccccttcgcgatctttctcaaaggctccctgcctcagacgcgcaatggacaaaccttcacaagcaccaaggataaaaagacagtgcaggcctttaccaacggcgctatcaaagccctgctttccattaatctcgacgatcacgaaatcgtgttcattaacaaggtcaagaattgtgacgctacgtttctgaacgtttctgggtgctacagctgcgattatggagcccatgtgtgtgtgaaagtcaagtccagcgagtctgccgacttctttgctgagtccgaagacaaaaccacagtgctgagcttcccgatccagtctggcacccacgattactgccaggttctccattttcaaaagcccctggtggacgagagacttagctactcctgtgggtctgaacctaaactgattgtcatcaagggaacactcgtgtgcatgggcgtttatgatttccggaataagaccggcgggagctccacagtggtcaacccctctgagggagcgtggagcatttccaattggttcagcggcctgctggactggcttgggggacctatgaaagccatcctgaagatcctcggctttattgctatcgggattgtgtgtttcgtcctgtttatgatcctcattcgcatcgccgtgaactctatcaatattaaaaagaaaaactga

SEQ ID NO: 14371 - RNA, 3852 nt, synthetic construct
  misc_feature 1..3852: note = derived and/or modified CDS sequence (opt5) from Phlebovirus(CoAr170255)__HM566149.1__GP
  source 1..3852: mol_type = other RNA
atgtacaagctgatcaccaacattctcaaactgagcgtggtctccgccatgtattctatcatgttctgggaccccacaggcattagcaagctgtgcctgtccaataactctcctctcgaggggctggtttactattgggaaaatacgatgagagagggagaatttaaacgggagaagcgcaaaaagtgtagacttggcatcagcgaaccggctcccgtgtccaaccagaccattgtgtctctgatcgaggaggtccaaaagagccctgccgaaatgatcctcatttgcgaggcgaatgggaactccacaggaagctctctgtccttcgatggcctgagcgacaatgaaatcaaaccctctattgtggattgtaccacaggggaccggacctccgatctccgcgttctggtgggaaagggcatctttgagaaaaagatgagcatgtctaacgagattgacagagtcgtgtcccttgaagatcaccttcagcgggagaaagaactcgttcagacattccaggacctgcatcacaatgagagcgaaaagaacaaacttctggagcatgagctcgaaaatgtgcgccaacagctgaagagagagcgggaatccaacaagatcaaaatgtggaccacgaagcgccctgagattaccacaatcggcctgaccacaaccatcgctacgattctcctggcctctcagagcgtcgcctccagcgtgcccatgcctgggcagcttaatacatggccgcacgctaaaaacagagtgggaggcggggtctttaaggccaatgatgacgatgaagactcttgcaaactgatcgattacggaattgcttgtcatggcttcgactatctcctgcggaccgacatctacccctttttcaacgcccacgtttcccaccgcagccttctggaggcgtctaacgaggggattatcctcaaggatgaagccagctgcgagatcgaaacaaataaggactttaaatgttatgaggaaagagctttcctgaagtggtcctgccctcatctggtgaactctgcccactttattgatagcaaaggaaagctccggatcattaaatgtaaggctgagtacgagatcaccgaagactgcacctactgtcgcagaattaagaaaaaggccgcgcaacagaaacaggtgtataagtccagcatcgccctgcaggatgctgtctgccaagaaaattctgactactatgatggcccccggatcacattcacgggcgtgtgcaaaattgggaccatggagtacaagaagtgtaaacataagtccagctcttttgagaacatcggattcattacaatcagagacaaaggcaagtattacattgagaatatgcgcaccaaaaacatcgaaatggtttccaatgtgagcttcatttgctataaccacaatgggcaggatacagagaaggacgtccggcttctgaagagagtgaaacctggagattgtaaggttgtggacgactccaaaaccaagcactgcacgggcgatcatgtcttttgtgaaaaatacgactgcacaaagtcttaccccgaggccacctgtatgcacgctccggggagcggacctatcctcgtgctggtcatgggcgtgtggttcaaaccccagtgcgttggctatgaacgcgtgcttgtcgagcgggaggtgaaggcccctgttctgatccaagaaaaggattgtgatacctgcgtgtttgagtgtctcgaagacaaaattctgatcaagtccacagggttcaaaatgatttctgccgtcgcttgcagccatggatcctgcgtgagctctcaccagtcccccagcacctttctgtacatcgactatcccggcctcacagcgtctgttgggggagagattggcctgcatctttcccacacggatgacagcgtgtctgtccacaagaaaatccattgtcctgccagagatccgtgcgaagctcacagctgtatcgtgtgctaccatgggctggtgaactatcagtgtcacaccgtcctctcctacagcgtggtttctttcctgctggtgtgcatgatgtatcttgcctttttcattacatcccgcctcctgtttttcctgcggatcatgcccagacgcctccggaatcctattagctggctgacccttctgatcagatgggtcctccagacactgctggccattcttcgcctctcctttaagaagctgtctgagaccatcggctggaacagccccaataaccggcaacagatggacgtggaggctaatagacggcctctgcgcagataccggacgaccttcatcctcacactgctttttgttggactgacctccgcctgttctaacacagcggtgagcaactccaaacagaccaagtgcctccagtctggcgggagcgtcaaatgttccattacggctacaatcaccctgaaggccggaacaattggcgccgaaagctgcttcatcattaaagggccctctgagaatcaacagaaggtgatcagagttaagaccgtgtccagcgaaaccgtctgtcgcgagggatcttccttctggacaggccagtttacgccgagctgcgtgtcttcccggagatgccacctggtgggggattgtgtcggcaaccgctgccaggcttggagagacgaagttgtgagccgggagttcggaaatatgaaagataacaatgtgatgtccgagaacaagtgttttgaacaatgcggcgccgctgggtgtggatgcttcaatatcaaccctagctgtctttacgtccattctacctttaaaagcgtgcgcagagaggccattcgggttttcaagtgcaatgactgggtgcaccgcctcacatttgaagtctccggcccctctggggagaaagacagaatcgtgctgaacagcctgtccaccaagttcctccagtggggaacaatttctctgagccttgatgcggagggcatctccgggaccaattcttatagctttctggaatccaacaagggcggattcgccattcatgacgaggaatttagcgagatccctcgggaaggctacctcggggagattcgctgttcttccgagagcgctgttatcgccgctcacaaatcttgcatcagagcccccaatctgattaagtataaacctatgacggatcagatcgactgtacagcgtccctggtggatcccttcgccatttttcttaagggaagcctcccgcagtcccggtctggctacaccttcaccagctccacagacaaaaagaccgtccaggctttcaacagcgggtctatcaaagccctgatttccatcaatatggatgaccatgaaatcgagtttctgaacgatgctgccgactgcgatgccacattcctcaacgtgagcggatgctattcttgtaattacggcgctcaagtttgcattaaggtgcgcagctccaagtctagcatcttttcctctaacaataacgacaatagcattgtcatcaacttcgatgcggaccaggggacgagagactattgtcggattatccactttaatggccctctggtggatgaaacccttcactactcctgcggaggcgagagcaaactgctccaaatgaaggggtctctgatcacagtgggaccctacgacttcagaaacaccacaggcgggaaatccaccattgtcaatccccatgaagagagctggaacctgttttcctggttctctggacttctggattggctcggcggccctctgcgcgccatcctcaagattgttctgatcattatcattgggatcatcctttttattgtggtggctttcctgatccggctcgtcatttttaatgtgctgctgaaaagcaagaagaactga

SEQ ID NO: 14372 - RNA, 3873 nt, synthetic construct
  misc_feature 1..3873: note = derived and/or modified CDS sequence (opt5) from Phlebovirus(CoAr171616)__HM566154.1__GP
  source 1..3873: mol_type = other RNA
atgttccagatcatttacctgctcaccaagctgtatcttgtgagctccatgtactctatcatgttttgggagaacgaaaatattagcaaactgtgcctctccaacaattctcccctggagggccttgtctattactgggaaaacgttatgaaggagggggacttcaaagaagagaagcggaaaaagtgtagaatcggacctagcgatctgaagcgcgtgacaaatcaaacgctcaccacactgattgaggaagtgcagaaatccccgtctgagatccagctgctctgcgaagaggacggcaacaagaccgggatcagcatgtttttcgatggactgtccgacgatattagcacaccctctatcgtcgactgtaatggcaacattagaatctccgatcttcgggtgcaggttgggcgcggacactttgagaaagaaaatgagattagaaagatcgaagagattgtgaccctggaagacgatctccggcgcgagagagacctgaacaaacttctgcaagatctcaataagaaggacgccgaggaacggcgcatcatcgagcatgaactgacaaacatgagagagcagctgcagcgggaacgcgagagaagcaaacagcaaattaaggagcacgagaaaatcgaagtcaataaccataaggaacctgctacccacctcaatgtgtctaaactgcttacgattggcctgctcgcccagcaggttggccaggtgatcgcgaccgagcccgggcaactgaacacatggattcatgctaagaaccggatcggaaaaggcctttataagaccgaagatacagacgaggacgggtgccgcggactggattacggcgtctcctgtctcgggttcgactatctgctgagaaccgatatctaccctttcttcaatagctttgtgtctcacctctccatgctggaggccagcacggaagaccttattgagaaggaaggaacatcctgcgagatcgagaccaacaaagaatttaagtgttacgaggaacgggcctttattaaaggctcttgcccccacctggtgaatagcgctcatttcctcgataacaagggcaaactgagaatcgtcaagtgtaagacagactttgagatgaccgaagattgcaccttctgtcgcaaaattaagaaaaagaactcccagcacaaacaggttttcaagacaagcatcgcccttcaagacgctgtgtgccagaataattctgatctgtataacgggcctcggatcgtgtactccaatgtctgcaagattggaatggtgagctataaacagtgtaagtctaaaacgagctcctacgagtctgttggctttgtgatcctcaaggggaaaggaaagttctatattgagaacatgaagatcaaaaatattgaagtcatcgccaacgtgagctttatttgccatcagtaccaaggccaggacgggaccgagaaggaacagagatccctgaaacgcatcagcgttggagagtgtaagtctgtgaatccgcagaaaacaaagcactgcaccggcgatcacgtcttctgtgaaaaatatgactgcacaaagtcctaccccgaggtgacctgtctgatggcgcctggcagcgggcccatcctcgtccaaattatgggatcttggatcaagcctcagtgcgtgggctacgagaaagttctggtggaacgggaggtcaagtcccccacgcttacagaagagagagactgtgatacctgcgtgtatgaatgtctggaggacaaaattctcatcaagagcaccgggtttaaaatgatttccgccgttgcttgctctcatggaatgtgcgtgagctcccaccaggagccgtctacattcctgtacatcaactatcctggcatgagcgcctccatcgggggcgaaattggactgcatcttagccacaccgatgactctctctccctgcataaggtcatcagctgtccctctcgcaatccttgcgatgtgcactcctgtattatctgctaccacggcattatcaactatcagtgtcatacagctctgagctacacgatcgtggccttttctttcattagctttctctatctgaccttcaaggttatctcccaacttctgtacacatttaaagtcgtgcccaagaaactcaaggggcccttctactggatgggatatctgattaaatggatcgtgaagaccattctgggcgtcgtgcggaacacatttttcaccatgagcaatagaatcgggtgggagcgccgggacgaaatccacgaggatattgaggcgaaccctagacgccatcttcagcggttcaagacgacctttgttctcacaatgctgatgatcaatggaggcctgtgctgttctaacaccctcgtgtccaatagcaaacagacaagatgcgtccagtccgggaacgaagtgaagtgttctgttagcgccaccgtggtcctgaaagctggcgtgattggagccgagtcctgcttcatcattaagggcccgtctgaaaatcaacacaaaatgatcagcgttcggacgctttcctctgagacagtgtgtcgcgaaggggctagcttttggaccggacacttctcccccagctgcgtctcttccagacggtgccatctggtgggcgagtgtcacgggaacagatgccagagctggcgcgacgatcagatttctcgggagtttggaggcgtgaaggacaataacagaatgtccgaaaataagtgtttcgagcaatgcgggagcatcggctgtggatgctttaacatgaatccttcttgtctctacgtccatacaaccctgaaatccgcccgcaacgaagccgttagagtgttcaagtgcaatgattggatccaccggctgaactttgaggtgattggccccagcggggaaaaagacgtcgtgacccttaactccatgagcacaaagttcctccagtggggaacgatctctctgagcctggatgctgagggcattaccgggacaaattcctattcttttctcgagagctccaaaggaggcttcgcgatccatgacgaagagttttctgacattcctcgcgaagggtacctgggcgagatcagatgtagctccgaatctgccgttatcagcgctcactccagctgcattcgggcccccgatcttatcaagtataaaccgatgaccgaccagattgagtgtacatctaccctgatcgatcctttcgccattttcatgaagggatccctcccccagacgcgcagcggctacacatttacctcttccaaggacaaaaagaccatccaggctttcaacacaaatagcatcaaagccctgatttccctgaaccttgatgaccacgagatcgtgtttgtctctgatcaaaccaattgcgaatgcacattcctcaacctgacggggtgttatagctgcgactacggagcgcatgtgtgttttagaattaagtccgataaaaagggcgttttcgtgagcaataccgaggctaaggacatctcttttgggttcgaagtcctgacaggaacccacgattactgccagattcagcattttaactcccctagcgtgtataaaacactctcttacagctgtggcggcgagtccaagctgcttgttatcaaagggtctctgattaccatcggaccccacgactatcggaataagacgggcggggccagcaccgtggtcaacccttccgaggaaggatggtctgtgacaaattggatcggcgggttcattagctggctcggaggccccctgaaagccctgcttaagatcgctgtgaccattctggccggcgtcgttatctttctcattatctacttcttcctgcgcctcatcgctacaaacattctgatgaagaccaaaaagaattga

SEQ ID NO: 14373 - RNA, 3852 nt, synthetic construct
  misc_feature 1..3852: note = derived and/or modified CDS sequence (opt5) from Buenaventura virus(CoAr3319)__KP272002.1__GP
  source 1..3852: mol_type = other RNA
atgtacaagctgatcaccaacattctcaaactgagcatggtgtccgccatgtattctatcatgttctgggaccccacaggcattagcaagctgtgcctgtccaataactctcctctcgaggggctggtctactattgggaaaatacgatgagagagggagaatttaaacgggagaagcgcaaaaagtgtagacttggcatcagcgaaccggctcccgtttccaaccagaccattgtgtctctgatcgaggaggtgcaaaagagccctgccgaaatgatcctcatttgcgagacatccgggaatgcgaccggaagctctctgtccttcgatggcctgagcgacaacgaagtcaaaccctctatcgtggattgtgctacaggggagcggacctccgacctccgcgttctggtgggaaagggcacatttgagaaaaagatgagcatgtctaatgaaattgatagagtcgtgtcccttgaggaccatctgcagcgggaacgcgagctcgttcagaccttccaggatctgcaccacaacgaaagcgagaaaaataaacttctggagcatgaactcgagaacgtgagacaacagctgcggcgcgaaagagagtccaataaggtcaaggtgtggacgaccaagaaacctgaagtgacaaccatcggcctgacaaccacgattgccacaatcctcctggcctctcagagcattgcttccagcgtccccatgcctgggcagcttaacacctggccgcacgccaagaatcgggttggaggcggggtgtttaaagctaacgacgatgacgaggattcttgcaagctgatcgactacggaatcgcctgtcatggcttcgattatctcctgcgcacagacatttacccctttttcaatgcgcacgtgtcccacagaagcatgcttgaggcctctaacgaagggatcattctgaaagacgaggctagctgcgaaatcgagaccaacaaggatctcaagtgttatgaggaacgggcctttctgaaatggtcctgccctcatctggtcaattctgctcacttcattgacagcaagggaaaactccgcatcatcaagtgtaaagccgagtacgaaattaccgaggattgcacatactgtagacggatcaagaagaaagcggcccaacagaaacaggtgtataagtccagcattgctctgcaggacgccgtttgccaagaaaactctgattactatgacggccccagaatcacgtttaccggcgtgtgcaagattgggtccatggagtacaaaaagtgtaagcataaatcttcttccttcgagaatgtcggatttatcacaatccgcgataagggcaaatattacattgaaaacatgcggatcaagaatattgagatggtgagcaacgtttccttcatctgctataatcacaacgggcaggacaccgaaaaagatattagacttctgaagcgcgtgaagccttctgactgtaaagtcgtggatgacagcaagtccaaacactgcacaggagaccatatcttctgtgataagtacgactgcaccaaatcttaccccgaggctagctgtatgcacgccccgggctccgggcctattctcgtcctggtgatgggagtttggtttaagccccagtgcgtgggctatgaacgggtccttgtggagagagaggttaaagtgcctgtcctgacgcaagaaaaggattgtgacacatgcgtgttcgagtgtcaggaagataagatcctcatcaaaagcaccggctttaagatgatttctgccgtggcttgctcccatgggagctgcgtttcttcccaccagagcccctctaccttcctgtacatcgactatcccggactgacagcgagcgtcggcggggagattggactccatctgtcccacaccgatgacagcatctctgtgcacaaaaagattcattgtcctgcccgcgatccgtgcgaagctcacaattgtgtgatctgctaccatggccttatcaactatcagtgtcacacatttctgtcctacagcgtcgtgtccttcctctttatttctgttctgtatctgacgttctttatcgtgagccggcttctcctgttcctgaaaattatgcccaagagactcaagaatcctatctcctggctgacccttctgattcgctgggtcctccaaacactgatcaccatcctgcggctttcttttaaaaagctcagcgagacaattgggtggaccacgaacgacaatagacagcacgtggatgttgaggccaaccgccggcccctgagacggtaccgcaccacattcatcctgaccctcctgtttattggccttgcctccggatgctctaatacagctgtgagcaactccaaacagaccaagtgtctgcagagcggcgggtctgtcaaatgctccatcacggccacaattaccctcaaggcgggaatcatcggcgctgaaagctgtttcattatcaaggggccttctgagaaccaacagagagtgattcgggttaaaacaatctccagcgaaaccgtgtgcagagagggatcttccttctggaccggcctgtttacacccagctgtgtctccagccgccggtgccatctggtgggggactgcgtgggcaatagatgtcagtcttggcgcgatgaagtcgttagcagagagttcggaaacatgaaggacaataacgccatgtccgagaataaatgctttgaacagtgtggcgccgctgggtgcggatgtttcaacattaatccgtcttgcctttacgtgcacagcgtgtttaagtccgtccggcgcgaggccatcagagtgttcaaatgtaacgactgggttcatcggctcacgtttgaagtgtctggccctagcggggagaaggatcgcattgtccttaattccctgtctaccaagttcctccaatggggaacaatcagcctgtcccttgacgctgagggcatcagcgggaccaactcttattcctttctggaaagcaataaaggcggattcgccattcacgatgaggaattttctgagatccccagagaaggctacctcggggagattcggtgctccagcgagtccgcggtgatcgccgctcataagtcttgtattcgcgcccctaacctgatcaaatataagcccatgacagaccagatcgattgcaccgctagcctggttgaccctttcgccatttttcttaaaggatccctcccccagagcagatctggctacacgttcacatccagcaccgataagaaaaccgtgcaggcgttcaattctggggccatcaaggctctgattagcatcaacctggacgatcacgaaattgagtttctctccgacacagccgattgtgacgctaccttcctgaatatctctggatgctatagctgcaactacggcgcccaagtctgtatcaaggtgcggtcctctaaaagctccatttttagctctaacaataacgataattccatcgttattaacttcgacgccgaacaggggacacgcgactattgcagaatcattcactttaatggcccgcttgtggatgagacgctgcattacagctgtggaggcgaatccaagctcctgcagatgaaagggtctctgatcaccgtcggaccttacgacttccggaacacaaccggcggaaagagcacagtggtgaatccccacgaggagtcctggaacctttttagctggttcagcgggctgctcgattggctgggcggccccctcagagctattctgaaaatcgtccttatcgttattatcgggattatcctgtttattgtggtggtcttcctcatgcgcctggcgatcctgaatgtgcttctgaagtccaagaaaaactga

SEQ ID NO: 14374 - RNA, 3942 nt, synthetic construct
  misc_feature 1..3942: note = derived and/or modified CDS sequence (opt5) from Cocle virus(GML244915)__KP272034.1__GP
  source 1..3942: mol_type = other RNA
atgatgttcacccacctggacgtgctcacaagagccatgctggtcatgagcatgtactcccttacgacctgggattctatccggcgcaacgacatttgctttagcaatgattctcccctggagggcctcgtttattactgggaaacacagtctaagatgcatgagtataaaaaggaagacagccaaaaatgtagagtgggggattccgagaagaaaatgatctctaacgtgaccattatcagcctgatttccgaaatccagaaaagcatctctgagctttccctgagctgcggaaatgacgataactctacaggccaggtcctcatgttcaatgggctggaggacaccattcggggagattacatcgtggactgtctgacaggcctctatcagtccgatattggggttggagtgggcagcggcaagaccaaacacgaccatacgaagctgcgcaacaaagctgtcatcattgatgaaaaggagaaaatgatctctcttctggaagcccaacagtccgagaatgacattaagacccaggtgctcatgagcgagatcgaacagctgaagacacaacttctgaacagacggtccgagcgcgggcacgaaaagagaaagaatgaggaaatcgtttctgacctcatggcgcggaacagcgatctgcgcaaacataatgacattctgaaggatgagatggaccagatcaaagagaacctcaccatttttaagtccagaaatgctatcagcacaacctctgtgcctgccattatgtccatcgccctgcttagctctagcgtcatgccgatcattgctgccgtgtccgattctcccatgatcaacccttggccccacgctaaaaatcgggtgggaagcggcatgtacaagtatgacgataacgacgaatccgggtgccgccctattagatacggagtcagctgtatcggcttcgatcacatgctgaagatggacaaatacccctttttcaacgcctttattgggcataagacgctcctggagtctttcgttgataaaatcatcgaaaaggaggacgaaacatgcgagattggaaccaataaagagtttaagtgtttcgaggaacgggcgtatatcaagggcacatgccctcacaacattaatgccgtgcattaccttgacaacaaaggcaagctgcgctatgtgaaatgtaaggaaaatctcgagatgaccgaagattgcgctttttgtagaaaaatcaagaagaaagccgggcagtccgtccaggtgcaaaagaccagcgttccgctgcaggacgctatttgccaggataactctgacatctacacaggaccccggattccttataaaggcatgtgcaagatcgggctggtgaaatacaaggagtgtaagtccaaaacgagctcctatgagaccgtctctttcatcacactcaagggaaaaggcaagatttacatcgaacacctgatgcttaaaaatattgaggtggttaccaacgtgagctttgtctgctacgaacacgccgggcaagtggagcaggaggtcgaacatagagcgctgaagcgcgtgtccgttaatgattgtaaaatcgtggactctagcaagcagaagatttgcacaggagatcacgtcttctgtgagaaatatgactgctccaccagctaccccgatgtgacgtgtatccaggcccctggctctggccccctctatgttaacctgatggggtcctggatcaagccgcaatgcgtgggatacgaacgggtccttgtggagagagaagtgaaacagcctctgctcacacccgagcagaattgtgatacctgcgttagcgagtgtctggacgaaggcgtccatattaagtctaccgggttcgagatcacatccgctgtggcctgcagccacggatcttgcattagcgctcatcaggaagcctccaccagcatcattgtgccttatcccggcctgctcgcctctgtcgggggcaaaatcggactgcacctttcccacacaagcgactccgcttctgtgcatatgatcgttgtgtgtccccctcgcgatagctgcgcggcccacaactgtctgctctgctaccatggcatgctgaattatcaatgtcactccacgctgtctgctattcttaccagctttctcctgatcctgttcatttacacaaccttttccttcatcacaaacattctctacctgcttcggctgctcccgaagcagctgaagtctcccatcgggtggctgaaactttttatcaattggcttttcaccattctgagaatccgcacgaagtatctgatgggacggctcaaccagagaattggctgggtcgagaaccacgacgtggaacgccctcggcccagagagcctatgcgccggtttaaaaccacactgatgcttaccatgctgatgatcacagggggatacgcctgcagcaataccgttgtggccaactccaagcagacgagatgtgtccaagagggcagcaatacaaaatgctctgtgaccgctacagttaccctcaaggccggggtgattggcgcggaatcctgtttcgtcatcaagggacccatggagaaccagcagaaaaccattagcatcaagacagtgtcttccgaaacggtgtgccgggagggcagctctttttggacctccctgtatatcccgagctgtctgtccagccgcagatgccatcttgtcggggactgcgttggaaatcggtgtcagtcttggagagaagatcaactcagccgcgagttctccggcgtgaaagacaaccagattatgaatgagaacaagtgctttgaacagtgtggggctatcggatgcggctgtttcaatattaacccttcttgcctgtacgtgcacgcctatctgaaaagcgcccggaatgaggctgtcagagtgttttcctgttctgattgggttcatcgcgtgagcttcgaagtcaaggggcccgacggcgagacagagctcgtgaccctgggatcccttggcacaaagttcctgaactgggggaccctctctctgagcctggatgccgaaggaatcacgggcacaaattcccttagctttctcgagtcttccaaagggggattcgctctgtacgacgaaggctttagcgagattcctagagaagggttcctgggcgagatccggtgctcctccgagagcgccgcgatctccgcccacaagtcttgtattcgcgctcccggactcatcaaatataagcctatgaccgatcaaattgaatgcaccgccagcctggttgacccctttgctatcttccttaaaggctccctgccgcagacaagaaacgggcagacctttacaagcacgaaggataaaaagaccgtgcaggccttcacaaccggagcgattcgggccctcctgtctatcaatctggacgatcatgagatcacatttatttccaagatcaaaaactgtgaagctaccttccttaacgtcagcggctgctactcttgcgactacggggcccacgtgtgtattaagatcaaaagctccgagtctgctgatttttatgccgaaagcgaggacaagacgaccgttctgtccctccctgtgtctagcggaacacaagactactgccaggtcctgcacttccagaaacccctcgtggatgagcgcctgtcctatagctgtggctctgaacccaagctcatggtgattaagggcaccctggtctacatgggggtttatgactttagaaataaaacaggaggctccagcaccgtggtgaacccttccgatgcctcttggagcatcgctaattggttctccgggctcctggactggctgggaggcccgcttaaggcgattctgaaaatcctcgggttcatcgccatgggagtcgtgtgctttattctgttcatgatcctcattaagatcgctgttcggtctgtgaacatgaaaaagaagaattga

SEQ ID NO: 14375 - RNA, 3873 nt, synthetic construct
  misc_feature 1..3873: note = derived and/or modified CDS sequence (opt5) from Campana virus(VP-334K)__KP272041.1__GP
  source 1..3873: mol_type = other RNA
atgctgcacttcatcaccattacaacgaagtttctcgccgtggctagcatgtacaacctgctttattgggaccccaatggcctgtccagactctgcctgtctaacaatagccctcttgaggggctggtctactattgggaaaacctcatgaaagagtccgatttcaagaaagacaagaaaaagcattgtcggatcggaacctctgttgccgcgccggtgacaaatgaaaccctgacaaccctgattgaggaagtgcaaaagagcccctccgagatcattctccaatgcgagtctcgcaacaatgatacaggcaacagcatctactttgacgggctggctgatgacatcgaatcccctagcattgtcaattgtgagtctggaaaaagagaatccgatcttcgggtgctggttggccaggggctcaagaaagagatcattctgaacgagatcgccgccattgaccgccaggctagccttgaagaacacctgagaggagaaaaggccctcacctctctgctgcaggagatctccaaacaagatgaagctgagcggaagcgcctcgagcatgaagtgagctctctgagacagcagcttatgaatgagcgggaagagaacaagaaacgcaagaatattcccgccttcggcgtctccagcacgacctcctctagcctgatgaacatctccagagtggttacaatcggcctcctgagccagcaagcgattgccaatccttctcttcccggacaggtgaacacctggcctcacgctaaaaaccggatcgggcagggcctgtatcgcattgacacatccgatgaagacgggtgcagaggactcaattacggcgtcatctgtctggggtttgatcatctgctccggatggacctgtatccgttctttaacgcctacgtgagccacctttctctgctcgaggcttacaccgagaatattatccagaaggacgaaacggagtgcgaaatcgagggaggcaaagagttcaagtgttatgaggagcgcgcctacattaaaggcgtgtgcccccacagaatcaagagcgcgcattatctggatcaaaaggggaaacttcggattatcaagtgtaaagaaaacctggagctcacagaagactgcacctactgtagaaagattaaaaaggatcgcggacacacaaagcaggtctataaaacctccgttcctctgcaggacgccatctgccaagataattctgacgattacagcggccccaagatctcctttaaaggggtgtgcaagattggaatgatcgagtataaagagtgtaagtacaagtcttcttccttcgaaaccgtgggctttattacaatcaaagagaaggggaaattctacattgaagacatgaagctgaaaaacctcgaggtcacgaataacgtggcttttatctgccatcagtataccggacaggatggcacaaccgacgaagagaatcggcacctgaagagaatgagcgttaaggattgtaaaaacgtgaatagctccaagagcaaatactgcacaggcgaccacattttctgtcaggtctatgactgcaccaagtcctaccctgaggccacgtgtttcgtggctcccgggtctggaccggttcttgtgcaagtcatgggcagctggatcaaacctcagtgcgtggggtatgaaaaggtcctggtggagcgcgaagttaaaatgcccatcctcacagaggaacgggattgtgatacctgcgtgtacgagtgtaaggaggaccatattctgatcaagtccaccggatttaacatgatttctgccgtcgcctgcagccacggctcctgcgtgagcgctcatcaggacccttctacattcctgaatatcgaatatcccgggatgtccgcgagcgttggcggagagattggcatccacatctctcataccgatgactcccttagcctccacaaaaagatttactgtcccgccagagattcttgcgaagctcacaactgtatcatgtgctaccatgggctgattaattatcagtgtcacacagccctgagctacgccgtggtctcctttatgttcgtgagcatcgcttatgtgatttttaacgttctccgcctggtccttgtggccctgcatgtggtccctcggaaactcaagtctccgatcgactggctgatcctgcttattaaatgggtgttcctcctgctggcgaaggttatcagagcttttctcacgcacctgaacaccacaattggatggcgcgagcggcaaaataacttcgccgccgatcttgaagctcagagacgccccctgcagcggtttaagaccacagtgctcctgatgatgatgctgatctccgtcgtgagctcctgctctaatagcgttgtgtccaactctaaacagaccagatgtattcaaagcggctccaatacgaagtgctctgtcagcgccaccatcacacttaaagctggggtgatcggagccgagtcctgtttcgttattaagggccctagcgagaaccagcacaaaaccatcgtgattcggacagtctcttccgaaaccatctgccgcgaggggagctctttttggacgggccatttcacaccctcctgtctcagctctagacggtgccacctggtgggagactgcgtgggctccagatgtcaggggtggcgcgaagatgtcattagccgggagtttggaggcgttaaggacaataaccagatgtccgagaataagtgcttcgaacaatgtggggcggccggatgcggctgtttcaacatcaatcctagctgcctgtacgtgcataccattctcagatctgctcgcaacgaggccgtgagagtctttaaatgtaatgattgggtgcacaagctgacattccatatcaaagggcccaacggcgaagaggaagacgttgtgcttaatagcctgtccaccaagtttctctcttggggaaccatcagcctgtccctggactctgagggcattacagggacgaacagctattccttccttgagtctagcaaaggaggctttgctatccacgatgaagagttctccgaaattccgcgggaggggtttctcggagaaatccgctgcagctctgagtccgccgtcgtgagcgcgcacaagtcttgtattagagcccctggcctgatcaagtacaaacccatgaccgaccaggttgagtgctccgctagcctggtggatcctttcgccatctttattaaggggtccctcccccagacacggtctggctataccttcacaagctcccgcgacaaaagaaccatccaggcttttaacaatggagccattaaggccctgcttacgctgaacctcgatgaccatgaagtcatcttcagcgagtctgtgattacatgtgaatgcacctttctgaatatctccggctgctacagctgtaacttcggggctcaggtttgcttcaaaatcaagtctagcggaattggcgattttgtgtcctctagcgagaccgggaatatcctgttctcctttcctgtcaaatctggaacagaagactactgtcagattcagcacttcaacagccccatggtgtccgagagccttcaatattcttgcggcggcgagtccaagctgctcctgatcaaggggagcctcatttccgtgggaccgtacgattatcggaataaaaccggcgggtctagcacagtcgttaaccctgcggaagactcctggtctatctttaattggctgagcggattccttgattggctgggcgggcccctccgcgccctggtgaagattgctctggccatcatcggagcccttgctctgctctttattacgatcatgctggccagatccgtgattagcaacaccctctctcggaaaaagaaaaattga

SEQ ID NO: 14376 - RNA, 3594 nt, synthetic construct
  misc_feature 1..3594: note = derived and/or modified CDS sequence (opt5) from RVFV(ZH-548)__DQ380206.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctcctgtccgctcacgggaatccttgcatgaaggagaagctggtgatgaaaacccattgtcccaacgattatcagagcgcccactacctcaataacgacggaaagatggcctctgtcaaatgcccgcctaagtatgaactgacagaggactgtaatttctgccgccaaatgaccggcgcttcccttaaaaaggggagctaccccctgcaggatctcttttgccagtcctctgaagacgatggaagcaaactgaagacgaagatgaaaggcgtttgtgaggtgggcgtgcaggcgcttaagaaatgcgacgggcaactgtccacagcccatgaagtcgtgcctttcgctgtttttaagaacagcaaaaaggtgtacctcgataagctggacctgaaaaccgaggagaatctcctgcccgattctttcgtctgttttgaacacaagggacagtataaaggcacaatggactccgggcagaccaagagagagcttaaatctttcgatatttctcagtgccccaagatcggaggccacgggagcaagaaatgtaccggagacgccgccttttgctccgcttacgaatgtacagcccaatatgcgaacgcttactgctctcatgccaatggcagcggcattgtgcagatccaggtttccggggtgtggaagaaacctctgtgtgtcggatatgagcgggtggtcgtgaagcgcgaactcagcgccaaaccgattcaaagagttgagccctgcacgacctgtatcacaaagtgcgagcctcacggcctggtggtccggtctaccgggttcaagatctccagcgctgtggcctgcgcttctggagtttgtgtgacaggctcccagagcccctccaccgaaattacgcttaaataccctgggatctctcagagctccggcggagatattggcgtccatatggcccacgacgaccagtctgtgagctccaagatcgtggcgcattgtcccccgcaagatccttgcctggttcacgactgcattgtctgtgcccacgggctcatcaactatcagtgccatacagctctgagcgccttcgtggtggtctttgtgttctcttccatcgctattatctgtctggccattctctacagagttctgaaatgccttaagatcgcgccccgcaaagtgctgaatcctctcatgtggattaccgcctttatccggtggatttacaagaaaatggtcgctagagtggccgataacatcaaccaggttaatcgcgagatcggatggatggaaggcgggcagctggtgctgggaaaccccgctcctattccccggcacgccccgatccctagatatagcacctaccttatgctcctgctgattgtctcttatgcctccgcttgtagcgagctcatccaagcgtctagccgcattacaacctgctccacagagggcgtgaatacgaagtgtcggctgagcgggaccgcccttatcagagctggctctgttggagccgaagcctgcctgatgctcaagggcgtgaaagaggaccagacaaagttcctgaaaatcaagaccgtctccagcgaactgtcctgccgcgaggggcagtcttactggacaggcagcttttcccccaaatgtctttctagccggagatgccatctcgtgggagaatgtcacgtgaaccgctgcctgtcctggcgggataatgagacctctgctgagttcagctttgtcggggaatccacgaccatgagagagaacaagtgtttcgaacagtgcggaggctgggggtgtggctgctttaatgttaaccccagctgtctgttcgtgcacacatatctccaatctgtgcggaaggaggccctgcgcgtctttaattgcattgactgggtgcataaacttaccctggaaatcacagatttcgacggatccgttagcaccattgatctcggcgcgtcttccagcagatttacgaactgggggtctgtgtccctgagcctggacgctgagggaatctccggcagcaattctttcagcttcattgagtcccctgggaagggatacgccatcgtcgatgaaccgttttctgagatcccccggcagggcttccttggggaaattagatgtaacagcgagtcctctgtgctcagcgcccacgaatcctgcctgcgcgctcctaatctgatctcttataaacccatgattgaccagctcgagtgcacaaccaacctgatcgatccttttgttgtgttcgagcggggcagccttccccagacaagaaatgacaagacctttgccgcgtccaaaggaaaccgcggcgtccaggctttcagcaaggggtctgtgcaagccgacctgaccctcatgtttgataacttcgaagttgactttgtgggagccgctgtctcctgtgatgccgctttcctgaatctgacaggctgctacagctgtaacgccggggcgagagtgtgcctttctattacgtccaccggaacaggcagcctctccgcccataataaggacggctctctgcacatcgtgctgcctagcgagaacgggaccaaagatcagtgtcaaatcctccattttacagtccccgaagttgaggaggagttcatgtactcctgcgacggagatgagcggccgctgcttgtgaagggcaccctgattgctatcgacccttttgatgaccgcagagaagccgggggagagagcacggtggtcaatcccaaatctggctcctggaacttcttcgattggtttagcgggctcatgtcttggttcggaggccctctgaagacaattctgcttatctgtctgtatgtggctctcagcattggcctgtttttcctcctgatctaccttgggcggaccggactgtccaaaatgtggctcgccgccaccaagaaggcttcttga

SEQ ID NO: 14377 - RNA, 3594 nt, synthetic construct
  misc_feature 1..3594: note = derived and/or modified CDS sequence (opt5) from RVFV(ZS-6365)__DQ380205.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggactccgggcagaccaagagagagctgaaatctttcgatatttctcaatgccccaagatcggaggccacgggagcaagaaatgtaccggagacgccgccttttgctccgcttacgaatgtacagcccagtatgcgaacgcttactgctctcatgccaatggcagcggcattgtgcagatccaagtttccggggtgtggaagaaacctctttgtgtcggatatgagcgggtggtcgtgaagcgcgaactgagcgccaaaccgattcagagagttgagccctgcacgacctgtatcacaaagtgcgagcctcacggcctcgtggtccggtctaccgggttcaagatctccagcgctgtggcctgcgcttctggagtttgtgtgacaggctcccagagcccctccaccgaaattacgctgaaataccctgggatctctcagagctccggcggagatattggcgtccatatggcccacgacgaccaatctgtgagctccaagatcgtggcgcattgtcccccgcaggatccttgccttgttcacgggtgcattgtctgtgcccacggactgatcaactatcagtgccatacagctctcagcgccttcgtggtggtctttgtgttctcttccatcgctattatctgtctggccattctgtacagagttctcaaatgcctgaagatcgcgccccgcaaagtgcttaatcctctgatgtggattaccgcctttatccggtggatttacaagaaaatggtcgctagagtggccgacaacatcaaccaggttaatcgcgagatcggctggatggaagggggacaactcgtgctgggcaaccccgctcctattccccggcacgccccgatccctagatatagcacctacctgatgcttctcctgattgtctcttatgcctccgcttgtagcgagctgatccaggcgtctagccgcattacaacctgctccacagagggggtgaatacgaagtgtcggctcagcggcaccgccctgatcagagctggatctgttggcgccgaagcctgccttatgctgaagggggtgaaagaggatcagacaaagttcctcaaaatcaagaccgtctccagcgaactgtcctgccgcgagggacagtcttactggacaggcagcttttcccccaaatgtctgtctagccggagatgccatcttgtgggggaatgtcacgtgaaccgctgcctctcctggcgggacaatgagacctctgctgagttcagctttgtcggagaatccacgaccatgagagagaacaagtgtttcgaacaatgcggcgggtggggctgtggatgctttaatgttaaccccagctgtctgttcgtgcacacatatctgcagtctgtgcggaaggaggccctccgcgtctttaattgcattgattgggtgcataaactgacccttgaaatcacagacttcgatggctccgttagcaccattgacctgggggcgtcttccagcagatttacgaactggggatctgtgtccctcagcctggatgctgagggcatctccgggagcaattctttcagcttcattgagtcccctggaaagggctacgccatcgtcgacgaaccgttttctgagatcccccggcaggggttcctgggcgaaattagatgtaacagcgagtcctctgtgcttagcgcccacgaatcctgcctccgcgctcctaatctgatctcttataaacccatgattgatcagctggagtgcacaaccaacctcatcgacccttttgttgtgttcgagcggggaagcctgccccaaacaagaaatgataagacctttgccgcgtccaaaggcaaccgcggggtccaggctttcagcaagggatctgtgcaggccgaccttaccctgatgtttgacaacttcgaagttgattttgtgggcgccgctgtctcctgtgacgccgctttcctcaatctgacagggtgctacagctgtaacgccggagcgagagtgtgcctgtctattacgtccaccggcacaggcagcctttccgcccataataaggatgggtctctccacatcgtgctgcctagcgagaacggaaccaaagaccaatgtcagatcctgcattttacagtccccgaagttgaggaggagttcatgtactcctgcgatggcgacgagcggccgctcctggtgaaggggacccttattgctatcgatccttttgacgatcgcagagaagccggaggcgagagcacggtggtcaatcccaaatctgggtcctggaacttcttcgactggtttagcggactgatgtcttggttcggcggccctctcaagacaattctgctgatctgtctttatgtggctctgagcattgggctctttttcctgctcatctacctgggacggaccggcctttccaaaatgtggctggccgccaccaagaaggcttcttga

SEQ ID NO: 14378 - RNA, 3594 nt, synthetic construct
  misc_feature 1..3594: note = derived and/or modified CDS sequence (opt5) from RVFV(CAR-R1622)__DQ380219.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggactccgggcagaccaagagagagctgaaatctttcgatatttctcaatgccccaagatcggaggccacgggagcaagaaatgtaccggagacgccgccttttgctccgcttacgaatgtacagcccagtatgcgaacgcttactgctctcatgccaatggcagcggcattgtgcagatccaagtttccggggtgtggaagaaacctctttgtgtcggatatgagcgggtggtcgtgaagcgcgaactgagcgccaaaccgattcagagagttgagccctgcacgacctgtatcacaaagtgcgagcctcacggcctcgtggtccggtctaccgggttcaagatctccagcgctgtggcctgcgcttctggagtttgtgtgacaggctcccagagcccctccaccgaaattacgctgaaataccctgggatctctcagagctccggcggagatattggcgtccatatggcccacgacgaccaatctgtgagctccaagatcgtggcgcattgtcccccgcaggatccttgccttgttcacgggtgcattgtctgtgcccacggactgatcaactatcagtgccatacagctctcagcgccttcgtggtggtctttgtgttctcttccatcgctattatctgtctggccattctgtacagagttctcaaatgcctgaagatcgcgccccgcaaagtgcttaatcctctgatgtggattaccgcctttatccggtgggtctacaagaaaatggtggctagagttgccgacaacattaaccaggtgaatcgcgagatcggctggatggaagggggacaactcgtcctgggcaaccccgctcctatcccccggcacgccccgattcctagatatagcacctacctgatgcttctcctgatcgtgtcttatgcctccgcttgtagcgagctgattcaggcgtctagccgcatcacaacctgctccacagagggggttaatacgaagtgtcggctcagcggcaccgccctgattagagctggatctgtgggcgccgaagcctgccttatgctgaagggggtcaaagaggatcagacaaagttcctcaaaatcaagaccgtgtccagcgaactgtcctgccgcgagggacagtcttactggacaggcagcttttcccccaaatgtctgtctagccggagatgccatcttgtgggggaatgtcacgtcaaccgctgcctctcctggcgggacaatgagacctctgctgagttcagctttgttggagaatccacgaccatgagagagaacaagtgtttcgaacaatgcggcgggtggggctgtggatgctttaatgtgaaccccagctgtctgttcgtgcacacatatctgcagtctgtccggaaggaggccctccgcgtgtttaattgcatcgattgggttcataaactgacccttgaaattacagacttcgatggctccgtgagcaccatcgacctgggggcgtcttccagcagatttacgaactggggatctgtctccctcagcctggatgctgagggcatttccgggagcaattctttcagcttcatcgagtcccctggaaagggctacgccattgtggacgaaccgttttctgagatcccccggcaggggttcctgggcgaaatcagatgtaacagcgagtcctctgttcttagcgcccacgaatcctgcctccgcgctcctaatctgatttcttataaacccatgatcgatcagctggagtgcacaaccaacctcattgacccttttgtggtcttcgagcggggaagcctgccccaaacaagaaatgataagacctttgccgcgtccaaaggcaaccgcggggtgcaggctttcagcaagggatctgttcaggccgaccttaccctgatgtttgacaacttcgaagtggattttgtcggcgccgctgtgtcctgtgacgccgctttcctcaatctgacagggtgctacagctgtaacgccggagcgagagtgtgcctgtctatcacgtccaccggcacaggcacccttagcgcccataataaggatgggtccctccacattgtcctgccttctgagaacggaacaaaagaccaatgtcagatcctgcattttaccgttcccgaagtggaggaggagttcatgtacagctgcgatggcgacgagcggccgctcctggtgaaggggacgcttatcgctattgatccttttgacgatcgcagagaagccggaggcgagtccacagtcgtgaatcccaaaagcgggtcttggaacttcttcgactggttttccggactgatgagctggttcggcggccctctcaagaccatcctgctgatttgtctttatgttgctctgtctatcgggctctttttcctgctcatttacctgggacggaccggccttagcaaaatgtggctggccgccacaaagaaggcttcctga

SEQ ID NO: 14379 - RNA, 3594 nt, synthetic construct
  misc_feature 1..3594: note = derived and/or modified CDS sequence (opt5) from RVFV(2250/74)__DQ380209.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgttcttcctttgatgtcctgctcgaaaaaggcaagttccccctgtttcagagctacgcgcaccatcggacccttctggaggccgtgcacgacacaatcatcgctaaagccgatcctccctcttgcgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggactccgggcagaccaagagagagctgaaatctttcgatatttctcaatgccccaagatcggaggccacgggagcaagaaatgtaccggagacgccgccttttgctccgcttacgaatgtacagcccagtatgcgaacgcttactgctctcatgccaatggcagcggcattgtgcagatccaagtttccggggtgtggaagaaacctctttgtgtcggatatgagcgggtggtcgtgaagcgcgaactgagcgccaaaccgattcagagagttgagccctgcacgacctgtatcacaaagtgcgagcctcacggcctcgtggtccggtctaccgggttcaagatctccagcgctgtggcctgcgcttctggagtttgtgtgacaggctcccagagcccctccaccgaaattacgctgaaataccctgggatctctcagagctccggcggagatattggcgtccatatggcccacgacgaccaatctgtgagctccaagatcgtggcgcattgtcccccgcaggatccttgccttgttcacgggtgcattgtctgtgcccacggactgatcaactatcagtgccatacagctctcagcgccttcgtggtggtctttgtgttctcttccatcgctattatctgtctggccattctgtacagagttctcaaatgcctgaagatcgcgccccgcaaagtgcttaatcctctgatgtggattaccgcctttatccggtggatttacaagaaaatggtcgctagagtggccgacaacatcaaccaggttaatcgcgagatcggctggatggaagggggacaactcgtgctgggcaaccccgctcctattccccggcacgccccgatccctagatatagcacctacctgatgcttctcctgattgtctcttatgcctccgcttgtagcgagctgatccaggcgtctagccgcattacaacctgctccacagagggggtgaatacgaagtgtcggctcagcggcaccgccctgatcagagctggatctgttggcgccgaagcctgccttatgctgaagggggtgaaagaggatcagacaaagttcctcaaaatcaagaccgtctccagcgaactgtcctgccgcgagggacagtcttactggacaggcagcttttcccccaaatgtctgtctagccggagatgccatcttgtgggggaatgtcacgtgaaccgctgcctctcctggcgggacaatgagacctctgctgagttcagctttgtcggagaatccacgaccatgagagagaacaagtgtttcgaacaatgcggcgggtggggctgtggatgctttaatgttaaccccagctgtctgttcgtgcacacatatctgcagtctgtgcggaaggaggccctccgcgtctttaattgcattgattgggtgcataaactgacccttgaaatcacagacttcgatggctccgttagcaccattgacctgggggcgtcttccagcagatttacgaactggggatctgtgtccctcagcctggatgctgagggcatctccgggagcaattctttcagcttcattgagtcccctggaaagggctacgccatcgtcgacgaaccgttttctgagatcccccggcaggggttcctgggcgaaattagatgtaacagcgagtcctctgtgcttagcgcccacgaatcctgcctccgcgctcctaatctgatctcttataaacccatgattgatcagctggagtgcacaaccaacctcatcgacccttttgttgtgttcgagcggggaagcctgccccaaacaagaaatgataagacctttgccgcgtccaaaggcaaccgcggggtccaggctttcagcaagggatctgtgcaggccgaccttaccctgatgtttgacaacttcgaagttgattttgtgggcgccgctgtctcctgtgacgccgctttcctcaatctgacagggtgctacagctgtaacgccggagcgaaggtgtgcctgtctattacgtccaccggcacaggcagcctttccgcccataataaagatgggtctctccacatcgtgctgcctagcgagaacggaaccaaggaccaatgtcagatcctgcattttacagtccccgaagttgaggaggagttcatgtactcctgcgatggcgacgagagaccgctcctggtgaaagggacccttattgctatcgatccttttgacgatcggcgcgaagccggaggcgagagcacggtggtcaatcccaagtctgggtcctggaacttcttcgactggtttagcggactgatgtcttggttcggcggccctctcaaaacaattctgctgatctgtctttatgtggctctgagcattgggctctttttcctgctcatctacctgggaagaaccggcctttccaagatgtggctggccgccaccaagaaagctagctga

SEQ ID NO: 14380 - RNA, 3594 nt, synthetic construct
  misc_feature 1..3594: note = derived and/or modified CDS sequence (opt5) from RVFV(T1)__DQ380201.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggactccgggcagaccaagagagagctgaaatctttcgatatttctcaatgccccaagatcggaggccacgggagcaagaaatgtaccggagacgccgccttttgctccgcttacgaatgtacagcccagtatgcgaacgcttactgctctcatgccaatggcagcggcattgtgcagatccaagtttccggggtgtggaagaaacctctttgtgtcggatatgagcgggtggtcgtgaagcgcgaactgagcgccaaaccgattcagagagttgagccctgcacgacctgtatcacaaagtgcgagcctcacggcctcgtggtccggtctaccgggttcaagatctccagcgctgtggcctgcgcttctggagtttgtgtgacaggctcccagagcccctccaccgaaattacgctgaaataccctgggatctctcagagctccggcggagatattggcgtccatatggcccacgacgaccaatctgtgagctccaagatcgtggcgcattgtcccccgcaggatccttgccttgttcacgggtgcattgtctgtgcccacggactgatcaactatcagtgccatacagctctcagcgccttcgtggtggtctttgtgttctcttccatcgctattatctgtctggccgttctgtacagagtgctcaaatgcctgaagattgcgccccgcaaagtccttaatcctctgatgtggatcaccgcctttattcggtggatctacaagaaaatggtggctagagttgccgacaacattaaccaggtgaatcgcgagatcggctggatggaagggggacaactcgtcctgggcaaccccgctcctatcccccggcacgccccgattcctagatatagcacctacctgatgcttctcctgatcgtgtcttatgcctccgcttgtagcgagctgattcaggcgtctagccgcatcacaacctgctccacagagggggttaatacgaagtgtcggctcagcggcaccgccctgattagagctggatctgtgggcgccgaagcctgccttatgctgaagggggtcaaagaggatcagacaaagttcctcaaaatcaagaccgtgtccagcgaactgtcctgccgcgagggacagtcttactggacaggcagcttttcccccaaatgtctgtctagccggagatgccatcttgtgggggaatgtcacgtcaaccgctgcctctcctggcgggacaatgagacctctgctgagttcagctttgttggagaatccacgaccatgagagagaacaagtgtttcgaacaatgcggcgggtggggctgtggatgctttaatgtgaaccccagctgtctgttcgtgcacacatatctgcagtctgtccggaaggaggccctccgcgtgtttaattgcatcgattgggttcataaactgacccttgaaattacagacttcgatggctccgtgagcaccatcgacctgggggcgtcttccagcagatttacgaactggggatctgtctccctcagcctggatgctgagggcatttccgggagcaattctttcagcttcatcgagtcccctggaaagggctacgccattgtggacgaaccgttttctgagatcccccggcaggggttcctgggcgaaatcagatgtaacagcgagtcctctgttcttagcgcccacgaatcctgcctccgcgctcctaatctgatttcttataaacccatgatcgatcagctggagtgcacaaccaacctcattgacccttttgtggtcttcgagcggggaagcctgccccaaacaagaaatgataagacctttgccgcgtccaaaggcaaccgcggggtgcaggctttcagcaagggatctgttcaggccgaccttaccctgatgtttgacaacttcgaagtggattttgtcggcgccgctgtgtcctgtgacgccgctttcctcaatctgacagggtgctacagctgtaacgccggagcgagagtgtgcctgtctatcacgtccaccggcacaggcagcctttccgcccataataaggatgggtctctccacattgtcctgcctagcgagaacggaaccaaagaccaatgtcagatcctgcattttacagttcccgaagtggaggaggagttcatgtactcctgcgatggcgacgagcggccgctcctggtgaaggggacccttatcgctattgatccttttgacgatcgcagagaagccggaggcgagagcacggtcgtgaatcccaaatctgggtcctggaacttcttcgactggtttagcggactgatgtcttggttcggcggccctctcaagacaatcctgctgatttgtctttatgttgctctgagcatcgggctctttttcctgctcatttacctgggacggaccggcctttccaaaatgtggctggccgccaccaagaaggcttcttga

SEQ ID NO: 14381 - RNA, 3594 nt, synthetic construct
  misc_feature 1..3594: note = derived and/or modified CDS sequence (opt5) from RVFV(1853/78)__DQ380220.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggactccgggcagaccaagagagagctgaaatctttcgatatttctcaatgccccaagatcggaggccacgggagcaagaaatgtaccggagacgccgccttttgctccgcttacgaatgtacagcccagtatgcgaacgcttactgctctcatgccaatggcagcggcgtggttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagatatcggcgtgcatatggcccacgacgaccaatctgtgagctccaagattgttgcgcattgtcccccgcaggatccttgccttgtccacgggtgcatcgtgtgtgcccacggactgattaactatcagtgccatacagctctcagcgccttcgtggtcgtgtttgttttctcttccatcgctatcatttgtctggccatcctgtacagagtgctcaaatgcctgaagattgcgccccgcaaagtccttaatcctctgatgtggatcaccgcctttattcggtgggtgtacaagaaaatggttgctagagtggccgacaacatcaaccaggtcaatcgcgagattggctggatggaagggggacaactcgtgctgggcaaccccgctcctatcccccggcacgccccgatccctagatatagcacctacctgatgcttctcctgattgtttcttatgcctccgcttgtagcgagctgatccaggcgtctagccgcattacaacctgctccacagagggggtgaatacgaagtgtcggctcagcggcaccgccctgatcagagctggatctgtcggcgccgaagcctgccttatgctgaagggggtgaaagaggatcagacaaagttcctcaaaattaagaccgtgtccagcgaactgtcctgccgcgagggacagtcttactggacaggcagcttttcccccaaatgtctgtctagccggagatgccatcttgtcggggaatgtcacgttaaccgctgcctctcctggcgggacaatgagacctctgctgagttcagctttgtgggagaatccacgaccatgagagagaacaagtgtttcgaacaatgcggcgggtggggctgtggatgctttaatgtgaaccccagctgtctgttcgtccacacatatctgcagtctgtgcggaaggaggccctccgcgtttttaattgcatcgattgggtgcataaactgacccttgaaatcacagacttcgatggctccgtcagcaccattgacctgggggcgtcttccagcagatttacgaactggggatctgtgtccctcagcctggatgctgagggcatctccgggagcaattctttcagcttcattgagtcccctggaaagggctacgccatcgttgacgaaccgttttctgagattccccggcaggggttcctgggcgaaatcagatgtaacagcgagtcctctgtgcttagcgcccacgaatcctgcctccgcgctcctaatctgatctcttataaacccatgattgatcagctggagtgcacaaccaacctcatcgacccttttgtcgtgttcgagcggggaagcctgccccaaacaagaaatgataagacctttgccgcgtccaaaggcaaccgcggggttcaggctttcagcaagggatctgtgcaggccgaccttaccctgatgtttgacaacttcgaagtcgattttgtgggcgccgctgtgtcctgtgacgccgctttcctcaatctgacagggtgctacagctgtaacgccggagcgagagtctgcctgtctattacgtccaccggcacaggcacccttagcgcccataataaggatgggtccctccacatcgttctgccttctgagaacggaacaaaagaccaatgtcagattctgcattttaccgtgcccgaagtggaggaggagttcatgtacagctgcgatggcgacgagcggccgctcctggtcaaggggacgcttatcgctatcgatccttttgacgatcgcagagaagccggaggcgagtccacagtggttaatcccaaaagcgggtcttggaacttcttcgactggttttccggactgatgagctggttcggcggccctctcaagaccattctgctgatctgtctttatgtggctctgtctattgggctctttttcctgctcatctacctgggacggaccggccttagcaaaatgtggctggccgccacaaagaaggcttcctga

SEQ ID NO: 14382 - RNA, 3594 nt, synthetic construct
  misc_feature 1..3594: note = derived and/or modified CDS sequence (opt5) from RVFV(MP-12)__DQ380208.1__GP
  source 1..3594: mol_type = other RNA
atgtacgtgctgctcaccatcctgacaagcgtccttgtttgcgaggccattatcagagtgtccctgtctagcacgcgggaagagacctgtttcggcgactccacaaaccccgaaatgattgagggggcttgggattctctccgcgaagaggagatgcctgaggaactgagctgctccatctctggaattagagaagtgaagaccagctcccaggagctttatcgggccctgaaagcgatcatcgctgccgacggcctcaataacattacatgtcacgggaaggatccggaggacaaaatcagcctgattaagggaccccctcataaaaagcgcgtcggcatcgtgagatgcgaacggcgcagagatgccaagcaaattgggcgggagaccatggctggaatcgccatgacagttctgcccgctctcgccgtgtttgcgctggcccctgtcgtgttcgctgaagacccccaccttcgcaatagacctggcaaaggccataactacattgatgggatgacccaggaggacgccacgtgtaagccggttacctatgctggagcctgcagctcctttgatgtgctgctcgaaaaaggcaagttccccctgtttcagagctacgcgcaccatcggacacttctggaggccgtccacgacaccatcatcgctaaagccgatcctccctcttgtgacctcctgtccgctcacgggaatccttgcatgaaggagaagctggtgatgaaaacacattgtcccaacgattatcagagcgcccaccatctcaataacgacggaaagatggcctctgtgaaatgcccgcctaagtacgaactgaccgaggactgtaatttctgccgccaaatgacgggcgcttcccttaaaaaggggagctatcccctgcaggatctcttttgccagtcctctgaagacgatggaagcaaactgaagacaaagatgaaaggcgtctgtgaggttggcgtgcaggcgcttaagaaatgcgacgggcaactgtccaccgcccacgaagtggtccctttcgctgtgtttaagaacagcaaaaaggtttacctcgataagctggacctgaaaacagaggagaatctcctgcccgattctttcgtgtgttttgaacacaagggacagtacaaaggcaccatggactccgggcagaccaagagagagcttaaatctttcgatatttctcagtgccccaagatcggaggccatgggagcaagaaatgtacaggagacgccgccttttgctccgcttatgaatgtacggcccaatacgcgaacgcttattgctctcacgccaatggcagcggcattgtccagatccaggtgtccggggtttggaagaaacctctgtgtgtgggatacgagcgggtcgtggtcaagcgcgaactcagcgccaaaccgattcaaagagtggagccctgcaccacatgtatcaccaagtgcgagcctcatggcctggttgtgcggtctacagggttcaagatctccagcgctgtcgcctgcgcttctggagtgtgtgttaccggctcccagagcccctccacggaaattacacttaaatatcctgggatctctcagagctccggcggagatattggcgtgcacatggcccatgacgaccagtctgtcagctccaagatcgtggcgcactgtcccccgcaagatccttgcctggtgcacgactgcattgtttgtgcccatgggctcatcaactaccagtgccacaccgctctgagcgccttcgtcgtggtgtttgtcttctcttccatcgctattatctgtctggccattctctatagagtgctgaaatgccttaagatcgcgccccgcaaagttctgaatcctctcatgtggattaccgcctttatccggtggatttacaagaaaatggtggctagagtcgccgataacatcaaccaggtgaatcgcgagatcggatggatggaaggcgggcagctggttctgggaaaccccgctcctattccccggcatgccccgatccctagatacagcacatatcttatgctcctgctgattgtgtcttacgcctccgcttgtagcgagctcatccaagcgtctagccgcattaccacatgctccacggagggcgtcaataccaagtgtcggctgagcgggacagcccttatcagagctggctctgtgggagccgaagcctgcctgatgctcaagggcgttaaagaggaccagaccaagttcctgaaactgaagacagtgtccagcgaactttcctgccgcgaggggcagtcttattggaccgggagcttttcccccaaatgtctctctagccggagatgccacctggtcggcgaatgtcacgtgaaccgctgcctgtcctggcgggataatgagacgtctgctgagttcagctttgtgggggaatccaccacaatgagagagaacaagtgtttcgaacagtgcggaggctgggggtgtggctgctttaatgtcaaccccagctgtctcttcgttcatacctacctgcaatctgtgcggaaggaggcccttcgcgtgtttaattgcatcgactgggtccacaaactgacactcgaaattaccgatttcgacggatccgtgagcacgatcgatctgggcgcgtcttccagcagatttacaaactgggggtctgtttccctgagccttgacgctgagggaatttccggcagcaattctttcagcttcatcgagtcccctgggaagggatatgccattgtggatgaaccgttttctgagatcccccggcagggcttcctcggggaaatcagatgtaacagcgagtcctctgtcctgagcgcccatgaatcctgcctgcgcgctcctaatctcatttcttacaaacccatgatcgaccagctggagtgcaccacaaaccttattgatccttttgtggttttcgagcggggcagcctgccccagaccagaaatgacaagacctttgccgcgtccaaaggaaaccgcggcgtgcaggctttcagcaaggggtctgtccaagccgacctcacactgatgtttgataacttcgaagtggactttgttggagccgctgtgtcctgtgatgccgctttcctgaatcttacgggctgctatagctgtaacgccggggcgagagtctgcctctctatcacctccacaggaaccggcagcctgtccgcccacaataaggacggctctctgcatattgtgctccctagcgagaacgggacaaaagatcagtgtcaaatcctgcactttaccgtgcccgaagtcgaggaggagttcatgtactcctgcgacggagatgaacggccgcttctggttaagggcacgctcatcgctattgacccttttgatgaccgcagagaagccgggggagagagcacagtggtgaatcccaaatctggctcctggaacttcttcgattggtttagcgggctgatgtcttggttcggaggccctctgaagaccatccttctgatttgtctctacgtcgctctgagcatcggcctctttttcctgcttatttatctgggaggaaccggcctctccaaaatgtggctggccgccacaaagaaggcttcttga

SEQ ID NO: 14383 - RNA, 3594 nt, synthetic construct
  misc_feature 1..3594: note = derived and/or modified CDS sequence (opt5) from RVFV(ZM-657)__DQ380204.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgttcttcctttgatgtcctgctcgaaaaaggcaagttccccctgtttcagagctacgcgcaccatcggacccttctggaggccgtgcacgacacaatcatcgctaaagccgatcctccctcttgcgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggactccgggcagaccaagagagagctgaaatctttcgatatttctcaatgccccaagatcggaggccacgggagcaagaaatgtaccggagacgccgccttttgctccgcttacgaatgtacagcccagtatgcgaaggcttactgctctcatgccaacggcagcggcattgtgcagatccaagtttccggggtgtggaaaaagcctctttgtgtcggatatgagcgggtggtcgtgaaacgcgaactgagcgccaagccgattcagagagttgagccctgcacgacctgtatcacaaagtgcgagcctcacggcctcgtggtccggtctaccgggttcaaaatctccagcgctgtggcctgcgcttctggagtttgtgtgacaggctcccagagcccctccaccgaaattacgctgaagtaccctgggatctctcagagctccggcggagatattggcgtccatatggcccacgacgaccaatctgtgagctccaaaatcgtggcgcattgtcccccgcaggatccttgccttgttcacgggtgcattgtctgtgcccacggactgatcaattatcagtgccatacagctctcagcgccttcgtggtggtctttgtgttctcttccatcgctattatctgtctggccattctgtacagagttctcaagtgcctgaaaatcgcgccccgcaaggtgcttaaccctctgatgtggattaccgcctttatccggtggatttacaaaaagatggtcgctagagtggccgacaatatcaaccaggttaaccgcgagatcggctggatggaagggggacaactcgtgctgggcaatcccgctcctattccccggcacgccccgatccctagatatagcacctacctgatgcttctcctgattgtctcttatgcctccgcttgtagcgagctgatccaggcgtctagccgcattacaacctgctccacagagggggtgaacacgaagtgtcggctcagcggcaccgccctgatcagagctggatctgttggcgccgaagcctgccttatgctgaaaggggtgaaggaggatcagacaaaattcctcaagatcaaaaccgtctccagcgaactgtcctgccgcgagggacagtcttactggacaggcagcttttcccccaagtgtctgtctagccggagatgccatcttgtgggggaatgtcacgtgaatcgctgcctctcctggcgggacaacgagacctctgctgagttcagctttgtcggagaatccacgaccatgagagagaataagtgtttcgaacaatgcggcgggtggggctgtggatgctttaacgttaatcccagctgtctgttcgtgcacacatatctgcagtctgtgcggaaagaggccctccgcgtctttaactgcattgattgggtgcataagctgacccttgaaatcacagacttcgatggctccgttagcaccattgacctgggggcgtcttccagcagatttacgaattggggatctgtgtccctcagcctggatgctgagggcatctccgggagcaactctttcagcttcattgagtcccctggaaaaggctacgccatcgtcgacgaaccgttttctgagatcccccggcaggggttcctgggcgaaattagatgtaatagcgagtcctctgtgcttagcgcccacgaatcctgcctccgcgctcctaacctgatctcttataagcccatgattgatcagctggagtgcacaaccaatctcatcgacccttttgttgtgttcgagcggggaagcctgccccaaacaagaaacgataaaacctttgccgcgtccaagggcaatcgcggggtccaggctttcagcaagggatctgtgcaggccgaccttaccctgatgtttgacaacttcgaagttgattttgtgggcgccgctgtctcctgtgacgccgctttcctcaacctgacagggtgctacagctgtaatgccggagcgagagtgtgcctgtctattacgtccaccggcacaggcagcctttccgcccataacaaagatgggtctctccacatcgtgctgcctagcgagaatggaaccaaggaccaatgtcagatcctgcattttacagtccccgaagttgaggaggagttcatgtactcctgcgatggcgacgagcggccgctcctggtgaaagggacccttattgctatcgatccttttgacgatcgcagagaagccggaggcgagagcacggtggtcaaccccaagtctgggtcctggaatttcttcgactggtttagcggactgatgtcttggttcggcggccctctcaaaacaattctgctgatctgtctttatgtggctctgagcattgggctctttttcctgctcatctacctgggacggaccggcctttccaagatgtggctggccgccaccaagaaagctagctga

SEQ ID NO: 14384 - RNA, 3594 nt, synthetic construct
  misc_feature 1..3594: note = derived and/or modified CDS sequence (opt5) from RVFV(ZH-501-777)__DQ380202.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggaccccgggcagaccaagagagagctgaaatccttcgatattagccaatgccctaagatcggaggccacgggtctaagaaatgtaccggagacgccgccttttgcagcgcttacgaatgtacagcccagtatgcgaacgcttactgctcccatgccaatggctctggcattgtgcagatccaagttagcggggtgtggaagaaaccgctttgtgtcggatatgagcgggtggtcgtgaagcgcgaactgtccgccaaacccattcagagagttgagccttgcacgacctgtatcacaaagtgcgagccccacggcctcgtggtccggagcaccgggttcaagatctcttccgctgtggcctgcgctagcggagtttgtgtgacaggctctcagtcccctagcaccgaaattacgctgaaataccccgggatctcccagtctagcggcggagatattggcgtccatatggcccacgacgaccaatccgtgtctagcaagatcgtggcgcattgcccgcctcaggatccctgtcttgttcacgggtgcattgtctgtgcccacggactgatcaactatcagtgccatacagctctctccgccttcgtggtggtctttgtgttcagctctatcgctattatctgtctggccgttctgtacagagtgctcaaatgcctgaagattgcgcctcgcaaagtccttaatcccctgatgtggatcaccgcctttattcggtggatctacaagaaaatggtggctagagttgccgacaacattaaccaggtgaatcgcgagatcggctggatggaagggggacaactcgtcctgggcaaccctgctcccatcccgcggcacgcccctattcccagatattccacctacctgatgcttctcctgatcgtgagctatgcctctgcttgttccgagctgattcaggcgagctctcgcatcacaacctgcagcacagagggggttaatacgaagtgtcggctctccggcaccgccctgattagagctggaagcgtgggcgccgaagcctgccttatgctgaagggggtcaaagaggatcagacaaagttcctcaaaatcaagaccgtgtcttccgaactgagctgccgcgagggacagtcctactggacaggctcttttagccccaaatgtctgtcctctcggagatgccatcttgtgggggaatgtcacgtcaaccgctgcctcagctggcgggacaatgagacctccgctgagttctcttttgttggagaaagcacgaccatgagagagaacaagtgtttcgaacaatgcggcgggtggggctgtggatgctttaatgtgaacccttcctgtctgttcgtgcacacatatctgcagagcgtccggaaggaggccctccgcgtgtttaattgcatcgattgggttcataaactgacccttgaaattacagacttcgatggctctgtgtccaccatcgacctgggggcgtcttcttccagatttacgaactggggaagcgtctctctctccctggatgctgagggcattagcgggtccaatagcttctctttcatcgagagcccgggaaagggctacgccattgtggacgaacccttttccgagatccctcggcaggggttcctgggcgaaatcagatgtaactctgagagctccgttctttctgcccacgaaagctgcctccgcgctcccaatctgatttcctataaacctatgatcgatcagctggagtgcacaaccaacctcattgacccctttgtggtcttcgagcggggatctctgcctcaaacaagaaatgataagacctttgccgcgagcaaaggcaaccgcggggtgcaggctttctccaagggaagcgttcaggccgaccttaccctgatgtttgacaacttcgaagtggattttgtcggcgccgctgtgtcttgtgacgccgctttcctcaatctgacagggtgctactcctgtaacgccggagcgagagtgtgcctgagcatcacgtctaccggcacaggctcccttagcgcccataataaggatgggtccctccacattgtcctgccctctgagaacggaaccaaagaccaatgtcagatcctgcattttacagttccggaagtggaggaggagttcatgtacagctgcgatggcgacgagcggcctctcctggtgaaggggacccttatcgctattgatccctttgacgatcgcagagaagccggaggcgagtccacggtcgtgaatcctaaaagcgggtcttggaacttcttcgactggttttccggactgatgagctggttcggcggccccctcaagacaatcctgctgatttgtctttatgttgctctgtctatcgggctctttttcctgctcatttacctgggacggaccggccttagcaaaatgtggctggccgccaccaagaaggcttcctga

SEQ ID NO: 14385 - RNA, 3594 nt, synthetic construct
  misc_feature 1..3594: note = derived and/or modified CDS sequence (opt5) from RVFV(OS-3)__DQ380184.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggactccgggcagaccaagagagagctgaaatctttcgatatttctcaatgccccaagatcggaggccacgggagcaagaaatgtaccggagacgccgccttttgctccgcttacgaatgtacagcccagtatgcgaacgcttactgctctcatgccaatggcagcggcgtggttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagatatcggcgtgcatatggcccacgacgaccaatctgtgagctccaagattgttgcgcattgtcccccgcaggatccttgccttgtccacgggtgcatcgtgtgtgcccacggactgattaactatcagtgccatacagctctcagcgccttcgtggtcgtgtttgttttctcttccgtggctatcatctgtctggccattctgtacaaagtcctcaagtgcctgaaaatcgcgcccagaaaggtgcttaatcctctgatgtggattaccgcctttatccgctgggtttacaaaaagatggtggctcgggtcgccgacaacattaaccaggtgaatagagagatcggctggatggaagggggacaactcgctctgggcaaccccgcccctattccccgccacgccccgatccctcggtatagcacctacctgatgcttctcctgatcgtttcttatgcttccgcgtgtagcgagctgattcaggcctctagcagaatcacaacctgctccacagagggggtgaatacgaagtgtcgcctcagcggcaccgctctgattcgggccggatctgtcggcgccgaggcttgccttatgctgaaaggggtgaaggaggatcagacaaaattcctcaagatcaaaaccgtgtccagcgaactgtcctgcagagagggacagtcttactggacaggcagcttttcccccaagtgtctgtctagccgccggtgccatcttgtcggggaatgtcacgttaacagatgcctctcctggcgcgacaatgagacctctgccgagttcagctttgtgggagaatccacgaccatgcgggagaacaagtgtttcgaacaatgcggcgggtggggctgtggatgctttaatgtgaaccccagctgtctgttcgtccacacatatctgcagtctgtgagaaaagaggcgctccgggtttttaattgcattgattgggtgcataagctgacccttgaaatcacagacttcgatggctccgtcagcaccatcgacctgggggcttcttccagccgctttacgaactggggatctgtgtccctcagcctggatgccgagggcatttccgggagcaattctttcagcttcatcgagtcccctggaaaaggctacgccattgttgacgaaccgttttctgagatccccagacaggggttcctgggcgaaattcggtgtaacagcgagtcctctgtgcttagcgctcacgaatcctgcctcagagcccctaatctgatctcttataagcccatgatcgatcagctggagtgcacaaccaacctcattgacccttttgtcgtgttcgagcgcggaagcctgccccaaacacggaatgataaaacctttgcggcttccaagggcaacagaggggttcaggccttcagcaagggatctgtgcaggccgaccttaccctgatgtttgacaacttcgaagtcgattttgtgggcgctgccgtgtcctgtgacgctgccttcctcaatctgacagggtgctacagctgtaacgcgggagcccgcgtctgcctgtctatcacgtccaccggcacaggcacccttagcgctcataataaagatgggtccctccacattgttctgccttctgagaacggaacaaaggaccaatgtcagatcctgcattttaccgtgcccgaagtggaggaggagttcatgtacagctgcgatggcgacgaaagaccgctcctggtcaaagggacgcttattgccatcgatccttttgacgatcggcgcgaagctggaggcgagtccacagtggttaatcccaagagcgggtcttggaacttcttcgactggttttccggactgatgagctggttcggcggccctctcaaaaccatcctgctgatttgtctttatgtggccctgtctatcgggctctttttcctgctcatttacctgggaagaaccggccttagcaagatgtggctggccgctacaaagaaagcgtcctga

SEQ ID NO: 14386 - RNA, 3594 nt, synthetic construct
  misc_feature 1..3594: note = derived and/or modified CDS sequence (opt5) from RVFV(Sudan 86-2010)__JQ820489.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagacatcggcgtgcatatggcccacgatgaccaatctgtgagctccaagattgttgcgcattgtcccccgcaggacccttgccttgtccacgggtgcatcgtgtgtgcccacggactgattaattatcagtgccatacagctctcagcgccttcgtggtcgtgtttgttttctcttccatcgctatcatttgtctggccatcctgtacagagtgctcaaatgcctgaagattgcgccccgcaaagtccttaaccctctgatgtggatcaccgcctttattcggtgggtgtacaagaaaatggttgctagagtggccgataacatcaatcaggtcaaccgcgagattggctggatggaagggggacaactcgtgctgggcaatcccgctcctatcccccggcacgccccgatccctagatatagcacctacctgatgcttctcctgattgtttcttatgcctccgcttgtagcgagctgatccaggcgtctagccgcattacaacctgctccacagagggggtgaacacgaagtgtcggctcagcggcaccgccctgatcagagctggatctgtcggcgccgaagcctgccttatgctgaagggggtgaaagaggaccagacaaagttcctcaaaattaagaccgtgtccagcgaactgtcctgccgcgagggacagtcttactggacaggcagcttttcccccaaatgtctgtctagccggagatgccatcttgtcggggaatgtcacgttaatcgctgcctctcctggcgggataacgagacctctgctgagttcagctttgtgggagaatccacgaccatgagagagaataagtgtttcgaacaatgcggcgggtggggctgtggatgctttaacgtgaatcccagctgtctgttcgtccacacatatctgcagtctgtgcggaaggaggccctccgcgtttttaactgcatcgactgggtgcataaactgacccttgaaatcacagatttcgacggctccgtcagcaccattgatctgggggcgtcttccagcagatttacgaattggggatctgtgtccctcagcctggacgctgagggcatctccgggagcaactctttcagcttcattgagtcccctggaaagggctacgccatcgttgatgaaccgttttctgagattccccggcaggggttcctgggcgaaatcagatgtaatagcgagtcctctgtgcttagcgcccacgaatcctgcctccgcgctcctaacctgatctcttataaacccatgattgaccagctggagtgcacaaccaatctcatcgatccttttgtcattttcgagcggggaagcctgccccaaacaagaaacgacaagacctttgccgcgtccaaaggcaaccgcggggtgcaggctttcagcaagggatctgttcaggccgatcttaccctgatgtttgacaatttcgaagtggactttgtcggcgccgctgtgtcctgtgatgccgctttcctcaacctgacagggtgctacagctgtaatgccggagcgagagtgtgcctgtctatcacgtccaccggcacaggcacccttagcgcccataacaaggacgggtccctccacattgtcctgccttctgagaatggaacaaaagatcaatgtcagatcctgcattttaccgttcccgaagtggaggaggagttcatgtacagctgcgacggcgatgagcggccgctcctggtgaaggggacgcttatcgctattgacccttttgatgaccgcagagaagccggaggcgagtccacagtcgtgaaccccaaaagcgggtcttggaatttcttcgattggttttccggactgatgagctggttcggcggccctctcaagaccatcctgctgatttgtctttatgttgctctgtctatcgggctctttttcctgctcatttacctgggacggaccggccttagcaaaatgtggctggccgccacaaagaaggcttcctga

SEQ ID NO: 14387 - RNA, 3594 nt, synthetic construct
  misc_feature 1..3594: note = derived and/or modified CDS sequence (opt5) from RVFV(T-46 (228113))__DQ380199.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgttcttcctttgatgtcctgctcgaaaaaggcaagttccccctgtttcagagctacgcgcaccatcggacccttctggaggccgtgcacgacacaatcatcgctaaagccgatcctccctcttgcgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaaaggactccgggcagaccaaaagagagctgaagtctttcgatatttctcaatgccccaagatcggaggccacgggagcaaaaagtgtaccggagacgccgccttttgctccgcttacgaatgtacagcccagtatgcgaacgcttactgctctcatgccaatggcagcggcattgtgcagatccaagtttccggggtgtggaaaaagcctctttgtgtcggatatgagcgggtggtcgtgaaacgcgaactgagcgccaagccgattcagagagttgagccctgcacgacctgtatcacaaagtgcgagcctcacggcctcgtggtccggtctaccgggttcaaaatctccagcgctgtggcctgcgcttctggagtttgtgtgacaggctcccagagcccctccaccgaaattacgctgaagtaccctgggatctctcagagctccggcggagatattggcgtccatatggcccacgacgaccaatctgtgagctccaaaatcgtggcgcattgtcccccgcaggatccttgccttgttcacgggtgcattgtctgtgcccacggactgatcaactatcagtgccatacagctctcagcgccttcgtggtggtctttgtgttctcttccatcgctattatctgtctggccgttctgtacagagtgctcaagtgcctgaaaattgcgccccgcaaggtccttaatcctctgatgtggatcaccgcctttattcggtggatctacaaaaagatggtggctagagttgccgacaacattaaccaggtgaatcgcgagatcggctggatggaagggggacaactcgtcctgggcaaccccgctcctatcccccggcacgccccgattcctagatatagcacctacctgatgcttctcctgatcgtgtcttatgcctccgcttgtagcgagctgattcaggcgtctagccgcatcacaacctgctccacagagggggttaatacgaagtgtcggctcagcggcaccgccctgattagagctggatctgtgggcgccgaagcctgccttatgctgaaaggggtcaaggaggatcagacaaaattcctcaagatcaaaaccgtgtccagcgaactgtcctgccgcgagggacagtcttactggacaggcagcttttcccccaagtgtctgtctagccggagatgccatcttgtgggggaatgtcacgtcaaccgctgcctctcctggcgggacaatgagacctctgctgagttcagctttgttggagaatccacgaccatgagagagaacaagtgtttcgaacaatgcggcgggtggggctgtggatgctttaatgtgaaccccagctgtctgttcgtgcacacatatctgcagtctgtccggaaagaggccctccgcgtgtttaattgcatcgattgggttcataagctgacccttgaaattacagacttcgatggctccgtgagcaccatcgacctgggggcgtcttccagcagatttacgaactggggatctgtctccctcagcctggatgctgagggcatttccgggagcaattctttcagcttcatcgagtcccctggaaaaggctacgccattgtggacgaaccgttttctgagatcccccggcaggggttcctgggcgaaatcagatgtaacagcgagtcctctgttcttagcgcccacgaatcctgcctccgcgctcctaatctgatttcttataagcccatgatcgatcagctggagtgcacaaccaacctcattgacccttttgtggtcttcgagcggggaagcctgccccaaacaagaaatgataaaacctttgccgcgtccaagggcaaccgcggggtgcaggctttcagcaagggatctgttcaggccgaccttaccctgatgtttgacaacttcgaagtggattttgtcggcgccgctgtgtcctgtgacgccgctttcctcaatctgacagggtgctacagctgtaacgccggagcgagagtgtgcctgtctatcacgtccaccggcacaggcagcctttccgcccataataaagatgggtctctccacattgtcctgcctagcgagaacggaaccaaggaccaatgtcagatcctgcattttacagttcccgaagtggaggaggagttcatgtactcctgcgatggcgacgagcggccgctcctggtgaaagggacccttatcgctattgatccttttgacgatcgcagagaagccggaggcgagagcacggtcgtgaatcccaagtctgggtcctggaacttcttcgactggtttagcggactgatgtcttggttcggcggccctctcaaaacaatcctgctgatttgtctttatgttgctctgagcatcgggctctttttcctgctcatttacctgggacggaccggcctttccaagatgtggctggccgccaccaagaaagctagctga

SEQ ID NO: 14388 - RNA, 3594 nt, synthetic construct
  misc_feature 1..3594: note = derived and/or modified CDS sequence (opt5) from RVFV(2007000094)__EU574055.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagacatcggcgtgcatatggcccacgatgaccaatctgtgagctccaagattgttgcgcattgtcccccgcaggacccttgccttgtccacgggtgcatcgtgtgtgcccacggactgattaattatcagtgccatacagctctcagcgccttcgtggtcgtgtttgttttctcttccatcgctatcatttgtctggccatcctgtacagagtgctcaaatgcctgaagattgcgccccgcaaagtccttaaccctctgatgtggatcaccgcctttattcggtgggtgtacaagaaaatggttgctagagtggccgataacatcaatcaggtcaaccgcgagattggctggatggaagggggacaactcgtgctgggcaatcccgctcctatcccccggcacgccccgatccctagatatagcacctacctgatgcttctcctgattgtttcttatgcctccgcttgtagcgagctgatccaggcgtctagccgcattacaacctgctccacagagggggtgaacacgaagtgtcggctcagcggcaccgccctgatcagagctggatctgtcggcgccgaagcctgccttatgctgaagggggtgaaagaggaccagacaaagttcctcaaaattaagaccgtgtccagcgaactgtcctgccgcgagggacagtcttactggacaggcagcttttcccccaaatgtctgtctagccggagatgccatcttgtcggggaatgtcacgttaatcgctgcctctcctggcgggataacgagacctctgctgagttcagctttgtgggagaatccacgaccatgagagagaataagtgtttcgaacaatgcggcgggtggggctgtggatgctttaacgtgaatcccagctgtctgttcgtccacacatatctgcagtctgtgcggaaggaggccctccgcgtttttaactgcatcgactgggtgcataaactgacccttgaaatcacagatttcgacggctccgtcagcaccattgatctgggggcgtcttccagcagatttacgaattggggatctgtgtccctcagcctggacgctgagggcatctccgggagcaactctttcagcttcattgagtcccctggaaagggctacgccatcgttgatgaaccgttttctgagattccccggcaggggttcctgggcgaaatcagatgtaatagcgagtcctctgtgcttagcgcccacgaatcctgcctccgcgctcctaacctgatctcttataaacccatgattgaccagctggagtgcacaaccaatctcatcgatccttttgtcgtgttcgagcggggaagcctgccccaaacaagaaacgacaagacctttgccgcgtccaaaggcaaccgcggggttcaggctttcagcaagggatctgtgcaggccgatcttaccctgatgtttgacaatttcgaagtcgactttgtgggcgccgctgtgtcctgtgatgccgctttcctcaacctgacagggtgctacagctgtaatgccggagcgagagtctgcctgtctattacgtccaccggcacaggcacccttagcgcccataacaaggacgggtccctccacatcgttctgccttctgagaatggaacaaaagatcaatgtcagattctgcattttaccgtgcccgaagtggaggaggagttcatgtacagctgcgacggcgatgagcggccgctcctggtcaaggggacgcttatcgctatcgacccttttgatgaccgcagagaagccggaggcgagtccacagtggttaaccccaaaagcgggtcttggaatttcttcgattggttttccggactgatgagctggttcggcggccctctcaagaccattctgctgatctgtctttatgtggctctgtctattgggctctttttcctgctcatctacctgggacggaccggccttagcaaaatgtggctggccgccacaaagaaggcttcctga

SEQ ID NO: 14389 - RNA, 3594 nt, synthetic construct
  misc_feature 1..3594: note = derived and/or modified CDS sequence (opt5) from RVFV(ZC-3349)__DQ380207.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggactccgggcagaccaagagagagctgaaatctttcgatatttctcaatgccccaagatcggaggccacgggagcaagaaatgtaccggagacgccgccttttgctccgcttacgaatgtacagcccagtatgcgaacgcttactgctctcatgccaatggcagcggcattgtgcagatccaagtttccggggtgtggaagaaacctctttgtgtcggatatgagcgggtggtcgtgaagcgcgaactgagcgccaaaccgattcagagagttgagccctgcacgacctgtatcacaaagtgcgagcctcacggcctcgtggtccggtctaccgggttcaagatctccagcgctgtggcctgcgcttctggagtttgtgtgacaggctcccagagcccctccaccgaaattacgctgaaataccctgggatctctcagagctccggcggagatattggcgtccatatggcccacgacgaccaagcggtgtctagcaagatcgtggcccattgtcccccgcaggatccttgccttgttcacgggtgcattgtctgtgctcacggactgatcaactatcagtgccatacagccctctccgctttcgtggtggtctttgtgttcagctctatcgccattatctgtctggcgattctgtacagagttctcaaatgcctgaagatcgctccccgcaaagtgcttaatcctctgatgtggattaccgcttttatccggtggatttacaagaaaatggtcgccagagtggctgacaacatcaaccacgttaatcgcgagatcggctggatggaagggggacagctcgtgctgggcaaccccgcccctattccccggcatgccccgatccctagatattccacctacctgatgcttctcctgattgtcagctatgcttctgcgtgttccgagctgatccaagccagctctcgcattacaacctgcagcacagagggggtgaatacgaagtgtcggctctccggcaccgctctgatcagagccggaagcgttggcgccgaagcctgccttatgctgaagggggtgaaagaggatcagacaaagttcctcaaaatcaagaccgtctcttccgaactgagctgccgcgagggacagtcctactggacaggctcttttagccccaaatgtctgtcctctcggagatgccaccttgtgggggaatgtcacgtgaaccgctgcctcagctggcgggacaatgagacctccgccgagttctcttttgtcggagaaagcacgaccatgagagagaacaagtgtttcgaacagtgcggcgggtggggctgtggatgctttaatgttaacccctcctgtctgttcgtgcatacatatctgcaaagcgtgcggaaggaggcgctccgcgtctttaattgcattgattgggtgcacaaactgacccttgaaatcacagacttcgatggctctgtttccaccattgacctgggggcttctagctccagatttacgaactggggaagcgtgtctctctccctggatgccgagggcatcagcgggtccaatagcttctctttcattgagagccctggaaagggctacgccatcgtcgacgaaccgttttccgagatcccccggcaggggttcctgggcgaaattagatgtaactctgagagctccgtgctttctgctcatgaaagctgcctcaaagcccctaatctgatctcctataagcccatgattgatcagctggagtgcacaaccaacctcatcgacccttttgttgtgttcgagcgcggatctctgccccagacacggaatgataaaacctttgcggctagcaagggcaacagaggggtccaagccttctccaagggaagcgtgcaggccgaccttaccctgatgtttgacaacttcgaagttgattttgtgggcgctgccgtctcttgtgacgctgccttcctcaatctgacagggtgctactcctgtaacgcgggagcccgcgtgtgcctgagcattacgtctaccggcacaggctcccttagcgctcacaataaagatgggtccctccatatcgtgctgccttctgagaacggaaccaaggaccagtgtcaaatcctgcactttacagtccccgaagttgaggaggagttcatgtacagctgcgatggcgacgagagaccgctcctggtgaaagggacccttattgccatcgatccttttgacgatcggcgcgaagctggaggcgagtccacggtggtcaatcccaagagcgggtcttggaacttcttcgactggttttccggactgatgagctggttcggcggccctctcaaaacaattctgctgatctgtctttatgtggccctgtctattgggctctttttcctgctcatctacctgggaagaaccggccttagcaagatgtggctggccgctaccaagaaagcgtcctga

SEQ ID NO: 14390 - RNA, 3594 nt, synthetic construct
  misc_feature 1..3594: note = derived and/or modified CDS sequence (opt5) from RVFV(2007001602)__EU574043.1__GP
  source 1..3594: mol_type = other RNA
atgtacgtgctgctcaccatcctgattagcgtccttgtttgcgaggccgtgatcagagtgtccatttctagcacacgggaagagacgtgtttcggcgactccaccaaccccgaaatgatcgagggggcttgggattctctgcgcgaagaggagatgcctgaagaactcagctgctccgtctctggaattagagaagtgaagacaagctcccaggagctgtatcgggcccttaaagcgatcatcgctgccgacggcctgaataacattacctgtcacgggaagaatccggaggataaaatcagcctcattaagggaccccctcataaaaagcgcgttggcatcgtgagatgcgaacggcgcagagacgccaagcaaattgggcgggagacaatggctggaatcgccatgaccgtcctgcccgctctggccgtgtttgcgctcgcccctgttgtgttcgctgaagatccccatctgcgcaacagacctggcaaaggccacaattacattgacgggatgacacaggaggatgccacctgtaagccggtcacgtatgctggagcctgcagctcctttgacgtgcttctggaaaaaggcaagttccccctctttcagagctacgcgcaccatcggaccctgcttgaggccgtgcacgatacaatcatcgctaaagccgaccctccctcttgtgatctgcagtccgctcacgggaacccttgcatgaaggagaagctcgtcatgaaaacccattgtcccaatgactatcaaagcgcccactacctgaacaatgatggaaagatggcctctgttaaatgcccgcctaagtatgaactgacagaggactgtaacttctgccgccagatgaccggcgcttccctcaaaaaggggagctaccccctgcaggaccttttctgccagtcctctgaagatgacggaagcaaactgaagacgaagatgaaaggcgtgtgtgaggtgggcgtccaagcgctcaagaaatgcgatgggcagctgtccacagcccatgaagtggttcctttcgctgtgtttaagaatagcaaaaaggtctaccttgacaagctggatctcaaaaccgaggagaacctgctgcccgactctttcgtgtgttttgaacacaagggacagtataaaggcacaatggattccgggcagaccaagagagagctcaaatctttcgacatttctcaatgccccaagatcggaggccacgggagcaagaaatgtaccggagatgccgccttttgctccgcttacgaatgtacagcccagtatgcgaatgcttactgctctcatgccaacggcagcggcattgttcagatccaagtgtccggggtctggaagaaacctctgtgtgtgggatatgagcgggtcgtggttaagcgcgaacttagcgccaaaccgattcagagagtggagccctgcacgacctgtatcacaaagtgcgagcctcacggcctggtcgtgcggtctaccgggttcaagatctccagcgctgttgcctgcgcttctggagtgtgtgtcacaggctcccagagcccctccaccgaaattacgctcaaataccctgggatctctcagagctccggcggagacattggcgtgcatatggcccacgatgaccaatctgtgagctccaagatcgttgcgcattgtcccccgcaggacccttgcctggtccacgggtgcattgtgtgtgcccacggacttatcaattatcagtgccatacagctctgagcgccttcgtggtcatctttgtgttctcttccaccgctattatctgtctcgccgttctgtacagagtgctgaaatgcctcaagattgcgccccgcaaagtcctgaaccctcttatgtggatcaccgcctttattcggtgggtgtacaagaaaatggttgctagagtggccgataacatcaatcaggtcaaccgcgagattggctggatggaagggggacaactggctctcggcaatcccgcccctatcccccggcacgccccgatccctagatatagcacatacctgatgctgcttctcattgtgtcttatgcttccgcgtgtagcgagctgatccaggcctctagccgcattaccacatgctccacggagggggttaacaccaagtgtcggctgagcggcacagctctcatcagagccggatctgtgggcgccgaggcttgcctgatgcttaagggggtcaaagaggaccagaccaagttcctgaaaattaagacagtgtccagcgaactctcctgccgcgagggacagtcttactggaccggcagcttttcccccaaatgtctgtctagccggagatgccatctggtgggggaatgtcacgtcaatcgctgcctttcctggcgggataacgagacgtctgccgagttcagctttgttggagaatccaccacaatgagagagaataagtgtttcgaacaatgcggcgggtggggctgtggatgctttaacgtgaatcccagctgtctcttcgtgcacacctatctgcagtctgtccggaaggaggcgctgcgcgtgtttaactgcatcgactgggttcataaactcacactggaaatcaccgatttcgacggctccgtgagcacgattgatcttggggcttcttccagcagatttacaaattggggatctgtctccctgagcctcgacgccgagggcatctccgggagcaactctttcagcttcattgagtcccctggaaagggctacgccatcgtggatgaaccgttttctgagattccccggcaggggttcctgggcgaaatcagatgtaatagcgagtcctctgttctgagcgctcacgaatcctgccttcgcgcccctaacctcgtgtcttataaacccatgatcgaccagctggagtgcaccacaaatctgattgatccttttgtcgtgttcgagcggggaagcctcccccaaaccagaaacgacaagacctttgcggcttccaaaggcaaccgcggggttcaggccttcagcaagggatctgtgcaggccgatctgacacttatgtttgacaatttcgaagtcgactttgtgggcgctgccgtgtcctgtgatgctgccttcctgaacctcacggggtgctacagctgtaatgcgggagccagagtctgcctgtctatcacctccacaggcaccggcacactgagcgctcataacaaggacgggtcccttcacattgttctcccttctgagaatggaaccaaagatcaatgtcagatcctgcattttacggtgcccgaagtggaggaggaatttatgtacagctgcgacggcgatgagcggccgctgctcgtcaaggggacactgattgccatcgacccttttgatgaccgcagagaagctggaggcgagtccaccgtggttaaccccaaaagcgggtcttggaatttcttcgattggttttccggacttatgagctggttcggcggccctctgaagaccatcctcctgatttgtctgtatgtggccctttctatcgggctgtttttcctcctgatttacctcggacggacaggcctgagcaaaatgtggcttgccgctaccaagaaggcgtcctga

SEQ ID NO: 14391 - RNA, 3594 nt, synthetic construct
  misc_feature 1..3594: note = derived and/or modified CDS sequence (opt5) from RVFV(1260/78)__DQ380214.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaggaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggactccgggcagaccaagagagagctgaaatctttcgatatttctcaatgccccaagatcggaggccacgggagcaagaaatgtaccggagacgccgccttttgctccgcttacgaatgtacagcccagtatgcgaacgcttactgctctcatgccaatggcagcggcattgtgcagatccaagtttccggggtgtggaagaaacctctttgtgtcggatatgagcgggtggtcgtgaagcgcgaactgagcgccaaaccgattcagagagttgagccctgcacgacctgtatcacaaagtgcgagcctcacggcctcgtggtccggtctaccgggttcaagatctccagcgctgtggcctgcgcttctggagtttgtgtgacaggctcccagagcccctccaccgaaattacgctgaaataccctgggatctctcagagctccggcggagatattggcgtccatatggcccacgacgaccaatctgtgagctccaagatcgtggcgcattgtcccccgcaggatccttgccttgttcacgggtgcattgtctgtgcccacggactgatcaactatcagtgccatacagctctcagcgccttcgtggtggtctttgtgttctcttccatcgctattatctgtctggccattctgcacagagttctcaaatgcctgaagatcgcgccccgcaaagtgcttaatcctctgatgtggattaccgcctttatccggtgggtctacaagaaaatggtggctagagttgccgacaacattaaccaggtgaatcgcgagatcggctggatggaagggggacaactcgtcctgggcaaccccgctcctatcccccggcatgccccgattcctagatacagcacctatctgatgcttctcctgatcgtgtcttacgcctccgcttgtagcgagctgattcaggcgtctagccgcatcacaacctgctccacagagggggttaatacgaagtgtcggctcagcggcaccgccctgattagagctggatctgtgggcgccgaagcctgccttatgctgaagggggtcaaagatgaccagacaaagttcctcaaaatcaagaccgtgtccagcgagctgtcctgccgcgaaggacagtcttattggacaggcagcttttcccccaaatgtctgtctagccggagatgccaccttgtgggggagtgtcacgtcaaccgctgcctctcctggcgggataatgaaacctctgctgagttcagctttgttggagagtccacgaccatgagagaaaacaagtgtttcgagcaatgcggcgggtggggctgtggatgctttaatgtgaaccccagctgtctgttcgtgcatacatacctgcagtctgtccggaaggaagccctccgcgtgtttaattgcatcgactgggttcacaaactgacccttgagattacagatttcgacggctccgtgagcaccatcgatctgggggcgtcttccagcagatttacgaactggggatctgtctccctcagcctggacgctgaaggcatttccgggagcaattctttcagcttcatcgagtcccctggaaagggctatgccattgtggatgagccgttttctgaaatcccccggcaggggttcctgggcgagatcagatgtaacagcgaatcctctgttcttagcgcccatgagtcctgcctccgcgctcctaatctgatttcttacaaacccatgatcgaccagctggaatgcacaaccaacctcattgatccttttgtggtcttcgagcggggaagcctgccccaaacaagaaatgacaagacctttgccgcgtccaaaggcaaccgcggggtgcaggctttcagcaagggatctgttcaggccgaccttaccctgatgtttgataacttcgaggtggactttgtcggcgccgctgtgtcctgtgatgccgctttcctcaatctgacagggtgctatagctgtaacgccggagcgagagtgtgcctgtctatcacgtccaccggcacaggcacccttagcgcccacaataaggacgggtccctccatattgtcctgccttctgaaaacggaacaaaagatcaatgtcagatcctgcactttaccgttcccgaggtggaagaggagttcatgtacagctgcgacggcgatgaacggccgctcctggtgaaggggacgcttatcgctattgacccttttgatgaccgcagagaggccggaggcgaatccacagtcgtgaatcccaaaagcgggtcttggaacttcttcgattggttttccggactgatgagctggttcggcggccctctcaagaccatcctgctgatttgtctttacgttgctctgtctatcgggctctttttcctgctcatttatctgggacggaccggccttagcaaaatgtggctggccgccacaaagaaggcttcctga

SEQ ID NO: 14392 - RNA, 3594 nt, synthetic construct
  misc_feature 1..3594: note = derived and/or modified CDS sequence (opt5) from RVFV(2007000324)__JF326195.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagacatcggcgtgcatatggcccacgatgaccaatctgtgagctccaagattgttgcgcattgtcccccgcaggacccttgccttgtccacgggtgcatcgtgtgtgcccacggactgattaattatcagtgccatacagctctcagcgccttcgtggtcatctttgtgttctcttccaccgctatcatttgtctggccgttctgtacagagtgctcaaatgcctgaagatcgcgccccgcaaagtccttaaccctctgatgtggattaccgcctttatccggtgggtgtacaagaaaatggttgctagagtggccgataacattaatcaggtcaaccgcgagatcggctggatggaagggggacaactcgctctgggcaatcccgcccctattccccggcacgccccgatccctagatatagcacatacctgatgcttctcctgatcgtgtcttatgcttccgcgtgtagcgagctgattcaggcctctagccgcatcaccacatgctccacggagggggttaacaccaagtgtcggctcagcggcacagctctgattagagccggatctgtgggcgccgaggcttgccttatgctgaagggggtcaaagaggaccagaccaagttcctcaaaatcaagacagtgtccagcgaactgtcctgccgcgagggacagtcttactggaccggcagcttttcccccaaatgtctgtctagccggagatgccatcttgtgggggaatgtcacgtcaatcgctgcctctcctggcgggataacgagacgtctgccgagttcagctttgttggagaatccaccacaatgagagagaataagtgtttcgaacaatgcggcgggtggggctgtggatgctttaacgtgaatcccagctgtctgttcgtgcacacctatctgcagtctgtccggaaggaggcgctccgcgtgtttaactgcattgactgggttcataaactgacacttgaaatcaccgatttcgacggctccgtgagcacgatcgatctgggggcttcttccagcagatttacaaattggggatctgtctccctcagcctggacgccgagggcatttccgggagcaactctttcagcttcatcgagtcccctggaaagggctacgccattgtggatgaaccgttttctgagatcccccggcaggggttcctgggcgaaattagatgtaatagcgagtcctctgttcttagcgctcacgaatcctgcctccgcgcccctaacctggtgtcttataaacccatgatcgaccagctggagtgcaccacaaatctcatcgatccttttgtcgtgttcgagcggggaagcctgccccaaaccagaaacgacaagacctttgcggcttccaaaggcaaccgcggggttcaggccttcagcaagggatctgtgcaggccgatcttacactgatgtttgacaatttcgaagtcgactttgtgggcgctgccgtgtcctgtgatgctgccttcctcaacctgacggggtgctacagctgtaatgcgggagccagagtctgcctgtctattacctccacaggcaccggcacacttagcgctcataacaaggacgggtccctccacatcgttctgccttctgagaatggaaccaaagatcaatgtcagattctgcattttacggtgcccgaagtggaggaggagttcatgtacagctgcgacggcgatgaacggccgctcctggtcaaggggacacttatcgccattgacccttttgatgaccgcagagaagctggaggcgagtccaccgtggttaaccccaaaagcgggtcttggaatttcttcgattggttttccggactgatgagctggttcggcggccctctcaagaccatcctgctgatctgtctttatgtggccctgtctattgggctctttttcctgctcatctacctgggacggacaggccttagcaaaatgtggctggccgctaccaagaaggcgtcctga

SEQ ID NO: 14393 - RNA, 3594 nt, synthetic construct
  misc_feature 1..3594: note = derived and/or modified CDS sequence (opt5) from RVFV(KEN/Gar-Msq/131B-04/06)__HM586972.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattcttttcgcgaagaggagatgcctgaagaactcagctgctccgtctctggaatcagagaagtgaagacaagctcccaggagctgtatcgggcccttaaagcgattatcgctgccgacggcctgaataacatcacctgtcacgggaagaatccggaggataaaattagcctcatcaagggaccccctcataaaaagcgcgttggcattgtgagatgcgaacggcgcagagacgccaagcaaatcgggcgggagacaatggctggaattgccatgaccgtcctgcccgctctggccgtgttcgcgctcgcccctgttgtgtttgctgaagatccccatctgcgcaacagacctggcaaaggccacaattacatcgacgggatgacacaggaggatgccacctgtaagccggtcacgtatgctggagcctgcagctccttcgacgtgcttctggaaaaaggcaagtttcccctcttccagagctacgcgcaccatcggaccctgcttgaggccgtgcacgatacaattatcgctaaagccgaccctccctcttgtgatctgcagtccgctcacgggaacccttgcatgaaggagaagctcgtcatgaaaacccattgtcccaatgactatcaaagcgcccactacctgaacaatgatggaaagatggcctctgttaaatgcccgcctaagtatgaactgacagaggactgtaacttttgccgccagatgaccggcgcttccctcaaaaaggggagctaccccctgcaggaccttttctgccagtcctctgaagatgacggaagcaaactgaagacgaagatgaaaggcgtgtgtgaggtgggcgtccaagcgctcaagaaatgcgatgggcagctgtccacagcccatgaagtggttccttttgctgtgttcaagaatagcaaaaaggtctaccttgacaagctggatctcaaaaccgaggagaacctgctgcccgactcttttgtgtgtttcgaacacaagggacagtataaaggcacaatggattccgggcagaccaagagagagctcaaatcttttgacatctctcaatgccccaagattggaggccacgggagcaagaaatgtaccggagatgccgccttctgctccgcttacgaatgtacagcccagtatgcgaatgcttactgctctcatgccaacggcagcggcatcgttcagattcaagtgtccggggtctggaagaaacctctgtgtgtgggatatgagcgggtcgtggttaagcgcgaacttagcgccaaaccgatccagagagtggagccctgcacgacctgtattacaaagtgcgagcctcacggcctggtcgtgcggtctaccgggttcaagatctccagcgctgttgcctgcgcttctggagtgtgtgtcacaggctcccagagcccctccaccgaaatcacgctcaaataccctgggatttctcagagctccggcggagacatcggcgtgcatatggcccacgatgaccaatctgtgagctccaagattgttgcgcattgtcccccgcaggacccttgcctggtccacgggtgcatcgtgtgtgcccacggacttattaattatcagtgccatacagctctgagcgcctttgtggtcatcttcgtgttttcttccaccgctatcatttgtctcgccgttctgtacagagtgctgaaatgcctcaagatcgcgccccgcaaagtcctgaaccctcttatgtggattaccgccttcatccggtgggtgtacaagaaaatggttgctagagtggccgataacattaatcaggtcaaccgcgagatcggctggatggaagggggacaactggctctcggcaatcccgcccctattccccggcacgccccgatccctagatatagcacatacctgatgctgcttctcatcgtgtcttatgcttccgcgtgtagcgagctgattcaggcctctagccgcatcaccacatgctccacggagggggttaacaccaagtgtcggctgagcggcacagctctcattagagccggatctgtgggcgccgaggcttgcctgatgcttaagggggtcaaagaggaccagaccaagtttctgaaaatcaagacagtgtccagcgaactctcctgccgcgagggacagtcttactggaccggcagcttctcccccaaatgtctgtctagccggagatgccatctggtgggggaatgtcacgtcaatcgctgcctttcctggcgggataacgagacgtctgccgagtttagcttcgttggagaatccaccacaatgagagagaataagtgttttgaacaatgcggcgggtggggctgtggatgcttcaacgtgaatcccagctgtctctttgtgcacacctatctgcagtctgtccggaaggaggcgctgcgcgtgttcaactgcattgactgggttcataaactcacactggaaatcaccgattttgacggctccgtgagcacgatcgatcttggggcttcttccagcagattcacaaattggggatctgtctccctgagcctcgacgccgagggcatttccgggagcaactctttcagctttatcgagtcccctggaaagggctacgccattgtggatgaaccgttctctgagatcccccggcaggggtttctgggcgaaattagatgtaatagcgagtcctctgttctgagcgctcacgaatcctgccttcgcgcccctaacctcgtgtcttataaacccatgatcgaccagctggagtgcaccacaaatctgatcgatcctttcgtcgtgtttgagcggggaagcctcccccaaaccagaaacgacaagaccttcgcggcttccaaaggcaaccgcggggttcaggcctttagcaagggatctgtgcaggccgatctgacacttatgttcgacaattttgaagtcgacttcgtgggcgctgccgtgtcctgtgatgctgcctttctgaacctcacggggtgctacagctgtaatgcgggagccagagtctgcctgtctattacctccacaggcaccggcacactgagcgctcataacaaggacgggtcccttcacatcgttctcccttctgagaatggaaccaaagatcaatgtcagattctgcatttcacggtgcccgaagtggaggaggaatttatgtacagctgcgacggcgatgagcggccgctgctcgtcaaggggacactgatcgccattgaccctttcgatgaccgcagagaagctggaggcgagtccaccgtggttaaccccaaaagcgggtcttggaatttctttgattggttctccggacttatgagctggtttggcggccctctgaagaccatcctcctgatctgtctgtatgtggccctttctattgggctgttctttctcctgatctacctcggacggacaggcctgagcaaaatgtggcttgccgctaccaagaaggcgtcctga

SEQ ID NO: 14394 - RNA, 3594 nt, synthetic construct
  misc_feature 1..3594: note = derived and/or modified CDS sequence (opt5) from RVFV(2007004194)__EU574031.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgttcttcctttgacgtgctgctcgaaaaaggcaagttccccctgtttcagagctacgcgcaccatcggacccttctggaggccgtgcacgatacaattatcgctaaagccgaccctccctcttgcgatctccagtccgctcacgggaacccttgcatgaaggagaagctggtcatgaaaacccattgtcccaatgactatcaaagcgcccactacctgtctaacgatggaaagatggcctccgttaaatgcccgcctaagtatgaactcacagaggactgtaatttctgccgccagatgaccggcgctagcctgaaaaaggggtcctacccccttcaggacctgttttgccagtctagcgaagatgacggatccaaactcaagacgaagatgaaaggcgtgtgtgaggtgggcgtccaagcgctgaagaaatgcgatgggcagcttagcacagcccatgaagtggttcctttcgctgtgtttaagaactctaaaaaggtctacctggacaagctcgatctgaaaaccgaggagaatctgctccccgactccttcgtgtgttttgaacacaagggacagtataaaggcacaatggatagcgggcagaccaagagagagctgaaatctttcgacatcagccaatgccccaagattggaggccacgggtccaagaaatgtaccggagatgccgccttttgctctgcttacgaatgtacagcccagtatgcgaacgcttactgcagccatgccaatggctccggcatcgttcagattcaagtgagcggggtctggaagaaacctctttgtgtgggatatgagcgggtcgtggttaagcgcgaactgtctgccaaaccgatccagagagtggagccctgcacgacctgtattacaaagtgcgagcctcacggcctcgtcgtgcggtccaccgggttcaagatcagctctgctgttgcctgcgcttccggagtgtgtgtcacaggcagccagtccccctctaccgaaatcacgctgaaataccctgggattagccagtcctctggcggagacatcggcgtgcatatggcccacgatgaccaaagcgtgtccagcaagattgttgcgcattgtcccccgcaggacccttgccttgtccacgggtgcatcgtgtgtgcccacggactgattaactatcagtgccatacagctctctctgccttcgtggtcgtgtttgttttctccagcatcgctatcatttgtctggccatcctgtacagagtgctcaaatgcctgaagattgcgccccgcaaagtccttaatcctctgatgtggatcaccgcctttattcggtgggtgtacaagaaaatggttgctagagtggccgataacatcaaccaggtcaatcgcgagattggctggatggaagggggacaactcgtgctgggcaaccccgctcctatcccccggcacgccccgatccctagatattctacctacctgatgcttctcctgattgtttcctatgccagcgcttgttctgagctgatccaggcgagctcccgcattacaacctgcagcacagagggggtgaatacgaagtgtcggctctctggcaccgccctgatcagagctggatccgtcggcgccgaagcctgccttatgctgaagggggtgaaagaggaccagacaaagttcctcaaaattaagaccgtgagctccgaactgtcttgccgcgagggacagagctactggacaggctccttttctcccaaatgtctgagctcccggagatgccatcttgtcggggaatgtcacgttaaccgctgcctctcttggcgggataatgagaccagcgctgagttctcctttgtgggagaaagcacgaccatgagagagaacaagtgtttcgaacaatgcggcgggtggggctgtggatgctttaatgtgaacccctcttgtctgttcgtccacacatatctgcagtccgtgcggaaggaggccctccgcgtttttaattgcatcgactgggtgcataaactgacccttgaaatcacagatttcgacggcagcgtctctaccattgatctgggggcgtccagctctagatttacgaactggggatccgtgagcctctccctggacgctgagggcatcagcgggtctaatagcttctccttcattgagtctcctggaaagggctacgccatcgttgatgaaccgtttagcgagattccccggcaggggttcctgggcgaaatcagatgtaactccgagtctagcgtgctttccgcccacgaatcttgcctccgcgctcctaatctgatcagctataaacccatgattgaccagctggagtgcacaaccaacctcatcgatccttttgtcgtgttcgagcggggatccctgccccaaacaagaaatgacaagacctttgccgcgagcaaaggcaaccgcggggttcaggctttctctaagggatccgtgcaggccgatcttaccctgatgtttgacaacttcgaagtcgactttgtgggcgccgctgtgagctgtgatgccgctttcctcaatctgacagggtgctactcttgtaacgccggagcgagagtctgcctgtccattacgagcaccggcacaggcaccctttccgcccataataaggacgggtctctccacatcgttctgcctagcgagaacggaacaaaagatcaatgtcagattctgcattttaccgtgcccgaagtggaggaggagttcatgtactcctgcgacggcgatgagcggccgctcctggtcaaggggacgcttatcgctatcgacccttttgatgaccgcagagaagccggaggcgagagcacagtggttaatcccaaatctgggtcctggaacttcttcgattggtttagcggactgatgtcttggttcggcggccctctcaagaccattctgctgatctgtctttatgtggctctgagcattgggctctttttcctgctcatctacctgggacggaccggcctttccaaaatgtggctggccgccacaaagaaggcttcttga

SEQ ID NO: 14395 - RNA, 3594 nt, synthetic construct
  misc_feature 1..3594: note = derived and/or modified CDS sequence (opt5) from RVFV(73HB1230)__DQ380221.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaagtggggcgggagacaatggctggaattgccatgaccgtcctgcccgctctcgccgtgtttgcgctggcccctgttgtgttcgctgaagacccccaccttcgcaatagacctggcaaaggccataactacatcgatgggatgacacaggaggacgccacctgtaagccggtcacgtatgctggagcctgttcttcctttgatgtgctgctcgaaaaaggcaagttccccctgtttcagagctacgcgcaccatcggacccttctggaggccgtgcacgacacaattatcgctaaagccgatcctccctcttgcgacctccagtccgctcacgggaatccttgcatgaaggagaagctggtcatgaaaacccattgtcccaacgattatcaaagcgcccactacctgaataacgacggaaagatggcctctgttaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtgtgtgaggtgggcgtccaagcgctgaagaaatgcgacgggcagctttccacagcccatgaagtggttcctttcgctgtgtttaagaacagcaaaaaggtctacctggataagctcgacctgaaaaccgaggagaatctgctccccgattctttcgtgtgttttgaacacaagggacagtataaaggcacaatggactccgggcagaccaagaaagagctgaagtccttcgatatctctcaatgccccaagattggaggccacgggagcaaaaagtgtaccggagacgccgccttttgctccgcttacgaatgtacagcccagtatgcgaacgcttactgctctcatgccaatggcagcggcatcgttcagattcaagtgtccggggtctggaaaaagcctctttgtgtgggatatgagagagtcgtggttaaacgggaactgagcgccaagccgatccagcgcgtggagccctgcacgacctgtattacaaagtgcgagcctcacggcctcgtcgtgagatctaccgggttcaaaatctccagcgctgttgcctgcgcttctggagtgtgtgtcacaggctcccagagcccctccaccgaaatcacgctgaagtaccctgggatttctcagagctccggcggagatatcggcgtgcatatggcccacgacgaccaatctgtgagctccaaaattgttgcgcattgtcccccgcaggatccttgccttgtccacgggtgcatcgtgtgtgcccacggactgattaactatcagtgccatacagctctcagcgccttcgtggtcgtgtttgttttctcttccatcgctatcatttgtctggccatcctgtaccgggtgctcaagtgcctgaaaattgcgcccagaaaggtccttaatcctctgatgtggatcaccgcctttattcgctgggtgtacaaaaagatggttgctcgggtggccgacaacatcaaccaggtcaatagagagattggctggatggaagggggacaactcgtgctgggcaaccccgctcctatcccccgccacgccccgatccctcggtatagcacctacctgatgcttctcctgattgtttcttatgcctccgcttgtagcgagctgatccaggcgtctagcagaattacaacctgctccacagagggggtgaatacgaagtgtcgcctcagcggcaccgccctgatccgggctggatctgtcggcgccgaagcctgccttatgctgaaaggggtgaaggaggatcagacaaaattcctcaagattaaaaccgtgtccagcgaactgtcctgcagagagggacagtcttactggacaggcagcttttcccccaagtgtctgtctagccgccggtgccatcttgtcggggaatgtcacgttaacagatgcctctcctggcgcgacaatgagacctctgctgagttcagctttgtgggagaatccacgatcatgcgggagaacaagtgtttcgaacaatgcggcgggtggggctgtggatgctttaatgtgaaccccagctgtctgttcgtccacacctatctgcagtctgtgagaaaagaggccctccgggtttttaattgcatcgattgggtgcataagctgacacttgaaattaccgacttcgatggctccgtcagcacaatcgacctgggggcgtcttccagccgctttaccaactggggatctgtgtccctcagcctggatgctgagggcatttccgggagcaattctttcagcttcatcgagtcccctggaaaaggctacgccattgttgacgaaccgttttctgagatccccagacaggggttcctgggcgaaatccggtgtaacagcgagtcctctgtgcttagcgcccacgaatcctgcctcagagctcctaatctgatttcttataagcccatgatcgatcagctggagtgcacgacaaacctcattgacccttttgtcgtgttcgagcgcggaagcctgccccaaacccggaatgataaaacatttgccgcgtccaagggcaacagaggggttcaggctttcagcaagggatctgtgcaggccgaccttaccctgatgtttgacaacttcgaagtcgattttgtgggcgccgctgtgtcctgtgacgccgctttcctcaatctgaccgggtgctacagctgtaacgccggagcgcgcgtctgcctgtctatcacatccacgggcaccggcacacttagcgcccataataaagatgggtccctccacattgttctgccttctgagaacggaaccaaggaccaatgtcagatcctgcattttacagtgcccgaagtggaggaggagttcatgtacagctgcgatggcgacgagagaccgctcctggtcaaagggacccttatcgctattgatccttttgacgatcggcgcgaagccggaggcgagtccacggtggttaatcccaagagcgggtcttggaacttcttcgactggttttccggactgatgagctggttcggcggccctctcaaaacaatcctgctgatttgtctttatgtggctctgtctatcgggctctttttcctgctcatttacctgggaagaaccggccttagcaagatgtggctggccgccaccaagaaagctagctga

SEQ ID NO: 14396 - RNA, 3594 nt, synthetic construct
  misc_feature 1..3594: note = derived and/or modified CDS sequence (opt5) from RVFV(73HB1449)__DQ380211.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggactccgggcagaccaagagagagctgaaatctttcgatatttctcaatgccccaagatcggaggccacgggagcaagaaatgtaccggagacgccgccttttgctccgcttacgaatgtacagcccagtatgcgaacgcttactgctctcatgccaatggcagcggcattgtgcagatccaagtttccggggtgtggaagaaacctctttgtgtcggatatgagcgggtggtcgtgaagcgcgaactgagcgccaaaccgattcagagagttgagccctgcacgacctgtatcacaaagtgcgagcctcacggcctcgtggtccggtctaccgggttcaagatctccagcgctgtggcctgcgcttctggagtttgtgtgacaggctcccagaaccccagcaccgaaattacgctgaaataccctgggatctcccagtctagcggcggagatattggcgtccatatggcccacgacgaccaatccgtgtctagcaagatcgtggcgcattgtcccccgcaggatccttgccttgttcacgggtgcattgtctgtgcccacggactgatcaattatcagtgccatacagctctctccgccttcgtggtggtctttgtgttcagctctatcgctattatctgtctggccattctgtacagagttctcaaatgcctgaagatcgcgccccgcaaagtgcttaaccctctgatgtggattaccgcctttatccggtgggtctacaagaaaatggtggctagagttgccgacaacattaatcaggtgaaccgcgagatcggctggatggaagggggacaactcgtcctgggcaatcccgctcctatcccccggcacgccccgattcctagatattccacctacctgatgcttctcctgatcgtgagctatgcctctgcttgttccgagctgattcaggcgagctctcgcatcacaacctgcagcacagagggggttaacacgaagtgtcggctctccggcaccgccctgattagagctggaagcgtgggcgccgaagcctgccttatgctgaagggggtcaaagatgaccagacaaagttcctcaaaatcaagaccgtgtcttccgagctgagctgccgcgaaggacagtcctactggacaggctcttttagccccaaatgtctgtcctctcggagatgccatcttgtgggggagtgtcacgtcaatcgctgcctcagctggcgggataacgaaacctccgctgagttctcttttgttggagagagcacgaccatgagagaaaataagtgtttcgagcaatgcggcgggtggggctgtggatgctttaacgtgaatccctcctgtctgttcgtgcacacatatctgcagagcgtccggaaggaagccctccgcgtgtttaactgcatcgactgggttcataaactgacccttgagattacagatttcgacggctctgtgtccaccatcgatctgggggcgtctagctccagatttacgaattggggaagcgtctctctctccctggacgctgaaggcattagcgggtccaacagcttctctttcatcgagagccctggaaagggctacgccattgtggatgagccgttttccgaaatcccccggcaggggttcctgggcgagatcagatgtaattctgaaagctccgttctttctgcccacgagagctgcctccgcgctcctaacctgatttcctataaacccatgatcgaccagctggaatgcacaaccaatctcattgatccttttgtggtcttcgagcggggatctctgccccaaacaagaaacgagaagacctttgccgcgagcaaaggcaaccgcggggtgcaggctttctccaagggaagcgttcaggccgaccttaccctgatgtttgacaatttcgaagtggattttgtcggcgccgctgtgtcttgtgacgccgctttcctcaacctgacagggtgctactcctgtaatgccggagcgagagtgtgcctgagcatcacgtctaccggcacaggcaccctttccgcccataacaaggatgggagcctccacattgtcctgccttccgagaatggaacaaaagaccaatgtcagatcctgcattttaccgttcccgaagtggaggaggagttcatgtactcttgcgatggcgacgagcggccgctcctggtgaaggggacgcttatcgctattgatccttttgacgatcgcagagaagccggaggcgagagcacagtcgtgaaccccaaatccgggagctggaatttcttcgactggttttctggactgatgtcctggttcggcggccctctcaagaccatcctgctgatttgtctttatgttgctctgagcatcgggctctttttcctgctcatttacctgggacggaccggcctttctaaaatgtggctggccgccacaaagaaggctagctga

SEQ ID NO: 14397 - RNA, 3594 nt, synthetic construct
  misc_feature 1..3594: note = derived and/or modified CDS sequence (opt5) from RVFV(ZH-548M12)__M25276.1__GP
  source 1..3594: mol_type = other RNA
atgtacgtgctgctcaccatcctgacaagcgtccttgtttgcgaggccattatcagagtgtccctgtctagcacgcgggaagagacctgtttcggcgactccacaaaccccgaaatgattgagggggcttgggattctctccgcgaagaggagatgcctgaggaactgagctgctccatctctggaattagagaagtgaaaaccagctcccaggagctttatcgggccctgaaagcgatcatcgctgccgacggcctcaataacattacatgtcacgggaaggatccggaggacaaaatcagcctgattaagggaccccctcataaaaagcgcgtcggcatcgtgagatgcgaacggcgcagagatgccaagcaaattgggcggaaaaccatggctggaatcgccatgacagttctgcccgctctcgccgtgtttgcgctggcccctgtcgtgttcgctgaggacccccaccttcgcaatagacctggcaagggccataactacattgatgggatgacccaggaagacgccacgtgtaaaccggttacctatgctggagcctgttcttcctttgatgtgctgctcgagaagggcaaattccccctgtttcagagctacgcgcaccatcggacacttctggaagccgtccacgacaccatcatcgctaaggccgatcctccctcttgcgacctcctgtccgctcacgggaatccttgcatgaaggagaaactggtgatgaagacacattgtcccaacgattatcagagcgcccaccatctcaataacgacggaaaaatggcctctgtgaagtgcccgcctaaatacgagctgaccgaagactgtaatttctgccgccaaatgacgggcgcttcccttaagaaagggagctatcccctgcaggatctcttttgccagtcctctgaggacgatggaagcaagctgaagacaaaaatgaagggcgtctgtgaagttggcgtgcaggcgcttaaaaagtgcgacgggcaactgtccaccgcccacgaggtggtccctttcgctgtgtttaaaaacagcaagaaggtttacctcgataaactggacctgaagacagaagagaatctcctgcccgattctttcgtgtgttttgagcacaaaggacagtacaagggcaccatggactccgggcagaccaaaagagaacttaagagcttcgatatttctcagtgccccaagatcggaggccatgggagcaaaaagtgtacaggagacgccgccttttgctccgcttatgagtgtacggcccaatacgcgaacgcttattgctctcacgccaatggcagcggcattgtccagatccaggtgtccggggtttggaaaaagcctctgtgtgtgggatacgaacgggtcgtggtcaaacgcgagctcagcgccaagccgattcaaagagtggaaccctgcaccacatgtatcaccaagtgcgagcctcatggcctggttgtgcggtctacagggttcaaaatctccagcgctgtcgcctgcgcttctggagtgtgtgttaccggctcccagagcccctccacggagattacacttaagtatcctgggatctctcagagctccggcggagatattggcgtgcacatggcccatgacgaccagtctgtcagctccaaaatcgtggcgcactgtcccccgcaagatccttgcctggtgcacgactgcattgtttgtgcccatgggctcatcaactaccagtgccacaccgctctgagcgccttcgtcgtggtgtttgtcttctcttccatcgctattatctgtctggccattctctatagagtgctgaagtgccttaaaatcgcgccccgcaaggttctgaatcctctcatgtggattaccgcctttatccggtggatttacaaaaagatggtggctagagtcgccgataacatcaaccaggtgaatcgcgaaatcggatggatggagggcgggcagctggttctgggaaaccccgctcctattccccggcatgccccgatccctagatacagcacatatcttatgctcctgctgattgtgtcttacgcctccgcttgtagcgaactcatccaagcgtctagccgcattaccacatgctccacggagggcgtcaataccaagtgtcggctgagcgggacagcccttatcagagctggctctgtgggagccgaggcctgcctgatgctcaaaggcgttaaggaagaccagaccaaattcctgaagctgaaaacagtgtccagcgagctttcctgccgcgaagggcagtcttattggaccgggagcttttcccccaagtgtctctctagccggagatgccacctggtcggcgagtgtcacgtgaaccgctgcctgtcctggcgggataatgaaacgtctgctgagttcagctttgtgggggagtccaccacaatgagagaaaacaagtgtttcgagcagtgcggaggctgggggtgtggctgctttaatgtcaaccccagctgtctcttcgttcatacctacctgcaatctgtgcggaaagaagcccttcgcgtgtttaattgcatcgactgggtccacaagctgacactcgagattaccgatttcgacggatccgtgagcacgatcgatctgggcgcgtcttccagcagatttacaaactgggggtctgtttccctgagccttgacgctgaaggaatttccggcagcaattctttcagcttcatcgagtcccctgggaaaggatatgccattgtggatgagccgttttctgaaatcccccggcagggcttcctcggggagatcagatgtaacagcgaatcctctgtcctgagcgcccatgagtcctgcctgcgcgctcctaatctcatttcttacaagcccatgatcgaccagctggaatgcaccacaaaccttattgatccttttgtggttttcgagcggggcagcctgccccagaccagaaatgacaaaacctttgccgcgtccaagggaaaccgcggcgtgcaggctttcagcaaggggtctgtccaagccgacctcacactgatgtttgataacttcgaggtggactttgttggagccgctgtgtcctgtgatgccgctttcctgaatcttacgggctgctatagctgtaacgccggggcgagagtctgcctctctatcacctccacaggaaccggcagcctgtccgcccacaataaagacggctctctgcatattgtgctccctagcgaaaacgggacaaaggatcagtgtcaaatcctgcactttaccgtgcccgaggtcgaagaggagttcatgtactcctgcgacggagatgaacggccgcttctggttaaaggcacgctcatcgctattgacccttttgatgaccgcagagaggccgggggagaaagcacagtggtgaatcccaagtctggctcctggaacttcttcgattggtttagcgggctgatgtcttggttcggaggccctctgaaaaccatccttctgatttgtctctacgtcgctctgagcatcggcctctttttcctgcttatttatctgggaggaaccggcctctccaagatgtggctggccgccacaaagaaggcttcttga

SEQ ID NO: 14398 - RNA, 3594 nt, synthetic construct
  misc_feature 1..3594: note = derived and/or modified CDS sequence (opt5) from RVFV(ZINGA J83 R1)__KU978776.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgttcttcctttgatgtcctgctcgaaaaaggcaagttccccctgtttcagagctacgcgcaccatcggacccttctggaggccgtgcacgacacaatcatcgctaaagccgatcctccctcttgcgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgcctgatgaccggcgcttcccttaaaaaggggagctaccccctgcaggatctcttttgccagtcctctgaagacgatggaagcaaactgaagacgaagatgaaaggcgtttgtgaggtgggcgtgcaggcgcttaagaaatgcgacgggcaactgtccacagcccatgaagtcgtgcctttcgctgtttttaagaacagcaaaaaggtgtacctcgataagctggacctgaaaaccgaggagaatctcctgcccgattctttcgtctgttttgaacacaagggacagtataaaggcacaatggactccgggcagaccaagagagagcttaagagcttcgatatttctcagtgccccaagatcggaggccacgggagcaagaaatgtaccggagacgccgccttttgctccgcttacgaatgtacagcccaatatgcgaacgcttactgctctcatgccaatggcagcggcattgtgcagatccaggtttccggggtgtggaagaaacctctgtgtgtcggatatgagcgggtggtcgtgaagcgcgaactcagcgccaaaccgattcaaagagttgagccctgcacgacctgtatcacaaagtgcgagcctcacggcctggtggtccggtctaccgggttcaagatctccagcgctgtggcctgcgcttctggagtttgtgtgacaggctcccagagcccctccaccgaaattacgcttaaataccctgggatctctcagagctccggcggagatattggcgtccatatggcccacgacgaccagtctgtgagctccaagatcgtggcgcattgtcccccgcaagatccttgcctggttcacgggtgcattgtctgtgcccacggactcatcaactatcagtgccatacagctctgagcgccttcgtggtggtctttgtgttctcttccatcgctattatctgtctggccattctctacagagttctgaaatgccttaagatcgcgccccgcaaagtgctgaatcctctcatgtggattaccgcctttatccggtgggtctacagaaagatggtggctcgcgttgccgacaacattaaccaggtgaatcgggagatcggctggatggaagggggacagctggtcctgggcaaccccgctcctatccccagacacgtgccgattcctcgctatagcacctaccttatgctcctgctgatcgtttcttatgcctccgcctgtagcgagctcattcaggcttctagccggatcacaacctgctccacagagggggtgaatacgaaatgtagactgagcggcaccgcgcttattcgcgccggatctgtcggcgctgaagcctgcctgatgctcaagggggtgaaggaggatcaaacaaaattcctgaagatcaaaaccgtgtccagcgaactgtcctgccgggagggacagtcttactggacaggcagcttttcccccaagtgtctttctagcagacgctgccatctcgtcggggaatgtcacgttaaccggtgcctgtcctggagagacaatgagacctctgccgagttcagctttgtgggagaatccacgaccatgcgggagaacaaatgtttcgaacagtgcggcgggtggggctgtggatgctttaatgtgaaccccagctgtctgttcgtccacacatatctccaatctgtgcgcaaggaggctctgagagtttttaattgcatcgattgggtgcataaacttaccctggaaattacagacttcgatggctccgtcagcaccatcgacctcggggcctcttccagccggtttacgaactggggatctgtgtccctgagcctggatgcggagggcatttccgggagcaattctttcagcttcatcgagtcccctggaaaaggctacgctattgttgacgaaccgttttctgagatccccagacaggggttccttggcgaaatccgctgtaacagcgagtcctctgtgctcagcgcccacgaatcctgcctgcgggcccctaatctgatttcttataagcccatgatcgatcagctcgagtgcacaaccaacctgattgacccttttgtcgtgttcgagagaggaagccttccccagacacgcaatgataaaacctttgctgcctccaagggcaacagaggggttcaagcgttcagcaaaggatctgtgcaggctgacctgaccctcatgtttgacaacttcgaagtcgattttgtgggcgccgccgtgtcctgtgacgctgccttcctgaatctgacagggtgctacagctgtaacgctggagcccgggtctgcctttctatcacgtccaccggcacaggcaccctcagcgcgcataataaggatgggtccctgcacattgttctgccttctgagaacggaacaaaggaccagtgtcaaatcctccattttaccgtgcccgaagtggaggaggagttcatgtacagctgcgatggcgacgagcgcccgctgcttgtcagagggacgctgatcgccattgatccttttgacgatcggcgcgaagctggaggcgagtccacagtggttaatcccaaaagcgggtcttggaacttcttcgactggttttccggactcatgagctggttcggcggccctctgaagaccatcctgcttatttgtctgtatgtggccctctctatcgggctgtttttcctcctgatttaccttggaagaaccggcctgagcaaaatgtggctcgctgccacaaagaaagcctcctga

SEQ ID NO: 14399 - RNA, 3594 nt, synthetic construct
  misc_feature 1..3594: note = derived and/or modified CDS sequence (opt5) from RVFV(Sudan 28-2010)__JQ820491.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagacatcggcgtgcatatggcccacgatgaccaatctgtgagctccaagattgttgcgcattgtcccccgcaggacccttgccttgtccacgggtgcatcgtgtgtgcccacggactgattaattatcagtgccatacagctctcagcgccttcgtggtcgtgtttgttttctcttccatcgctatcatttgtctggccatcctgtacagagtgctcaaatgcctgaagattgcgccccgcaaagtccttaaccctctgatgtggatcaccgcctttattcggtgggtgtacaagaaaatggttgctagagtggccgataacatcaatcaggtcaaccgcgagattggctggatggaagggggacaactcgtgctgggcaatcccgctcctatcccccggcacgccccgatccctagatatagcacctacctgatgcttctcctgattgtttcttatgcctccgcttgtagcgagctgatccaggcgtctagccgcattacaacctgctccacagagggggtgaacacgaagtgtcggctcagcggcaccgccctgatcagagctggatctgtcggcgccgaagcctgccttatgctgaagggggtgaaagaggaccagacaaagttcctcaaaattaagaccgtgtccagcgaactgtcctgccgcgagggacagtcttactggacaggcagcttttcccccaaatgtctgtctagccggagatgccatcttgtcggggaatgtcacgttaatcgctgcctctcctggcgggataacgagacctctgctgagttcagctttgtgggagaatccacgaccatgagagagaataagtgtttcgaacaatgcggcgggtggggctgtggatgctttaacgtgaatcccagctgtctgttcgtccacacatatctgcagtctgtgcggaaggaggccctccgcgtttttaactgcatcgactgggtgcataaactgacccttgaaatcacagatttcgacggctccgtcagcaccattgatctgggggcgtcttccagcagatttacgaattggggatctgtgtccctcagcctggacgctgagggcatctccgggagcaactctttcagcttcattgagtcccctggaaagggctacgccatcgttgatgaaccgttttctgagattccccggcaggggttcctgggcgaaatcagatgtaatagcgagtcctctgtgcttagcgcccacgaatcctgcctccgcgctcctaacctgatctcttataaacccatgattgaccagctggagtgcacaaccaatctcatcgatccttttgtcgtgttcgagcggggaagcctgccccaaacaagaaacgacaagacctttgccgcgtccaaaggcaaccgcggggttcaggctttcagcaagggatctgtgcaggccgatcttaccctgatgtttgacaatttcgaagtcgactttgtgggcgccgctgtgtcctgtgatgccgctttcctcaacctgacagggtgctacagctgtaatgccggagcgagagtctgcctgtctattacgtccaccggcacaggcacccttagcgcccataacaaggacgggtccctccacatcgttctgccttctgagaatggaacaaaagatcaatgtcagattctgcattttaccgtgcccgaagtggaggaggagttcatgtacagctgcgacggcgatgagcggccgctcctggtcaaggggacgcttatcgctatcgacccttttgatgaccgcagagaagccggaggcgagtccacagtggttaaccccaaaagcgggtcttggaatttcttcgattggttttccggactgatgagctggttcggcggccctctcaagaccattctgctgatctgtctttatgtggtcctgtctattgggctctttttcctgctcatctacctgggacggaccggccttagcaaaatgtggctggctgccacaaagaaggcctcctga

SEQ ID NO: 14400 - RNA, 3594 nt, synthetic construct
  misc_feature 1..3594: note = derived and/or modified CDS sequence (opt5) from RVFV(2007001292)__EU574046.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagacatcggcgtgcatatggcccacgatgaccaatctgtgagctccaagattgttgcgcattgtcccccgcaggacccttgccttgtccacgggtgcatcgtgtgtgcccacggactgattaattatcagtgccatacagctctcagcgccttcgtggtcatctttgtgttctcttccaccgctatcatttgtctggccgttctgtacagagtgctcaaatgcctgaagatcgcgccccgcaaagtccttaaccctctgatgtggattaccgcctttatccggtgggtgtacaagaaaatggttgctagagtggccgataacattaatcaggtcaaccgcgagatcggctggatggaagggggacaactcgctctgggcaatcccgcccctattccccggcacgccccgatccctagatatagcacatacctgatgcttctcctgatcgtgtcttatgcttccgcgtgtagcgagctgattcaggcctctagccgcatcaccacatgctccacggagggggttaacaccaagtgtcggctcagcggcacagctctgattagagccggatctgtgggcgccgaggcttgccttatgctgaagggggtcaaagaggaccagaccaagttcctcaaaatcaagacagtgtccagcgaactgtcctgccgcgagggacagtcttactggaccggcagcttttcccccaaatgtctgtctagccggagatgccatcttgtgggggaatgtcacgtcaatcgctgcctctcctggcgggataacgagacgtctgccgagttcagctttgttggagaatccaccacaatgagagagaataagtgtttcgaacaatgcggcgggtggggctgtggatgctttaacgtgaatcccagctgtctgttcgtgcacacctatctgcagtctgtccggaaggaggcgctccgcgtgtttaactgcattgactgggttcataaactgacacttgaaatcaccgatttcgacggctccgtgagcacgatcgatctgggggcttcttccagcagatttacaaattggggatctgtctccctcagcctggacgccgagggcatttccgggagcaactctttcagcttcatcgagtcccctggaaagggctacgccattgtggatgaaccgttttctgagatcccccggcaggggttcctgggcgaaattagatgtaatagcgagtcctctgttcttagcgctcacgaatcctgcctccgcgcccctaacctggtgtcttataaacccatgatcgaccagctggagtgcaccacaaatctcatcgatccttttgtcgtgttcgagcggggaagcctgccccaaaccagaaacgacaagacctttgcggcttccaaaggcaaccgcggggttcaggccttcagcaagggatctgtgcaggccgatcttacactgatgtttgacaatttcgaagtcgactttgtgggcgctgccgtgtcctgtgatgctgccttcctcaacctgacggggtgctacagctgtaatgcgggagccagagtctgcctgtctattacctccacaggcaccggcacacttagcgctcataacaaggacgggtccctccacatcgttctgccttctgagaatggaaccaaagatcaatgtcagattctgcattttacggtgcccgaagtggaggaggagttcatgtacagctgcgacggcgatgaacggccgctcctggtcaaggggacacttatcgccattgacccttttgatgaccgcagagaagctggaggcgagtccaccgtggttaaccccaaaagcgggtcttggaatctgttcgattggttctccggactcatgagctggtttggcggccctctgaagaccatcctgcttatctgtctgtatgtggccctctctattgggctgttctttctcctgatctaccttggacggacaggcctgagcaaaatgtggctcgccgctaccaagaaggcgtcctga

SEQ ID NO: 14401 - RNA, 3594 nt, synthetic construct
  misc_feature 1..3594: note = derived and/or modified CDS sequence (opt5) from RVFV(Sudan 85-2010)__JQ820488.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaggaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagacatcggcgtgcatatggcccacgatgaccaatctgtgagctccaagattgttgcgcattgtcccccgcaggacccttgccttgtccacgggtgcatcgtgtgtgcccacggactgattaattatcagtgccatacagctctcagcgccttcgtggtcgtgtttgttttctcttccatcgctatcatttgtctggccatcctgtacagagtgctcaaatgcctgaagattgcgccccgcaaagtccttaaccctctgatgtggatcaccgcctttattcggtgggtgtacaagaaaatggttgctagagtggccgataacatcaatcaggtcaaccgcgagattggctggatggaagggggacaactcgtgctgggcaatcccgctcctatcccccggcacgccccgatccctagatatagcacctacctgatgcttctcctgattgtttcttatgcctccgcttgtagcgagctgatccaggcgtctagccgcattacaacctgctccacagagggggtgaacacgaagtgtcggctcagcggcaccgccctgatcagagctggatctgtcggcgccgaagcctgccttatgctgaagggggtgaaagaggaccagacaaagttcctcaaaattaagaccgtgtccagcgaactgtcctgccgcgagggacagtcttactggacaggcagcttttcccccaaatgtctgtctagccggagatgccatcttgtcggggaatgtcacgttaatcgctgcctctcctggcgggataacgagacctctgctgagttcagctttgtgggagaatccacgaccatgagagagaataagtgtttcgaacaatgcggcgggtggggctgtggatgctttaacgtgaatcccagctgtctgttcgtccacacatatctgcagtctgtgcggaaggaggccctccgcgtttttaactgcatcgactgggtgcataaactgacccttgaaatcacagatttcgacggctccgtcagcaccattgatctgggggcgtcttccagcagatttacgaattggggatctgtgtccctcagcctggacgctgagggcatctccgggagcaactctttcagcttcattgagtcccctggaaagggctacgccatcgttgatgaaccgttttctgagattccccggcaggggttcctgggcgaaatcagatgtaatagcgagtcctctgtgcttagcgcccacgaatcctgcctccgcgctcctaacctgatctcttataaacccatgattgaccagctggagtgcacaaccaatctcatcgatccttttgtcgtgttcgagcggggaagcctgccccaaacaagaaacgaaaagacctttgccgcgtccaaaggcaaccgcggggttcaggctttcagcaagggatctgtgcaggccgaccttaccctgatgtttgataatttcgaggtcgactttgtgggcgccgctgtgtcctgtgacgccgctttcctcaacctgacagggtgctacagctgtaatgccggagcgagagtctgcctgtctattacgtccaccggcacaggcacccttagcgcccataacaaggatgggtccctccacatcgttctgccttctgaaaatggaacaaaagaccaatgtcagattctgcattttaccgtgcccgaggtggaggaagagttcatgtacagctgcgatggcgacgaacggccgctcctggtcaaggggacgcttatcgctatcgatccttttgacgatcgcagagaggccggaggcgaatccacagtggttaaccccaaaagcgggtcttggaatttcttcgactggttttccggactgatgagctggttcggcggccctctcaagaccattctgctgatctgtctttatgtggctctgtctattgggctctttttcctgctcatctacctgggacggaccggccttagcaaaatgtggctggccgccacaaagaaggcttcctga

SEQ ID NO: 14402 - RNA, 3594 nt, synthetic construct
  misc_feature 1..3594: note = derived and/or modified CDS sequence (opt5) from RVFV(2007002060)__EU574039.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcaaggacgccaaacaaatcgggagagagacaatggctggaattgccatgaccgtcctgcccgctctcgccgtgtttgcgctggcccctgttgtgttcgctgaagatccccaccttcggaaccgccctggcaagggccataattacatcgacgggatgacacaggaggatgccacctgtaaaccggtcacgtatgctggagcctgcagctcctttgacgtgctgctcgaaaagggcaaattccccctgtttcagagctacgcgcaccatagaacccttctggaggccgtgcacgatacaattatcgctaaggccgaccctccctcttgtgatctccagtccgctcacgggaacccttgcatgaaggagaaactggtcatgaagacccattgtcccaatgactatcaaagcgcccactacctgaacaatgatggaaaaatggcctctgttaagtgcccgcctaaatatgaactcacagaggactgtaacttctgccggcagatgaccggcgcttccctgaagaaagggagctacccccttcaggacctgttttgccagtcctctgaagatgacggaagcaagctcaagacgaaaatgaagggcgtgtgtgaggtgggcgtccaagcgctgaaaaagtgcgatgggcagctttccacagcccatgaagtggttcctttcgctgtgtttaaaaatagcaagaaggtctacctggacaaactcgatctgaagaccgaggagaacctgctccccgactctttcgtgtgttttgaacacaaaggacagtataagggcacaatggattccgggcagaccaaacgcgagctgaagtctttcgacatctctcaatgccccaagattggaggccacgggagcaaaaagtgtaccggagatgccgccttttgctccgcttacgaatgtacagcccagtatgcgaatgcttactgctctcatgccaacggcagcggcatcgttcagattcaagtgtccggggtctggaaaaagcctctttgtgtgggatatgagagagtcgtggttaaacgggaactgagcgccaagccgatccagcgcgtggagccctgcacgacctgtattacaaagtgcgagcctcacggcctcgtcgtgagatctaccgggttcaaaatctccagcgctgttgcctgcgcttctggagtgtgtgtcacaggctcccagagcccctccaccgaaatcacgctgaagtaccctgggatttctcagagctccggcggagacatcggcgtgcatatggcccacgatgaccaatctgtgagctccaaaattgttgcgcattgtcccccgcaggacccttgccttgtccacgggtgcatcgtgtgtgcccacggactgattaattatcagtgccatacagctctcagcgccttcgtggtcatctttgtgttctcttccaccgctatcatttgtctggccgttctgtaccgggtgctcaagtgcctgaaaatcgcgcccagaaaggtccttaaccctctgatgtggattaccgcctttatccgctgggtgtacaaaaagatggttgctcgggtggccgataacattaatcaggtcaacagagagatcggctggatggaagggggacaactcgctctgggcaatcccgcccctattccccgccacgccccgatccctcggtatagcacatacctgatgcttctcctgatcgtgtcttatgcttccgcgtgtagcgagctgattcaggcctctagcagaatcaccacatgctccacggagggggttaacaccaagtgtcgcctcagcggcacagctctgattcgggccggatctgtgggcgccgaggcttgccttatgctgaaaggggtcaaggaggaccagaccaaattcctcaagatcaaaacagtgtccagcgaactgtcctgcagagagggacagtcttactggaccggcagcttttcccccaagtgtctgtctagccgccggtgccatcttgtgggggaatgtcacgtcaatagatgcctctcctggcgcgataacgagacgtctgccgagttcagctttgttggagaatccaccacaatgcgggagaataagtgtttcgaacaatgcggcgggtggggctgtggatgctttaacgtgaatcccagctgtctgttcgtgcacacctatctgcagtctgtcagaaaagaggcgctccgggtgtttaactgcattgactgggttcataagctgacacttgaaatcaccgatttcgacggctccgtgagcacgatcgatctgggggcttcttccagccgctttacaaattggggatctgtctccctcagcctggacgccgagggcatttccgggagcaactctttcagcttcatcgagtcccctggaaaaggctacgccattgtggatgaaccgttttctgagatccccagacaggggttcctgggcgaaattcggtgtaatagcgagtcctctgttcttagcgctcacgaatcctgcctcagagcccctaacctggtgtcttataagcccatgatcgaccagctggagtgcaccacaaatctcatcgatccttttgtcgtgttcgagcgcggaagcctgccccaaacccggaacgacaaaacctttgcggcttccaagggcaacagaggggttcaggccttcagcaagggatctgtgcaggccgatcttacactgatgtttgacaatttcgaagtcgactttgtgggcgctgccgtgtcctgtgatgctgccttcctcaacctgacggggtgctacagctgtaatgcgggagcccgcgtctgcctgtctattacctccacaggcaccggcacacttagcgctcataacaaagacgggtccctccacatcgttctgccttctgagaatggaaccaaggatcaatgtcagattctgcattttacggtgcccgaagtggaggaggagttcatgtacagctgcgacggcgatgaaagaccgctcctggtcaaagggacacttatcgccattgacccttttgatgaccggcgcgaagctggaggcgagtccaccgtggttaaccccaagagcgggtcttggaatttcttcgattggttttccggactgatgagctggttcggcggccctctcaaaaccatcctgctgatctgtctttatgtggccctgtctattgggctctttttcctgctcatctacctgggaagaacaggccttagcaagatgtggctggccgctaccaagaaagcgtcctga

SEQ ID NO: 14403 - RNA, 3594 nt, synthetic construct
  misc_feature 1..3594: note = derived and/or modified CDS sequence (opt5) from RVFV(2007002476)__EU574036.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagacatcggcgtgcatatggcccacgatgaccaatctgtgagctccaagattgttgcgcattgtcccccgcaggacccttgccttgtccacgggtgcatcgtgtgtgcccacggactgattaattatcagtgccatacagctctcagcgccttcgtggtcatctttgtgttctcttccaccgctatcatttgtctggccgttctgtacagagtgctcaaatgcctgaagatcgcgccccgcaaagtccttaaccctctgatgtggattaccgcctttatcaagtgggtgtacaaaaagatggttgctcgggtggccgataacattaatcaggtcaacagagagatcggctggatggaagggggacaactcgctctgggcaatcccgcccctattccccgccacgccccgatccctcggtatagcacatacctgatgcttctcctgatcgtgtcttatgcttccgcgtgtagcgagctgattcaggcctctagcagaatcaccacatgctccacggagggggttaacaccaagtgtcgcctcagcggcacagctctgattcgggccggatctgtgggcgccgaggcttgccttatgctgaaaggggtcaaggaggaccagaccaaattcctcaagatcaaaacagtgtccagcgaactgtcctgcagagagggacagtcttactggaccggcagcttttcccccaagtgtctgtctagccgccggtgccatcttgtgggggaatgtcacgtcaatagatgcctctcctggcgcgataacgagacgtctgccgagttcagctttgttggagaatccaccacaatgcgggagaataagtgtttcgaacaatgcggcgggtggggctgtggatgctttaacgtgaatcccagctgtctgttcgtgcacacctatctgcagtctgtcagaaaagaggcgctccgggtgtttaactgcattgactgggttcataagctgacacttgaaatcaccgatttcgacggctccgtgagcacgatcgatctgggggcttcttccagccgctttacaaattggggatctgtctccctcagcctggacgccgagggcatttccgggagcaactctttcagcttcatcgagtcccctggaaaaggctacgccattgtggatgaaccgttttctgagatccccagacaggggttcctgggcgaaattcggtgtaatagcgagtcctctgttcttagcgctcacgaatcctgcctcagagcccctaacctggtgtcttataagcccatgatcgaccagctggagtgcaccacaaatctcatcgatccttttgtcgtgttcgagcgcggaagcctgccccaaacccggaacgacaaaacctttgcggcttccaagggcaacagaggggttcaggccttcagcaagggatctgtgcaggccgatcttacactgatgtttgacaatttcgaagtcgactttgtgggcgctgccgtgtcctgtgatgctgccttcctcaacctgacggggtgctacagctgtaatgcgggagcccgcgtctgcctgtctattacctccacaggcaccggcacacttagcgctcataacaaagacgggtccctccacatcgttctgccttctgagaatggaaccaaggatcaatgtcagattctgcattttacggtgcccgaagtggaggaggagttcatgtacagctgcgacggcgatgaaagaccgctcctggtcaaagggacacttatcgccattgacccttttgatgaccggcgcgaagctggaggcgagtccaccgtggttaaccccaagagcgggtcttggaatttcttcgattggttttccggactgatgagctggttcggcggccctctcaaaaccatcctgctgatctgtctttatgtggccctgtctattgggctctttttcctgctcatctacctgggaagaacaggccttagcaagatgtggctggccgctaccaagaaagcgtcctga

SEQ ID NO: 14404 - RNA, 3594 nt, synthetic construct
  misc_feature 1..3594: note = derived and/or modified CDS sequence (opt5) from RVFV(2269/74)__DQ380222.1__GP
  source 1..3594: mol_type = other RNA
atgtacgtgctgctcacaatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagcacaaaggcacaatggactccgggcagaccaagagagagctgaaatctttcgatatttctcaatgccccaagatcggaggccatgggagcaagaaatgtaccggagacgccgccttttgctccgcttatgaatgtacagcccagtacgcgaacgcttattgctctcacgccaatggcagcggcattgtgcagatccaagtttccggggtgtggaagaaacctctttgtgtcggatacgagcgggtggtcgtgaagcgcgaactgagcgccaaaccgattcagagagttgagccctgcacgacctgtatcacaaagtgcgagcctcatggcctcgtggtccggtctaccgggttcaagatctccagcgctgtggcctgcgcttctggagtttgtgtgacaggctcccagagcccctccaccgaaattacgctgaaatatcctgggatctctcagagctccggcggagatattggcgtccacatggcccatgacgaccaatctgtgagctccaagatcgtggcgcactgtcccccgcaggatccttgccttgttcacgggtgcattgtctgtgcccatggactgatcaactaccagtgccacacagctctcagcgccttcgtggtggtctttgtgttctcttccgttgctatcatttgtctggccatcctgtataaagtgctcaagtgcctgaaaattgcgcccaagaaagtccttaatcctctgatgtggatcaccgcctttattagatgggtgtacaagaagatggttgctcgcgtggccgacaacatcaaccaggtcaatcgggagattggctggatggaagggggacaactcgctctgggcaaccccgcccctatccccagacatgccccgatccctcgctacagcacctatctgatgcttctcctgattgtgtcttacgcttccgcgtgtagcgagctgatccaggcctctagccggattacaacctgctccacagagggggttaatacgaaatgtagactcagcggcaccgctctgatccgcgccggatctgtgggcgccgaggcttgccttatgctgaagggggtcaaagaggatcagacaaagttcctcaaaattaagaccgtgtccagcgaactgtcctgccgggagggacagtcttattggacaggcagcttttcccccaagtgtctgtctagcagacgctgccaccttgtgggggaatgtcacgtcaaccggtgcctctcctggagagacaatgagacctctgccgagttcagctttgttggagaatccacgaccatgcgcgagaacaaatgtttcgaacaatgcggcgggtggggctgtggatgctttaatgtgaaccccagctgtctgttcgtgcatacatacctgcagtctgtccggaaggaggcgctcagagtgtttaattgcatcgattgggttcacaaactgacccttgaaatcacagacttcgatggctccgtgagcaccattgacctgggggcttcttccagccggtttacgaactggggatctgtctccctcagcctggatgccgagggcatctccgggagcaattctttcagcttcattgagtcccctggaaagggctatgccatcgtggacgaaccgttttctgagattccccgccaggggttcctgggcgaaatcagatgtaacagcgagtcctctgttcttagcgctcatgaatcctgcctccgggcccctaatctgatctcttacaaacccatgattgatcagctggagtgcacaaccaacctcatcgacccttttgtggtcttcgagagaggaagcctgccccaaacacgcaatgataagacctttgcggcttccaagggcaacagaggggtgcaggccttcagcaaaggatctgttcaggccgaccttaccctgatgtttgacaacttcgaagtggattttgtcggcgctgccgtgtcctgtgacgctgccttcctcaatctgacagggtgctatagctgtaacgcgggagcccgggtgtgcctgtctattacgtccaccggcacaggcacccttagcgctcacaataaggatgggtccctccatatcgtcctgccttctgagaacggaacaaaagaccaatgtcagattctgcactttaccgttcccgaagtggaggaggagttcatgtacagctgcgatggcgacgaacgcccgctcctggtgaaggggacgcttatcgccatcgatccttttgacgatagacgggaagctggaggcgagtccacagtcgtgaatcccaaaagcgggtcttggaacttcttcgactggttttccggactgatgagctggttcggcggccctctcaagaccattctgctgatctgtctttacgttgccctgtctattgggctctttttcctgctcatctatctgggacgcaccggccttagcaagatgtggctggccgctaccaaaaaggcgtcctga

SEQ ID NO: 14405 - RNA, 3594 nt, synthetic construct
  misc_feature 1..3594: note = derived and/or modified CDS sequence (opt5) from RVFV(SA-51 (Van Wyck))__DQ380195.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggactccgggcagaccaagagagagctgaaatctttcgatatttctcaatgccccaagatcggaggccgggggagcaagaaatgtaccggagacgccgccttttgctccgcttacgaatgtacagcccagtatgcgaacgcttactgctctcacgccaatggcagcggcattgtgcagatccaagtttccggggtgtggaagaaacctctttgtgtcggatatgagcgcgtggtcgtgaagagagaactgagcgccaaaccgattcagcgggttgagccctgcacgacctgtatcacaaagtgcgagcctcatggcctcgtggtcagatctaccgggttcaagatctccagcgctgtggcctgcgcttctggagtttgtgtgacaggctcccagagcccctccaccgaaattacgctgaaataccctgggatctctcagagctccggcggagatattggcgtccacatggcccatgacgaccaatctgtgagctccaagatcgtggcgcactgtcccccgcaggatccttgccttgttcatgggtgcattgtctgtgcccacggactgatcaactatcagtgccacacagctctcagcgccttcgtggtggtctttgtgttctcttccgttgctatcatttgtctggccatcctgtacaaagtgctcaagtgcctgaaaattgcgccccgcaaggtccttaatcctctgatgtggatcaccgcctttattcggtgggtgtacaaaaagatggttgctagagtggccgacaacatcaaccaggtcaatcgcgagattggctggatggaagggggacaactcgctctgggcaaccccgcccctatcccccggcatgccccgatccctagatatagcacctacctgatgcttctcctgattgtgtcttatgcttccgcgtgtagcgagctgatccaggcctctagccgcattacaacctgctccacagagggggttaatacgaagtgtcggctcagcggcaccgctctgatcagagccggatctgtgggcgccgaggcttgccttatgctgaaaggggtcaaggaggatcagacaaaattcctcaagattaaaaccgtgtccagcgaactgtcctgccgcgagggacagtcttactggacaggcagcttttcccccaagtgtctgtctagccggagatgccaccttgtgggggaatgtcatgtcaaccgctgcctctcctggcgggacaatgagacctctgccgagttcagctttgttggagaatccacgaccatgagagagaacaagtgtttcgaacaatgcggcgggtggggctgtggatgctttaatgtgaaccccagctgtctgttcgtgcacacatatctgcagtctgtccggaaagaggcgctccgcgtgtttaattgcatcgattgggttcacaagctgacccttgaagtgacagacttcgatggctccgtcagcaccatcgacctgggggcttcttccagcagatttacgaactggggatctgtgtccctcagcctggatgccgagggcatttccgggagcaattctttcagcttcatcgagtcccctggaaaaggctacgccattgttgacgaaccgttttctgagatcccccggcaggggttcctgggcgaaattagatgtaacagcgagtcctctgtgcttagcgctcatgaatcctgcctccgcgcccctaatctgatctcttataagcccatgatcgatcagctggagtgcacaaccaacctcattgacccttttgtcgtgttcgagcggggaagcctgccccaaacaagaaatgataaaacctttgcggcttccaagggcaaccgcggggttcaggccttcagcaagggatctgtgcaggccgaccttaccctgatgtttgacaacttcgaagtcgattttgtgggcgctgccgtgtcctgtgacgctgccttcctcaatctgacagggtgctacagctgtaacgcgggagccagagtctgcctgtctatcacgtccaccggcacaggcacccttagcgctcacaataaagatgggtccctccatattgttctgccttctgagaacggaacaaaggaccaatgtcagatcctgcactttaccgtgcccgaagtggaggaggagttcatgtacagctgcgatggcgacgaacggccgctcctggtcaaagggacgcttattgccatcgatccttttgacgatcgcagagaagctggaggcgagtccacagtggttaatcccaagagcgggtcttggaacttcttcgactggttttccggactgatgagctggttcggcggccctctcaaaaccatcctgctgatttgtctttatgtggccctgtctatcgggctctttttcctgctcatttacctgggacggaccggccttagcaagatgtggctggccgctacaaagaaagcgtcctga

SEQ ID NO: 14406 - RNA, 3594 nt, synthetic construct
  misc_feature 1..3594: note = derived and/or modified CDS sequence (opt5) from RVFV(OS-8)__DQ380185.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggactccgggcagaccaagagagagctgaaatctttcgatatttctcaatgccccaagatcggaggccacgggagcaagaaatgtaccggagacgccgccttttgctccgcttacgaatgtacagcccagtatgcgaacgcttactgctctcatgccaatggcagcggcgtggttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagatatcggcgtgcatatggcccacgacgaccaatctgtgagctccaagattgttgcgcattgtcccccgcaggatccttgccttgtccacgggtgcatcgtgtgtgcccacggactgattaactatcagtgccatacagctctcagcgccttcgtggtcgtgtttgttttctcttccgtggctatcatctgtctggccattctgtacaaagtcctcaagtgcctgaaaatcgcgcccagaaaggtgcttaatcctctgatgtggattaccgcctttatccgctgggtttacaaaaagatggtggctcgggtcgccgacaacattaaccaggtgaatagagagatcggctggatggaagggggacaactcgctctgggcaaccccgcccctattccccgccacgccccgatccctcggtatagcacctacctgatgcttctcctgatcgtttcttatgcttccgcgtgtagcgagctgattcaggcctctagcagaatcacaacctgctccacagagggggtgaatacgaagtgtcgcctcagcggcaccgctctgattcgggccggatctgtcggcgccgaggcttgccttatgctgaaaggggtgaaggaggatcagacaaaattcctcagaatcaagaccgtgtccagcgaactgtcctgccgcgagggacagtcttactggacaggcagcttttcccccaaatgtctgtctagccggagatgccatcttgtcggggaatgtcacgttaaccgctgcctctcctggcgggacaatgagacctctgccgagttcagctttgtgggagaatccacgaccatgagagagaacaagtgtttcgaacaatgcggcgggtggggctgtggatgctttaatgtgaaccccagctgtctgttcgtccacacatatctgcagtctgtgcggaaggaggcgctccgcgtttttaattgcattgattgggtgcataaactgacccttgaaatcacagacttcgatggctccgtcagcaccatcgacctgggggcttcttccagcagatttacgaactggggatctgtgtccctcagcctggatgccgagggcatttccgggagcaattctttcagcttcatcgagtcccctggaaagggctacgccattgttgacgaaccgttttctgagatcccccggcaggggttcctgggcgaaattagatgtaacagcgagtcctctgtgcttagcgctcacgaatcctgcctccgcgcccctaatctgatctcttataaacccatgatcgatcagctggagtgcacaaccaacctcattgacccttttgtcgtgttcgagcggggaagcctgccccaaacaagaaatgataagacctttgcggcttccaaaggcaaccgcggggttcaggccttcagcaagggatctgtgcaggccgaccttaccctgatgtttgacaacttcgaagtcgattttgtgggcgctgccgtgtcctgtgacgctgccttcctcaatctgagcgggtgctactcttgtaacgcgggagccagagtctgcctgtccatcacaagcacgggcaccggcacactttccgctcataataaggatgggtctctccacattgttctgcctagcgagaacggaaccaaagaccaatgtcagatcctgcattttacagtgcccgaagtggaggaggagttcatgtactcctgcgatggcgacgaacggccgctcctggtcaaggggacccttattgccatcgatccttttgacgatcgcagagaagctggaggcgagagcacggtggttaatcccaaatctgggtcctggaacttcttcgactggtttagcggactgatgtcttggttcggcggccctctcaagacaatcctgctgatttgtctttatgtggccctgagcatcgggctctttttcctgctcatttacctgggacggaccggcctttccaaaatgtggctggccgctaccaagaaggcgtcttga

SEQ ID NO: 14407 - RNA, 3594 nt, synthetic construct
  misc_feature 1..3594: note = derived and/or modified CDS sequence (opt5) from RVFV(BIME-01)__KX609032.1__GP
  source 1..3594: mol_type = other RNA
atgtacgtgctgctcaccatcctgattagcgtccttgtttgcgaggccatcattagagtgtccctgtctagcacacgggaagagacgtgtttcggcgactccaccaaccccgaaatgatcgagggggcttgggattctctccgcgaagaggagatgcctgaagaactgagctgctccatttctggaatcagagaagtgaagacaagctcccaggagctttatcgggccctgaaagcgatcattgctgccgacggcctcaataacatcacctgtcacgggaaggatccggaggacaaaattagcctgatcaagggaccccctcataaaaagcgcgtcggcattgtgagatgcgaacggcgcagagatgccaagcaaatcgggcgggagacaatggctggaattgccatgaccgttctgcccgctctcgccgtgtttgcgctggcccctgtcgtgttcgctgaagacccccaccttcgcaatagacctggcaaaggccataactacatcgatgggatgacacaggaggacgccacctgtaagccggttacgtatgctggagcctgcagctcctttgatgtgctgctcgaaaaaggcaagttccccctgtttcagagctacgcgcaccatcggacccttctggaggccgtccacgacacaatcattgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtgaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtctgtgaggttggcgtgcaagcgctgaagaaatgcgacgggcagctttccacagcccatgaagtggtccctttcgctgtgtttaagaacagcaaaaaggtttacctggataagctcgacctgaaaaccgaggagaatctgctccccgattctttcgtgtgttttgaacacaagggacagtataaaggcacaatggactccgggcagaccaagagagagctgaaatctttcgatatctctcaatgccccaagattggaggccacgggagcaagaaatgtaccggagacgccgccttttgctccgcttacgaatgtacagcccagtatgcgaacgcttactgctctcatgccaatggcagcggcatcgtccagattcaagtgtccggggtttggaagaaacctctttgtgtgggatatgagcgggtcgtggtcaagcgcgaactgagcgccaaaccgatccagagagtggagccctgcacgacctgtatcacaaagtgcgagcctcacggcctcgttgtgcggtctaccgggttcaagatttccagcgctgtcgcctgcgcttctggagtgtgtgttacaggctcccagagcccctccaccgaaatcacgctgaaataccctgggatttctcagagctccggcggagatatcggcgtgcatatggcccacgacgaccaatctgtcagctccaagattgtggcgcattgtcccccgcaggatccttgccttgtgcacgggtgcatcgtttgtgcccacggactgatcaactatcagtgccatacagctctcagcgccttcgtcgtggtgtttgtcttctcttccgtggctattatctgtctggccattctgtacaaagttctcagatgcctgaagatcgcgcccaaaaaggtgcttaatcctctgatgtggattaccgcctttatccgctgggtctacaaaaagatggtggctcgggttgccgacaacattaaccaggtgaatagagagatcggctggatggaagggggacaactcgctctgggcaaccccgcccctatcccccgccacgccccgattcctcggtatagcacctacctgatgcttctcctgatcatttcttatgcttccgcgtgtagcgagctgatccaggcctctagcagaattacaacctgctccacagagggggtcaatacgaagtgtcgcctcagcggcaccgctctgatccgggccggatctgtgggcgccgaggcttgccttatgctgaaaggggttaaggaggatcagacaaaattcctcaagatcaaaaccgtgtccagcgaactgtcctgcagagagggacagtcttactggacaggcagcttttcccccaagtgtctgtctagccgccggtgccatcttgtcggggaatgtcacgtgaacagatgcctctcctggcgcgacaatgagacctctgccgagttcagctttgtgggagaatccacgaccatgcgggagaacaagtgtttcgaacaatgcggcgggtggggctgtggatgctttaatgtcaaccccagctgtctgttcgttcacacatatctgcagtctgtgagaaaagaggcgctccgggtgtttaattgcattgattgggtccataagctgacccttgaaatcacagacttcgatggctccgtgagcaccattgacctgggggcttcttccagccgctttacgaactggggatctgtttccctcagcctggatgccgagggcatctccgggagcaattctttcagcttcattgagtcccctggaaaaggctacgccatcgtggacgaaccgttttctgagatccccagacaggggttcctgggcgaaattcggtgtaacagcgagtcctctgtccttagcgctcacgaatcctgcctcagagcccctaatctgatctcttataagcccatgattgatcagctggagtgcacaaccaacctcatcgacccttttgtggttttcgagcgcggaagcctgccccaaacacggaatgataaaacctttgcggcttccaagggcaacagaggggtgcaggccttcagcaagggatctgtccaggccgaccttaccctgatgtttgacaacttcgaagtggattttgttggcgctgccgtgtcctgtgacgctgccttcctcaatctgacagggtgctacagctgtaacgcgggagcccgcgtctgcctgtctattacgtccaccggcacaggcacccttagcgctcataataaagatgggtccctccacatcgtgctgccttctgagaacggaacaaaggaccaatgtcagatcctgcattttaccgtgcccgaagtcgaggaggagttcatgtacagctgcgatggcgacgaaagaccgctcctggttaaagggacgcttattgccatcgatccttttgacgatcggcgcgaagctggaggcgagtccacagtggtgaatcccaagagcgggtcttggaacttcttcgactggttttccggactgatgagctggttcggcggccctctcaaaaccattctgctgatctgtctttatgtcgccctgtctattgggctctttttcctgctcatctacctgggaagaaccggccttagcaagatgtggctggccgctacaaagaaagcgtcctga

SEQ ID NO: 14408 - RNA, 3594 nt, synthetic construct
  misc_feature 1..3594: note = derived and/or modified CDS sequence (opt5) from RVFV(Kenya 83 (21445))__DQ380198.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaagaatccggagaacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggattgtaatttctgccgccagatgaccggcgcttccctgaaaaaggggagctacccccttcaggacctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggactccgggcagaccaagagagagctgaaatctttcgatatttctcaatgccccaagatcggaggccacgggagcaagaaatgtaccggagacgccgccttttgctccgcttacgaatgtacagcccagtatgcgaacgcttactgctctcatgccaatggcagcggcattgtgcagatccaagtttccggggtgtggaagaaacctctttgtgtcggatatgagcgggtggtcgtgaagcgcgaactgagcgccaaaccgattcagagagttgagccctgcacgacctgtatcacaaagtgcgagcctcacggcctcgtggtccggtctaccgggttcaagatctccagcgctgtggcctgcgcttctggagtttgtgtgacaggctcccagagcccctccaccgaaattacgctgaaataccctgggatctctcagagctccggcggagatattggcgtccatatggcccacgacgatcaatctgtgagctccaagatcgtggcgcattgtcccccgcaggacccttgccttgttcacgggtgcattgtctgtgcccacggactgatcaactatcagtgccatacagctctcagcgccttcgtggtggtctttgtgttctcttccatcgctattatctgtctggccattctgtacagagttctcaaatgcctgaagatcgcgccccgcaaagtgcttaaccctctgatgtggattaccgcctttatccggtgggtctacaagaaaatggtggctagagttgccgacaatattaaccaggtgaatcgcgagatcggctggatggaagggggacaactcgctctgggcaaccccgcccctatcccccggcacgccccgattcctagatatagcacctacctgatgcttctcctgatcgtctcttatgcttccgcgtgtagcgagctgattcaggcctctagccgcatcacaacctgctccacagagggggtgaatacgaagtgtcggctcagcggcaccgctctgattagagccggatctgttggcgccgaggcttgccttatgctgaagggggtgaaagaggatcagacaaagttcctcaaaatcaagaccgtctccagcgaactgtcctgccgcgagggacagtcttactggacaggcagcttttcccccaaatgtctgtctagccggagatgccatcttgtgggggaatgtcacgtgaaccgctgcctctcctggcgggacaatgagacctctgccgagttcagctttgtcggagaatccacgaccatgagagagaacaagtgtttcgaacaatgcggcgggtggggctgtggatgctttaatgttaaccccagctgtctgttcgtgcacacatatctgcagtctgtgcggaaggaggcgctccgcgtctttaattgcatcgattgggtgcataaactgacccttgaaattacagacttcgatggctccgttagcaccatcgacctgggggcttcttccagcagatttacgaactggggatctgtgtccctcagcctggatgccgagggcatttccgggagcaattctttcagcttcatcgagtcccctggaaagggctacgccattgtcgacgaaccgttttctgagatcccccggcaggggttcctgggcgaaatcagatgtaacagcgagtcctctgtgcttagcgctcacgaatcctgcctccgcgcccctaatctgatttcttataaacccatgatcgatcagctggagtgcacaaccaacctcattgacccttttgttgtgttcgagcggggaagcctgccccaaacaagaaacgataagacctttgcggcttccaaaggcaatcgcggggtccaggccttcagcaagggatctgtgcaggccgaccttaccctgatgtttgataacttcgaagttgactttgtgggcgctgccgtctcctgtgacgctgccttcctcaatctgacagggtgctacagctgtaacgcgggagccagagtgtgcctgtctatcacgtccaccggcacaggcacccttagcgctcataataaggatgggtccctccacattgtgctgccttctgagaacggaacaaaagaccaatgtcagatcctgcattttaccgtccccgaagttgaggaggagttcatgtacagctgcgatggcgacgaacggccgctcctggtgaaggggacgcttatcgccattgatccttttgacgatcgcagagaagctggaggcgagtccacagtggtcaatcccaaaagcgggtcttggaacttcttcgactggttttccggactgatgagctggttcggcggccctctcaagaccatcctgctgatttgtctttatgtggccctgtctatcgggctctttttcctgctcatttacctgggacggaccggccttagcaaaatgtggctggccgctacaaagaaggcgtcctga

SEQ ID NO: 14409 - RNA, 3594 nt, synthetic construct
  misc_feature 1..3594: note = derived and/or modified CDS sequence (opt5) from RVFV(2007000253)__JF326192.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagacatcggcgtgcatatggcccacgatgaccaatctgtgagctccaagattgttgcgcattgtcccccgcaggacccttgccttgtccacgggtgcatcgtgtgtgcccacggactgattaattatcagtgccatacagctctcagcgccttcgtggtcatctttgtgttctcttccaccgctatcatttgtctggccgttctgtacagagtgctcaaatgcctgaagatcgcgccccgcaaagtccttaaccctctgatgtggattaccgcctttatccggtgggtgtacaagaaaatggttgctagagtggccgataacattaatcaggtcaaccgcgagatcggctggatggaagggggacaactcgctctgggcaatcccgcccctattccccggcacgccccgatccctagatatagcacatacctgatgcttctcctgatcgtgtcttatgcttccgcgtgtagcgagctgattcaggcctctagccgcatcaccacatgctccacggagggggttaacaccaagtgtcggctcagcggcacagctctgattagagccggatctgccggcgctgaagcctgccttatgctgaagggggtgaaagaggaccagaccaagttcctcaaaatcaagacagtctccagcgaactgtcctgccgcgagggacagtcttactggaccggcagcttttcccccaaatgtctgtctagccggagatgccatcttgtgggggaatgtcacgtgaatcgctgcctctcctggcgggataacgagacgtctgcggagttcagctttgtcggagaatccaccacaatgagagagaataagtgtttcgaacaatgcggcgggtggggctgtggatgctttaacgttaatcccagctgtctgttcgtgcacacctatctgcagtctgtgcggaaggaggctctccgcgtctttaactgcattgactgggtgcataaactgacacttgaaatcaccgatttcgacggctccgttagcacgatcgatctgggggcctcttccagcagatttacaaattggggatctgtgtccctcagcctggacgccgagggcatttccgggagcaactctttcagcttcatcgagtcccctggaaagggctacgctattgtcgatgaaccgttttctgagatcccccggcaggggttcctgggcgaaattagatgtaatagcgagtcctctgtgcttagcgcccacgaatcctgcctccgcgcgcctaacctggtttcttataaacccatgatcgaccagctggagtgcaccacaaatctcatcgatccttttgtggtcttcgagcggggaagcctgccccaaaccagaaacgacaagacctttgctgcctccaaaggcaaccgcggggtgcaggccttcagcaagggatctgttcaggctgatcttacactgatgtttgacaatttcgaagtggactttgtcggcgccgctgtgtcctgtgatgccgcgttcctcaacctgacggggtgctacagctgtaatgccggagctagagtgtgcctgtctattacctccacaggcaccggcacacttagcgcccataacaaggacgggtccctccacatcgtcctgccttctgagaatggaaccaaagatcaatgtcagattctgcattttacggttcccgaagtggaggaggagttcatgtacagctgcgacggcgatgagcggccgctcctggtgaaggggacacttatcgctattgacccttttgatgaccgcagagaagccggaggcgagtccaccgtcgtgaaccccaaaagcgggtcttggaatttcttcgattggttttccggactgatgagctggttcggcggccctctcaagaccatcctgctgatctgtctttatgttgccctgtctattgggctctttttcctgctcatctacctgggacggacaggccttagcaaaatgtggctggctgcgaccaagaaggcctcctga

SEQ ID NO: 14410 - RNA, 3594 nt, synthetic construct
  misc_feature 1..3594: note = derived and/or modified CDS sequence (opt5) from RVFV(200803166)__JF311381.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaggagctgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcaaaaagggcaaattccccctgtttcagagctacgcgcaccatcggacccttctggaagccgtgcacgatacaattatcgctaaggccgaccctccctcttgtgatctccagtccgctcacgggaacccttgcatgaaggagaaactggtcatgaagacccattgtcccaatgactatcaaagcgcccactacctgaacaatgatggaaaaatggcctctgttaagtgcccgcctaaatatgagctcacagaagactgtaacttctgccgccagatgaccggcgcttccctgaagaaagggagctacccccttcaggacctgttttgccagtcctctgaggatgacggaagcaagctcaagacgaaaatgaagggcgtgtgtgaagtgggcgtccaagcgctgaaaaagtgcgatgggcagctttccacagcccatgaggtggttcctttcgctgtgtttaaaaatagcaagaaggtctacctggacaaactcgatctgaagaccgaagagaacctgctccccgactctttcgtgtgttttgagcacaaaggacagtataagggcacaatggattccgggcagaccaaaagagaacttaagagcttcgacatctctcaatgccccaagattggaggccacgggagcaaaaagtgtaccggagatgccgccttttgctccgcttacgagtgtacagcccagtatgcgaatgcttactgctctcatgccaacggcagcggcatcgttcagattcaagtgtccggggtctggaaaaagcctctgtgtgtgggatatgaacgggtcgtggttaaacgcgagctgagcgccaagccgatccagagagtggaaccctgcacgacctgtattacaaagtgcgagcctcacggcctcgtcgtgcggtctaccgggttcaaaatctccagcgctgttgcctgcgcttctggagtgtgtgtcacaggctcccagagcccctccaccgagatcacgctgaagtaccctgggatttctcagagctccggcggagacatcggcgtgcatatggcccacgatgaccaatctgtgagctccaaaattgttgcgcattgtcccccgcaggacccttgccttgtccacgggtgcatcgtgtgtgcccacggactgattaattatcagtgccatacagctctcagcgccttcgtggtcgtgtttgttttctcttccatcgctatcatttgtctggccatcctgtacagagtgctcaagtgcctgaaaattgcgccccgcaaggtccttaaccctctgatgtggatcaccgcctttattcggtgggtgtacaaaaagatggttgctagagtggccgataacatcaatcaggtcaaccgcgaaattggctggatggaagggggacaactcgtgctgggcaatcccgctcctatcccccggcacgccccgatccctagatatagcacctacctgatgcttctcctgattgtttcttatgccacagcttgttccgaactgatccaggcgagctctcgcattaccacatgcagcacggagggggtgaacaccaagtgtcggctctccggcacagccctgatcagagctggaagcgtcggcgccgaggcctgccttatgctgaaaggggtgaaggaagaccagaccaaattcctcaagattaaaacagtgtcttccgagctgagctgccgcgaaggacagtcctactggaccggctcttttagccccaagtgtctgtcctctcggagatgccatcttgtcggggagtgtcacgttaatcgctgcctcagctggcgggataacgaaacgtccgctgagttctcttttgtgggagagagcaccacaatgagagaaaataagtgtttcgagcaatgcggcgggtggggctgtggatgctttaacgtgaatccctcctgtctgttcgtccacacctatctgcagagcgtgcggaaagaagccctccgcgtttttaactgcatcgactgggtgcataagctgacacttgagatcaccgatttcgacggctctgtctccacgattgatctgggggcgtcttcttccagatttacaaattggggaagcgtgtctctctccctggacgctgaaggcatcagcgggtccaacagcttctctttcattgagagccctggaaaaggctacgccatcgttgatgagccgttttccgaaattccccggcaggggttcctgggcgagatcagatgtaattctgaaagctccgtgctttctgcccacgagagctgcctccgcgctcctaacctgatctcctataagcccatgattgaccagctggaatgcaccacaaatctcatcgatccttttgtcgtgttcgagcggggatctctgccccaaaccagaaacgacaaaacctttgccgcgagcaagggcaaccgcggggttcaggctttctccaagggaagcgtgcaggccgatcttacactgatgtttgacaatttcgaggtcgactttgtgggcgccgctgtgtcttgtgatgccgctttcctcaacctgacggggtgctactcctgtaatgccggagcgagagtctgcctgagcattacctctacaggcaccggcacactttccgcccataacaaagacgggagcctccacgttgtgctgccttccgaaaatggaaccaaggatcaatgtcagatcctgcattttacggtgcccgaggtcgaagaggagttcatgtactcttgcgacggcgatgaacggccgctcctggtgaaagggacacttattgctatcgacccttttgatgaccgcagagaggccggaggcgaaagcaccgttgtgaaccccaagtccgggagctggaatttcttcgattggttttctggactgatgtcctggttcggcggccctctcaaaaccatcctgctgatttgtctttatgtcgctctgagcatcgggctctttttcctgctcatttacctgggacggacaggcctttctaagatgtggctggccgccaccaagaaagctagctga

SEQ ID NO: 14411 - RNA, 3594 nt, synthetic construct
  misc_feature 1..3594: note = derived and/or modified CDS sequence (opt5) from RVFV(2007001107)__EU574047.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagcaatcaggagctttatcgggccctgaaagcgattatcgctgccgacggcctcaacaatatcacctgtcacgggaagaacccggaggataaaatttccctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaatagacctggcaaaggccataactacatcgacgggatgacacaggaggatgccacctgtaagccggtcacgtatgctggagcctgcagctcttttgacgtgctgctcgaaaaaggcaagttccccctgtttcagtcctacgcgcaccatcggacccttctggaggccgtgcacgatacaattatcgctaaagccgaccctcccagctgtgatctccagtctgctcacgggaatccttgcatgaaggagaagctggtcatgaaaacccattgtcccaacgactatcaatccgcccactacctgaataacgatggaaagatggccagcgttaaatgcccgcctaagtatgaactcacagaggactgtaatttctgccgccagatgaccggcgcttctctgaaaaaggggtcctacccccttcaggacctgttttgccagagctccgaagatgacggatctaaactcaagacgaagatgaaaggcgtgtgtgaggtgggcgtccaagcgctgaagaaatgcgatgggcagcttagcacagcccatgaagtggttcctttcgctgtgtttaagaactccaaaaaggtctacctggacaagctcgatctgaaaaccgaggagaatctgctccccgacagcttcgtgtgttttgaacacaagggacagtataaaggcacaatggattctgggcagaccaagagagagctgaaatccttcgacatcagccaatgccccaagattggaggccacgggtctaagaaatgtaccggagatgccgccttttgcagcgcttacgaatgtacagcccagtatgcgaacgcttactgctcccatgccaatggctctggcatcgttcagattcaagtgagcggggtctggaagaaacctctttgtgtgggatatgagcgggtcgtggttaagcgcgaactgtccgccaaaccgatccagagagtggagccctgcacgacctgtattacaaagtgcgagcctcacggcctcgtcgtgcggagcaccgggttcaagatctcttccgctgttgcctgcgctagcggagtgtgtgtcacaggctctcagtcccccagcaccgaaatcacgctgaaataccctgggatttcccagtctagcggcggagacatcggcgtgcatatggcccacgatgaccaatccgtgtctagcaagattgttgcgcattgtcccccgcaggacccttgccttgtccacgggtgcatcgtgtgtgcccacggactgattaactatcagtgccatacagctctctccgccttcgtggtcatctttgtgttcagctctaccgctatcatttgtctggccgttctgtacagagtgctcaaatgcctgaagatcgcgccccgcaaagtccttaaccctctgatgtggattaccgcctttatccggtgggtgtacaagaaaatggttgctagagtggccgataatattaaccaggtcaatcgcgagatcggctggatggaagggggacaactcgctctgggcaaccccgcccctattccccggcacgccccgatccctagatattccacatacctgatgcttctcctgatcgtgagctatgcttctgcgtgttccgagctgattcaggccagctctcgcatcaccacatgcagcacggagggggttaataccaagtgtcggctctccggcacagctctgattagagccggaagcgtgggcgccgaggcttgccttatgctgaagggggtcaaagaggaccagaccaagttcctcaaaatcaagacagtgtcttccgaactgagctgccgcgagggacagtcctactggaccggctcttttagccccaaatgtctgtcctctcggagatgccatcttgtgggggaatgtcacgtcaaccgctgcctcagctggcgggataatgagacgtccgccgagttctcttttgttggagaaagcaccacaatgagagagaacaagtgtttcgaacaatgcggcgggtggggctgtggatgctttaatgtgaacccctcctgtctgttcgtgcacacctatctgcagagcgtccggaaggaggcgctccgcgtgtttaattgcattgactgggttcataaactgacacttgaaatcaccgatttcgacggctctgtgtccacgatcgatctgggggcttctagctccagatttacaaactggggaagcgtctctctctccctggacgccgagggcattagcgggtccaatagcttctctttcatcgagagccctggaaagggctacgccattgtggatgaaccgttttccgagatcccccggcaggggttcctgggcgaaattagatgtaactctgagagctccgttctttctgctcacgaaagctgcctccgcgcccctaatctggtgtcctataaacccatgatcgaccagctggagtgcaccacaaacctcatcgatccttttgtcgtgttcgagcggggatctctgccccaaaccagaaacgacaagacctttgcggctagcaaaggcaatcgcggggttcaggccttctccaagggaagcgtgcaggccgatcttacactgatgtttgacaacttcgaagtcgactttgtgggcgctgccgtgtcttgtgatgctgccttcctcaatctgacggggtgctactcctgtaacgcgggagccagagtctgcctgagcattacctctacaggcaccggcacactttccgctcataataaggacgggagcctccacatcgttctgccttccgagaacggaaccaaagatcaatgtcagattctgcattttacggtgcccgaagtggaggaggagttcatgtactcttgcgacggcgatgaacggccgctcctggtcaaggggacacttatcgccattgacccttttgatgaccgcagagaagctggaggcgagagcaccgtggttaatcccaaatccgggagctggaacttcttcgattggttttctggactgatgtcctggttcggcggccctctcaagaccatcctgctgatctgtctttatgtggccctgagcattgggctctttttcctgctcatctacctgggacggacaggcctttctaaaatgtggctggccgctaccaagaaggcgagctga

SEQ ID NO: 14412 - RNA, 3594 nt, synthetic construct
  misc_feature 1..3594: note = derived and/or modified CDS sequence (opt5) from RVFV(ANK-3837)__DQ380215.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgttcttcctttgatgtcctgctcgaaaaaggcaagttccccctgtttcagagctacgcgcaccatcggacccttctggaggccgtgcacgacacaatcatcgctaaagccgatcctccctcttgcgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcaagctggactccgggcagacaaaaagagagcttaagagcttcgatatttctcaatgccccaagatcggaggccacgggagcaaaaagtgtaccggagacgccgccttttgctccgcttacgaatgtaccgcccagtatgcgaacgcttactgctctcatgccaatggcagcggcattgtgcagatccaagtttccggggtgtggaaaaagcctctgtgtgtcggatatgagcgggtggtcgtgaaacgcgaactcagcgccaagccgattcagagagttgagccctgcacaacgtgtatcaccaagtgcgagcctcacggcctggtggtccggtctacagggttcaaaatctccagcgctgtggcctgcgcttctggagtttgtgtgaccggctcccagagcccctccacagaaattacccttaagtaccctgggatctctcagagctccggcggagatattggcgtccatatggcccacgacgaccaatctgtgagctccaaaatcgtggcgcattgtcccccgcaggatccttgcctggttcacgggtgcattgtctgtgcccacggactcatcaactatcagtgccatacggctctgagcgccttcgtggtggtctttgtgttctcttccatcgctattatctgtctggccattctctacagagttctgaagtgccttaaaatcgcgccccgcaaggtgctgaatcctctcatgtggattacagcctttatccggtgggtctacagaaaaatggtggctcgcgttgccgacaacattaaccaggtgaatcgggagatcggctggatggaagggggacaactggtcctgggcaaccccgctcctatccccagacacgtgccgattcctcgctatagcacctaccttatgctcctgctgatcgtttcttatgcctccgcctgtagcgagctcattcaggcttctagccggatcaccacatgctccaccgagggggtgaatacaaagtgtagactgagcggcacggcgcttattcgcgccggatctgtcggcgctgaagcctgcctgatgctcaagggggtgaaagaggatcagaccaagttcctgaaaatcaagacagtgtccagcgaactgtcctgccgggagggacagtcttactggaccggcagcttttcccccaaatgtctttctagcagacgctgccatctcgtcggggaatgtcacgttaaccggtgcctgtcctggagagacaatgagacatctgccgagttcagctttgtgggagaatccaccacgatgcgggagaacaagtgtttcgaacaatgcggcgggtggggctgtggatgctttaatgtgaaccccagctgtctgttcgtccacacctatctccagtctgtgcgcaaggaggctctgagagtttttaattgcatcgattgggtgcataaacttacactggaaattaccgacttcgatggctccgtcagcacaatcgacctcggggcctcttccagccggtttaccaactggggatctgtgtccctgagcctggatgcggagggcatttccgggagcaattctttcagcttcatcgagtcccctggaaagggctacgctattgttgacgaaccgttttctgagatccccagacaggggttccttggcgaaatccgctgtaacagcgagtcctctgtgctcagcgcccacgaatcctgcctgcgggcccctaatctgatttcttataaacccatgatcgatcagctcgagtgcacgacaaacctgattgacccttttgtcgtgttcgagagaggaagccttccccaaacccgcaatgataagacatttgctgcctccaaaggcaacagaggggttcaggcgttcagcaagggatctgtgcaggctgacctgaccctcatgtttgacaacttcgaagtcgattttgtgggcgccgccgtgtcctgtgacgctgccttcctgaatctgaccgggtgctacagctgtaacgctggagcccgggtctgcctttctatcacatccacgggcaccggcacactcagcgcgcataataaggatgggtccctgcacattgttctgccttctgagaacggaaccaaagaccaatgtcagatcctccattttacagtgcccgaagtggaggaggagttcatgtacagctgcgatggcgacgagcgcccgctgcttgtcagagggaccctgatcgccattgatccttttgacgatcggcgcgaagctggaggcgagtccacggtggttaatcccaagagcgggtcttggaacttcttcgactggttttccggactcatgagctggttcggcggccctctgaaaacaatcctgcttatttgtctgtatgtggccctctctatcgggctgtttttcctcctgatttaccttggaagaaccggcctgagcaagatgtggctcgctgccaccaaaaaggcctcctga

SEQ ID NO: 14413 - RNA, 3594 nt, synthetic construct
  misc_feature 1..3594: note = derived and/or modified CDS sequence (opt5) from RVFV(OS-1)__DQ380186.1__GP
  source 1..3594: mol_type = other RNA
atgtacgtgctgctcacaatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcaacgcgatgccaagcagattgggagagagacaatggctggaatcgccatgaccgtgctgcccgctctcgccgtctttgcgctggcccctgtggttttcgctgaagacccccaccttcggaatcgccctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatagaacccttctggaggccgtgcacgacacaatcatcgctaaagccgatcctccctcttgtgacctccaatccgctcacgggaatccttgcatgaaggagaagctggtgatgaaaacccattgtcccaacgattatcagagcgcccactacctgaataacgacggaaagatggcctctgtcaaatgcccgcctaagtatgaactcacagaggactgtaatttctgccggcagatgaccggcgcttccctgaaaaaggggagctacccccttcaggatctgttttgccaatcctctgaagacgatggaagcaaactcaagacgaagatgaaaggcgtttgtgaggtgggcgtgcaggcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggactccgggcaaaccaagcgcgagctgaaatctttcgatatttctcagtgccccaagatcggaggccacgggagcaagaaatgtaccggagacgccgccttttgctccgcttacgaatgtacagcccagtatgcgaacgcttactgctctcatgccaatggcagcggcgtggttcaaattcaggtgtccggggtctggaagaaacctctttgtgtgggatatgagagagtcgtggttaagcgggaactgagcgccaaaccgatccagcgcgtggagccctgcacgacctgtattacaaagtgcgagcctcacggcctcgtcgtgagatctaccgggttcaagatctccagcgctgttgcctgcgcttctggagtgtgtgtcacaggctcccagagcccctccaccgaaatcacgctgaaataccctgggatttctcaaagctccggcggagatatcggcgtgcatatggcccacgacgaccagtctgtgagctccaagattgttgcgcattgtcccccgcaggatccttgccttgtccacgggtgcatcgtgtgtgcccacggactgattaactatcagtgccatacagctctcagcgccttcgtggtcgtgtttgttttctcttccgtggctatcatctgtctggccattctgtacaaagtcctcaagtgcctgaaaatcgcgccccggaaggtgcttaatcctctgatgtggattaccgcctttatcagatgggtttacaaaaagatggtggctcgcgtcgccgacaacattaaccaagtgaatcgggagatcggctggatggaagggggacagctcgctctgggcaaccccgcccctattcccagacacgccccgatccctcgctatagcacctacctgatgcttctcctgatcgtttcttatgcttccgcgtgtagcgagctgattcaggcctctagccggatcacaacctgctccacagagggggtgaatacgaagtgtagactcagcggcaccgctctgattcgcgccggatctgtcggcgccgaggcttgccttatgctgaaaggggtgaaggaggatcagacaaaattcctcaagatcaaaaccgtgtccagcgaactgtcctgccgggagggacaatcttactggacaggcagcttttcccccaagtgtctgtctagcagacgctgccatcttgtcggggaatgtcacgttaaccggtgcctctcctggagagacaatgagacctctgccgagttcagctttgtgggagaatccacgaccatgcgcgagaacaagtgtttcgaacagtgcggcgggtggggctgtggatgctttaatgtgaaccccagctgtctgttcgtccacacatatctgcagtctgtgcggaaagaggcgctcaaggtttttaattgcattgattgggtgcataaactgacccttgaaatcacagacttcgatggctccgtcagcaccatcgacctgggggcttcttccagcagatttacgaactggggatctgtgtccctcagcctggatgccgagggcatttccgggagcaattctttcagcttcatcgagtcccctggaaagggctacgccattgttgacgaaccgttttctgagatcccccggcaggggttcctgggcgaaattcgctgtaacagcgagtcctctgtgcttagcgctcacgaatcctgcctcagagcccctaatctgatctcttataaacccatgatcgatcaactggagtgcacaaccaacctcattgacccttttgtcgtgttcgagcggggaagcctgccccagacaagaaatgataagacctttgcggcttccaagggcaaccgcggggttcaggccttcagcaaaggatctgtgcaagccgaccttaccctgatgtttgacaacttcgaagtcgattttgtgggcgctgccgtgtcctgtgacgctgccttcctcaatctgacagggtgctacagctgtaacgcgggagcccgggtctgcctgtctatcacgtccaccggcacaggcacccttagcgctcataataaggatgggtccctccacattgttctgccttctgagaacggaacaaaagaccagtgtcagatcctgcattttaccgtgcccgaagtggaggaggagttcatgtacagctgcgatggcgacgaaagaccgctcctggtcaaggggacgcttattgccatcgatccttttgacgatcgcagagaagctggaggcgagtccacagtggttaatcccaaaagcgggtcttggaacttcttcgactggttttccggactgatgagctggttcggcggccctctcaagaccatcctgctgatttgtctttatgtggccctgtctatcgggctctttttcctgctcatttacctgggacggaccggccttagcaagatgtggctggccgctaccaaaaaggcgtcctga

SEQ ID NO: 14414 - RNA, 3594 nt, synthetic construct
  misc_feature 1..3594: note = derived and/or modified CDS sequence (opt5) from RVFV(Sudan 2V-2007)__JQ820490.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagacatcggcgtgcatatggcccacgatgaccaatctgtgagctccaagattgttgcgcattgtcccccgcaggacccttgcagcgtccacgggtgcatcgtgtgtgcccacggacttattaattatcagtgccatacagctctgtctgccttcgtggtcgtgtttgttttctccagcatcgctatcatttgtctcgccatcctgtacagagtgctgaaatgcctcaagattgcgccccgcaaagtcctgaaccctcttatgtggatcaccgcctttattcggtgggtgtacaagaaaatggttgctagagtggccgataacatcaatcaggtcaaccgcgagattggctggatggaagggggacaactggtgctcggcaatcccgctcctatcccccggcacgccccgatccctagatattctacctacctgatgctgcttctcattgtttcccatgccagcgcttgttctgagctgatccaggcgagctcccgcattacaacctgcagcacagagggggtgaacacgaagtgtcggctgtctggcaccgccctcatcagagctggatccgtcggcgccgaagcctgcctgatgcttaagggggtgaaagaggaccagacaaagttcctgaaaattaagaccgtgagctccgaactctcttgccgcgagggacagagctattggacaggctccttttctcccaaatgtctgagctcccggagatgccacctggtcggggaatgtcacgttaatcgctgcctttcttggcgggataacgagaccagcgctgagttctcctttgtgggagaaagcacgaccatgagagagaataagtgtttcgaacaatgcggcgggtggggctgtggatgctttaacgtgaatccctcttgtctcttcgtccatacatacctgcagtccgtgcggaaggaggccctgcgcgtttttaactgcatcgactgggtgcacaaactcaccctggaaatcacagatttcgacggcagcgtctctaccattgatcttggggcgtccagctctagatttacgaattggggatccgtgagcctgtccctcgacgctgagggcatcagcgggtctaacagcttctccttcattgagtctcctggaaagggctatgccatcgttgatgaaccgtttagcgagattccccggcaggggttcctgggcgaaatcagatgtaattccgagtctagcgtgctgtccgcccatgaatcttgccttcgcgctcctaacctcatcagctacaaacccatgattgaccagctggagtgcacaaccaatctgatcgatccttttgtcgtgttcgagcggggatccctcccccaaacaagaaacgacaagacctttgccgcgagcaaaggcaaccgcggggttcaggctttctctaagggatccgtgcaggccgatctgacccttatgtttgacaatttcgaagtcgactttgtgggcgccgctgtgagctgtgatgccgctttcctgaacctcacagggtgctattcttgtaatgccggagcgagagtctgcctgtccattacgagcaccggcacaggcaccctgtccgcccacaacaaggacgggtctcttcatatcgttctccctagcgagaatggaacaaaagatcaatgtcagattctgcactttaccgtgcccgaagtggaggaggagttcatgtactcctgcgacggcgatgagcggccgctgctcgtcaaggggacgctgatggctatcgacccttttgatgaccgcagagaagccggaggcgagagcacagtggttaaccccaaatctgggtcctggaatttcttcgattggtttagcggacttatgtcttggttcggcggccctctgaagaccatcctcctgatttgtctgtacgtggctcttagcatcgggctgtttttcctcctgatttatctcggacggaccggcctgtccaaaatgtggcttgccgccacaaagaaggcttcttga

SEQ ID NO: 14415 - RNA, 3594 nt, synthetic construct
  misc_feature 1..3594: note = derived and/or modified CDS sequence (opt5) from RVFV(200803162)__JF311377.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacctctttgtgtgggatatgagcgggtcgtggttaagcgcgaactgagcgccaaaccgatccagagagtggagccctgcacgacctgtattgctaagtgcgagcctcacggcctcgtcgtgcggtctacagggttcaagatctccagcgccgttgcttgcgcctctggagtgtgtgtcaccggctcccagagcccctccacagaaatcaccctgaaataccctgggatttctcagagctccggcggagacatcggcgtgcatatggcgcacgatgaccaatctgtgagctccaagattgttgcccattgtcccccgcaggacccttgccttgtccacgattgcatcgtgtgtgctcacgggctgattaattatcagtgccatacggccctcagcgctttcgtggtcatctttgtgttctcttccacagccatcatttgtctggcggttctgtacagagtgctcaaatgcctgaagatcgctccccgcaaagtccttaaccctctgatgtggattaccgcctttatccggtgggtgtacaagaaaatggttgccagagtggctgacaacattaatcaggtcaaccgcgagatcggatggatggaaggcgggcaactcgccctgcggaatcccgcccctattcccagacacgctccgatccctcgctatagcacctacctgatgcttctcctgatcgtgtcttatgcgtccgcctgtagcgagctgattcaggcttctagccggatcacaacctgctccacagagggagttaacacgaagtgtagactcagcggcaccgccctgattcgcgccgggtctgtgggcgctgaagcctgccttatgctgaagggagtcaaagaggatcagacaaagttcctcaaaatcaagaccgtgtccagcgaactgtcctgccgggagggccagtcttactggacagggagcttttcccccaaatgtctgtctagcagacgctgccatcttgtgggagaatgtcacgtcaatcggtgcctctcctggagagacaacgagacctctgcggagttcagctttgttggcgaatccacgaccatgcgggagaataagtgtttcgaacaatgcgggggatggggctgtgggtgctttaacgtgaatcccagctgtctgttcgtgcacacatatctgcagtctgtccgcaaggaggctctcagagtgtttaactgcattgattgggttcataaactgacccttgaaatcacagacttcgatggctccgtgagcaccatcgacctgggagcctcttccagccggtttacgaattggggctctgtctccctcagcctggatgccgaggggatttccggaagcaactctttcagcttcatcgagtcccctggcaaggggtacgctattgtggacgaaccgttttctgagatccccagacagggattcctgggcgaaattcgctgtaatagcgagtcctctgttcttagcgcccacgaatcctgcctccgggcgcctaacctggtgtcttataaacccatgatcgatcagctggagtgcacaaccaatctcatcgacccttttgtcgtgttcgagagagggagcctgccccaaacacgcaacgataagacctttgctgcctccaaaggcaacagaggagttcaggccttcagcaagggctctgtgcaggctgaccttaccctgatgtttgacaatttcgaagtcgattttgtgggggccgctgtgtcctgtgacgccgcgttcctcaacctgacaggatgctacagctgtaatgccggcgctcgggtctgcctgtctattacgtccaccgggacaggaacccttagcgcccataacaaggatggctccctccacatcgttctgccttctgagaatggcacaaaagaccaatgtcagattctgcattttaccgtgcccgaagtggaggaggagttcatgtacagctgcgatggggacgagcgcccgctcctggtcaagggaacgcttatcgctattgatccttttgacgatagacgggaagccggcggggagtccacagtggttaaccccaaaagcggatcttggaatttcttcgactggttttccggcctgatgagctggttcgggggacctctcaagaccatcctgctgatctgtctttatgtggccctgtctattggcctctttttcctgctcatctacctgggccgcaccgggcttagcaaaatgtggctggctgcgacaaagaaggcctcctga

SEQ ID NO: 14416 - RNA, 3594 nt, synthetic construct
  misc_feature 1..3594: note = derived and/or modified CDS sequence (opt5) from RVFV(2007001811)__EU574040.1__GP
  source 1..3594: mol_type = other RNA
atgtacgtgctgctcacaatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagacatcggcgtgcatatggcccacgatgaccaatctgtgagctccaagattgttgcgcattgtcccccgcaggacccttgccttgtccacgggtgcatcgtgtgtgcccacggactgattaattatcagtgccatacagctctcagcgccttcgtggtcgtgtttgttttctcttccatcgctatcatttgtctggccatcctgtacagagtgctcaaatgcctgaagattgcgccccgcaaagtccttaaccctctgatgtggatcaccgcctttattcggtgggtgtacaagaaaatggttgctagagtggccgataacatcaatcaggtcaaccgcgagattggctggatggaagggggacaactcgtgctgggcaatcccgctcctatcccccggcacgccccgatccctagatatagcacctacctgatgcttctcctgattgtttcttatgcctccgcttgtagcgagctgatccaggcgtctagccgcattacaacctgctccacagagggggtgaacacgaagtgtcggctcagcggcaccgccctgatcagagctggatctgtcggcgccgaagcctgccttatgctgaagggggtgaaagaggaccagacaaagttcctcatgattaaaaccgtgtccagcgaactgtcctgccgcgagggacagtcttactggacaggcagcttttcccccaagtgtctgtctagccggagatgccatcttgtcggggaatgtcacgttaatcgctgcctctcctggcgggataacgagacctctgctgagttcagctttgtgggagaatccacgaccatgagagagaataaatgtttcgaacaatgcggcgggtggggctgtggatgctttaacgtgaatcccagctgtctgttcgtccacacatatctgcagtctgtgcggaaggaggccctccgcgtttttaactgcatcgactgggtgcataagctgacccttgaaatcacagatttcgacggctccgtcagcaccattgatctgggggcgtcttccagcagatttacgaattggggatctgtgtccctcagcctggacgctgagggcatctccgggagcaactctttcagcttcattgagtcccctggaaaaggctacgccatcgttgatgaaccgttttctgagattccccggcaggggttcctgggcgaaatcagatgtaatagcgagtcctctgtgcttagcgcccacgaatcctgcctccgcgctcctaacctgatctcttataagcccatgattgaccagctggagtgcacaaccaatctcatcgatccttttgtcgtgttcgagcggggaagcctgccccaaacaagaaacgagaaaacctttgccgcgtccaagggcaaccgcggggttcaggctttcagcaaaggatctgtgcaggccgaccttaccctgatgtttgataatttcgaggtcgactttgtgggcgccgctgtgtcctgtgacgccgctttcctcaacctgacagggtgctacagctgtaatgccggagcgagagtctgcctgtctattacgtccaccggcacaggcacccttagcgcccataacaaggatgggtccctccacatcgttctgccttctgaaaatggaacaaaggaccaatgtcagattctgcattttaccgtgcccgaggtggaggaagagttcatgtacagctgcgatggcgacgaacggccgctcctggtcaaagggacgcttatcgctatcgatccttttgacgatcgcagagaggccggaggcgaatccacagtggttaaccccaagagcgggtcttggaatttcttcgactggttttccggactgatgagctggttcggcggccctctcaaaaccattctgctgatctgtctttatgtggctctgtctattgggctctttttcctgctcatctacctgggacggaccggccttagcaagatgtggctggccgccaccaaaaaggcttcctga

SEQ ID NO: 14417 - RNA, 3594 nt, synthetic construct
  misc_feature 1..3594: note = derived and/or modified CDS sequence (opt5) from RVFV(clone 13)__DQ380213.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagcatgaactcacagaggactgtaatttctgccgccagatgaccggcgcttccctgaaaaaggggagctatccccttcaggatctgttttgccagtcctctgaagacgatggaagcaaactcaagacgaagatgaaaggcgtttgtgaggtgggcgtgcaagcgctgaagaaatgcgacgggcagctttccacagcccacgaagtcgtgcctttcgctgtttttaagaacagcaaaaaggtgtacctggataagctcgacctgaaaaccgaggagaatctgctccccgattctttcgtctgttttgaacacaagggacagtacaaaggcacaatggactccgggcagaccaagagagagctgaaatctttcgatatttctcaatgccccaagatcggaggccatgggagcaagaaatgtaccggagacgccgccttttgctccgcttatgaatgtacagcccagtacgcgaacgcttattgctctcacgccaatggcagcggcattgtgcagatccaagtttccggggtgtggaagaaacctctttgtgtcggatacgagcgggtggtcgtgaagcgcgaactgagcgccaaaccgattcagagagttgagccctgcacgacctgtatcacaaagtgcgagcctcatggcctcgtggtccggtctaccgggttcaagatctccagcgctgtggcctgcgcttctggagtttgtgtgacaggctcccagaaccccagcaccgaaattacgctgaaatatcctgggatctcccagtctagcggcggagatattggcgtccacatggcccatgacgaccaatccgtgtctagcaagatcgtggcgcactgtcccccgcaggatccttgccttgttcacgggtgcattgtctgtgcccatggactgatcaattaccagtgccacacagctctctccgccttcgtggtggtctttgtgttcagctctatcgctattatctgtctggccattctgtatagagttctcaaatgcctgaagatcgcgccccgcaaagtgcttaaccctctgatgtggattaccgcctttatccggtgggtctacaagaaaatggtggctagagttgccgacaacattaatcaggtgaaccgcgagatcggctggatggaagggggacaactcgtcctgggcaatcccgctcctatcccccggcatgccccgattcctagatactccacctatctgatgcttctcctgatcgtgagctacgcctctgcttgttccgagctgattcaggcgagctctcgcatcacaacctgcagcacagagggggttaacacgaagtgtcggctctccggcaccgccctgattagagctggaagcgtgggcgccgaagcctgccttatgctgaagggggtcaaagatgaccagacaaagttcctcaaaatcaagaccgtgtcttccgagctgagctgccgcgaaggacagtcctattggacaggctcttttagccccaaatgtctgtcctctcggagatgccaccttgtgggggagtgtcacgtcaatcgctgcctcagctggcgggataacgaaacctccgctgagttctcttttgttggagagagcacgaccatgagagaaaataagtgtttcgagcaatgcggcgggtggggctgtggatgctttaacgtgaatccctcctgtctgttcgtgcatacatacctgcagagcgtccggaaggaagccctccgcgtgtttaactgcatcgactgggttcacaaactgacccttgagattacagatttcgacggctctgtgtccaccatcgatctgggggcgtctagctccagatttacgaattggggaagcgtctctctctccctggacgctgaaggcattagcgggtccaacagcttctctttcatcgagagccctggaaagggctatgccattgtggatgagccgttttccgaaatcccccggcaggggttcctgggcgagatcagatgtaattctgaaagctccgttctttctgcccatgagagctgcctccgcgctcctaacctgatttcctacaaacccatgatcgaccagctggaatgcacaaccaatctcattgatccttttgtggtcttcgagcggggatctctgccccaaacaagaaacgagaagacctttgccgcgagcaaaggcaaccgcggggtgcaggctttctccaagggaagcgttcaggccgaccttaccctgatgtttgacaatttcgaagtggattttgtcggcgccgctgtgtcttgtgacgccgctttcctcaacctgacagggtgctattcctgtaatgccggagcgagagtgtgcctgagcatcacgtctaccggcacaggcaccctttccgcccacaacaaggatgggagcctccatattgtcctgccttccgagaatggaacaaaagaccaatgtcagatcctgcactttaccgttcccgaagtggaggaggagttcatgtactcttgcgatggcgacgagcggccgctcctggtgaaggggacgcttatcgctattgatccttttgacgatcgcagagaagccggaggcgagagcacagtcgtgaaccccaaatccgggagctggaatttcttcgactggttttctggactgatgtcctggttcggcggccctctcaagaccatcctgctgatttgtctttacgttgctctgagcatcgggctctttttcctgctcatttatctgggacggaccggcctttctaaaatgtggctggccgccacaaagaaggctagctga

SEQ ID NO: 14418 - RNA, 3594 nt, synthetic construct
  misc_feature 1..3594: note = derived and/or modified CDS sequence (opt5) from RVFV(MP12)__Z30318.1__GP
  source 1..3594: mol_type = other RNA
atgtacgtgctgctcaccatcctgacaagcgtccttgtttgcgaggccattatcagagtgtccctgtctagcacgcgggaagagacctgtttcggcgactccacaaaccccgaaatgattgagggggcttgggattctctccgcgaagaggagatgcctgaggaactgagctgctccatctctggaattagagaagtgaaaaccagctcccaggagctttatcgggccctgaaagcgatcatcgctgccgacggcctcaataacattacatgtcacgggaaggatccggaggacaaaatcagcctgattaagggaccccctcataaaaagcgcgtcggcatcgtgagatgcgaacggcgcagagatgccaagcaaattgggcggaaaaccatggctggaatcgccatgacagttctgcccgctctcgccgtgtttgcgctggcccctgtcgtgttcgctgaggacccccaccttcgcaatagacctggcaagggccataactacattgatgggatgacccaggaagacgccacgtgtaaaccggttacctatgctggagcctgttcttcctttgatgtgctgctcgagaagggcaaattccccctgtttcagagctacgcgcaccatcggacacttctggaagccgtccacgacaccatcatcgctaaggccgatcctccctcttgcgacctcctgtccgctcacgggaatccttgcatgaaggagaaactggtgatgaagacacattgtcccaacgattatcagagcgcccaccatctcaataacgacggaaaaatggcctctgtgaagtgcccgcctaaatacgagctgaccgaagactgtaatttctgccgccaaatgacgggcgcttcccttaagaaagggagctatcccctgcaggatctcttttgccagtcctctgaggacgatggaagcaagctgaagacaaaaatgaagggcgtctgtgaagttggcgtgcaggcgcttaaaaagtgcgacgggcaactgtccaccgcccacgaggtggtccctttcgctgtgtttaaaaacagcaagaaggtttacctcgataaactggacctgaagacagaagagaatctcctgcccgattctttcgtgtgttttgagcacaaaggacagtacaagggcaccatggactccgggcagaccaaaagagaacttaagagcttcgatatttctcagtgccccaagatcggaggccatgggagcaaaaagtgtacaggagacgccgccttttgctccgcttatgagtgtacggcccaatacgcgaacgcttattgctctcacgccaatggcagcggcattgtccagatccaggtgtccggggtttggaaaaagcctctgtgtgtgggatacgaacgggtcgtggtcaaacgcgagctcagcgccaagccgattcaaagagtggaaccctgcaccacatgtatcaccaagtgcgagcctcatggcctggttgtgcggtctacagggttcaaaatctccagcgctgtcgcctgcgcttctggagtgtgtgttaccggctcccagagcccctccacggagattacacttaagtatcctgggatctctcagagctccggcggagatattggcgtgcacatggcccatgacgaccagtctgtcagctccaaaatcgtggcgcactgtcccccgcaagatccttgcctggtgcacgactgcattgtttgtgcccatgggctcatcaactaccagtgccacaccgctctgagcgccttcgtcgtggtgtttgtcttctcttccatcgctattatctgtctggccattctctatagagtgctgaagtgccttaaaatcgcgccccgcaaggttctgaatcctctcatgtggattaccgcctttatccggtggatttacaaaaagatggtggctagagtcgcccataacatcaaccaggtgaatcgcgaaatcggatggatggagggcgggcagctggttctgggaaaccccgctcctattccccggcacgccccgatccctagatacagcacatatcttatgctcctgctgattgtgtcttacgcctccgcttgtagcgaactcatccaagcgtctagccgcattaccacatgctccacggagggcgtcaataccaagtgtcggctgagcgggacagcccttatcagagctggctctgtgggagccgaggcctgcctgatgctcaaaggcgttaaggaagatcagaccaaattcctgaagctgaaaacagtgtccagcgagctttcctgccgcgaagggcagtcttattggaccgggagcttttcccccaagtgtctctctagccggagatgccacctggtcggcgagtgtcatgtgaaccgctgcctgtcctggcgggacaatgaaacgtctgctgagttcagctttgtgggggagtccaccacaatgagagaaaacaagtgtttcgagcagtgcggaggctgggggtgtggctgctttaatgtcaaccccagctgtctcttcgttcacacctacctgcaatctgtgcggaaagaagcccttcgcgtgtttaattgcatcgattgggtccataagctgacactcgagattaccgacttcgatggatccgtgagcacgatcgacctgggcgcgtcttccagcagatttacaaactgggggtctgtttccctgagccttgatgctgaaggaatttccggcagcaattctttcagcttcatcgagtcccctgggaaaggatatgccattgtggacgagccgttttctgaaatcccccggcagggcttcctcggggagatcagatgtaacagcgaatcctctgtcctgagcgcccacgagtcctgcctgcgcgctcctaatctcatttcttacaagcccatgatcgatcagctggaatgcaccacaaaccttattgacccttttgtggttttcgagcggggcagcctgccccagaccagaaatgataaaacctttgccgcgtccaagggaaaccgcggcgtgcaggctttcagcaaggggtctgtccaagccgacctcacactgatgtttgacaacttcgaggtggattttgttggagccgctgtgtcctgtgacgccgctttcctgaatcttacgggctgctatagctgtaacgccggggcgagagtctgcctctctatcacctccacaggaaccggcagcctgtccgcccataataaagatggctctctgcacattgtgctccctagcgaaaacgggacaaaggaccagtgtcaaatcctgcactttaccgtgcccgaggtcgaagaggagttcatgtactcctgcgatggagacgaacggccgcttctggttaaaggcacgctcatcgctattgatccttttgacgatcgcagagaggccgggggagaaagcacagtggtgaatcccaagtctggctcctggaacttcttcgactggtttagcgggctgatgtcttggttcggaggccctctgaaaaccatccttctgatttgtctctacgtcgctctgagcatcggcctctttttcctgcttatttatctgggaggaaccggcctctccaagatgtggctggccgccacaaagaaggcttcttga

SEQ ID NO: 14419 - RNA, 3594 nt, synthetic construct
  misc_feature 1..3594: note = derived and/or modified CDS sequence (opt5) from RVFV__JQ068143.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaattgactccgggcagaccaagagagagctgaaatctttcgatatctctcaatgccccaagattggaggccacgggagcaagaaatgtaccggagacgccgccttttgctccgcttacgaatgtacagcccagtatgcgaacgcttactgctctcatgccaatggcagcggcatcgtgcagattcaagtttccggggtgtggaagaaacctctttgtgtcggatatgagcgggtggtcgtgaagcgcgaactgagcgccaaaccgatccagagagttgagccctgcacgacctgtatcacaaagtgcgagcctcacggcctcgtggtccggtctaccgggttcaagatttccagcgctgtggcctgcgcttctggagtttgtgtgacaggctcccagagcccctccaccgaaatcacgctgaaataccctgggatttctcagagctccggcggagatatcggcgtccatatggcccacgacgaccaatctgtgagctccaagattgtggcgcattgtcccccgcaggatccttgccttgttcacgggtgcatcgtctgtgcccacggactgatcaactatcagtgccatacagctctcagcgccttcgtggtggtctttgtgttctcttccgttgctattatctgtctggccattctgtacaaagtgctcagatgcctgaagatcgcgcccaaaaaggtccttaatcctctgatgtggattaccgcctttatccgctgggtgtacaaaaagatggttgctcgggtggccgacaacattaaccaggtcaatagagagatcggctggatggaagggggacaactcgctctgggcaaccccgcccctatcccccgccacgccccgattcctcggtatagcacctacctgatgcttctcctgatcatttcttatgcttccgcgtgtagcgagctgatccaggcctctagcagaattacaacctgctccacagagggggtgaatacgaagtgtcgcctcagcggcaccgctctgatccgggccggatctgttggcgccgaggcttgccttatgctgaaaggggtgaaggaggatcagacaaaattcctcaagatcaaaaccgtctccagcgaactgtcctgcagagagggacagtcttactggacaggcagcttttcccccaagtgtctgtctagccgccggtgccatcttgtgggggaatgtcacgtgaacagatgcctctcctggcgcgacaatgagacctctgccgagttcagctttgtcggagaatccacgaccatgcgggagaacaagtgtttcgaacaatgcggcgggtggggctgtggatgctttaatgttaaccccagctgtctgttcgtgcacacatatctgcagtctgtgagaaaagaggcgctccgggtctttaattgcattgattgggtgcataagctgacccttgaaatcacagacttcgatggctccgttagcaccattgacctgggggcttcttccagccgctttacgaactggggatctgtgtccctcagcctggatgccgagggcatctccgggagcaattctttcagcttcattgagtcccctggaaaaggctacgccatcgtcgacgaaccgttttctgagatccccagacaggggttcctgggcgaaattcggtgtaacagcgagtcctctgtgcttagcgctcacgaatcctgcctcagagcccctaatctgatctcttataagcccatgattgatcagctggagtgcacaaccaacctcatcgacccttttgttgtgttcgagcgcggaagcctgccccaaacacggaatgataaaacctttgcggcttccaagggcaacagaggggtccaggccttcagcaagggatctgtgcaggccgaccttaccctgatgtttgacaacttcgaagttgattttgtgggcgctgccgtctcctgtgacgctgccttcctcaatctgacagggtgctacagctgtaacgcgggagcccgcgtgtgcctgtctattacgtccaccggcacaggcacccttagcgctcataataaagatgggtccctccacatcgtgctgccttctgagaacggaacaaaggaccaatgtcagatcctgcattttaccgtccccgaagttgaggaggagttcatgtacagctgcgatggcgacgaaagaccgctcctggtgaaagggacgcttattgccatcgatccttttgacgatcggcgcgaagctggaggcgagtccacagtggtcaatcccaagagcgggtcttggaacttcttcgactggttttccggactgatgagctggttcggcggccctctcaaaaccattctgctgatctgtctttatgtggccctgtctattgggctctttttcctgctcatctacctgggaagaaccggccttagcaagatgtggctggccgctacaaagaaagcgtcctga

SEQ ID NO: 14420 - RNA, 3594 nt, synthetic construct
  misc_feature 1..3594: note = derived and/or modified CDS sequence (opt5) from RVFV(2007002445)__EU574037.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagacatcggcgtgcatatggcccacgatgaccaatctgtgagctccaagattgttgcgcattgtcccccgcaggacccttgccttgtccacgggtgcatcgtgtgtgcccacggactgattaattatcagtgccatacagctctcagcgccttcgtggtcatctttgtgttctcttccaccgctatcatttgtctggccgttctgtacagagtgctcaaatgcctgaagatcgcgccccgcaaagtccttaaccctctgatgtggattaccgcctttatccggtgggtgtacaagaaaatggttgctagagtggccgataacattaatcaggtcaaccgcgagatcggctggatggaagggggacaactcgctctgggcaatcccgcccctattccccggcacgccccgatccctagatatagcacatacctgatgcttctcctgatcgtgtcttatgcttccgcgtgtagcgagctgattcaggcctctagccgcatcaccacatgctccacggagggggttaacaccaagtgtcggctcagcggcacagctctgattagagccggatctgtgggcgccgaggcttgccttatgctgaagggggtcaaagaggaccagaccaagttcctcaaaatcaagacagtgtccagcgaactgtcctgccgcgagggacagtcttactggaccggcagcttttcccccaaatgtctgtctagccggagatgccatcttgtgggggaatgtcacgtcaatcgctgcctctcctggcgggataacgagacgtctgccgagttcagctttgttggagaatccaccacaatgagagagaataagtgtttcgaacaatgcggcgggtggggctgtggatgctttaacgtgaatcccagctgtctgttcgtgcacacctatctgcagtctgtccggaaggaggcgctccgcgtgtttaactgcattgactgggttcataaactgacacttgaaatcaccgatttcgacggctccgtgagcacgatcgatctgggggcttcttccagcagatttacaaattggggatctgtctccctcagcctggacgccgagggcatttccgggagcaactctttcagcttcatcgagtcccctggaaagggctacgccattgtggatgaaccgttttctgagatcccccggcaggggttcctgggcgaaattagatgtaatagcgagtcctctgttcttagcgctcacgaatcctgcctccgcgcccctaacctggtgtcttataaacccatgatcgaccagctggagtgcaccacaaatctcatcgatccttttgtcgtgttcgagcggggaagcctgccccaaaccagaaacgaaaagacctttgcggcttccaaaggcaaccgcggggttcaggccttcagcaagggatctattcaggccgaccttacactgatgtttgataatttcgaggtggactttgtcggcgctgccgtgtcctgtgacgctgccttcctcaacctgacggggtgctacagctgtaatgcgggagccagagtgtgcctgtctatcacctccacaggcaccggcacacttagcgctcataacaaggatgggtccctccacattgtcctgccttctgaaaatggaaccaaagaccaatgtcagatcctgcattttacggttcccgaggtggaggaagagttcatgtacagctgcgatggcgacgaacggccgctcctggtgaaggggacacttattgccatcgatccttttgacgatcgcagagaggctggaggcgaatccaccgtcgtgaaccccaaaagcgggtcttggaatttcttcgactggttttccggactgatgagctggttcggcggccctctcaagaccatcctgctgatttgtctttatgttgccctgtctatcgggctctttttcctgctcatttacctgggacggacaggccttagcaaaatgtggctggccgctaccaagaaggcgtcctga

SEQ ID NO: 14421 - RNA, 3594 nt, synthetic construct
  misc_feature 1..3594: note = derived and/or modified CDS sequence (opt5) from RVFV(2008/00101)__HE687306.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagacatcggcgtgcatatggcccacgatgaccaatctgtgagctccaagattgttgcgcattgtcccccgcaggacccttgccttgtccacgggtgcatcgtgtgtgcccacggactgattaattatcagtgccatacagctctcagcgccttcgtggtcatctttgtgttctcttccaccgctatcatttgtctggccgttctgtacagagtgctcaaatgcctgaagatcgcgccccgcaaagtccttaaccctctgatgtggattaccgcctttatccggtgggtgtacaagaaaatggttgctagagtggccgataacattaatcaggtcaaccgcgagatcggctggatggaagggggacaactcgctctgggcaatcccgcccctattccccggcacgccccgatccctagatatagcacatacctgatgcttctcctgatcgtgtcttatgcttccgcgtgtagcgagctgattcaggcctctagccgcatcaccacatgctccacggagggggttaacaccaagtgtcggctcagcggcacagctctgattagagccggatctgtgggcgccgaggcttgccttatgctgaagggggtcaaagaggaccagaccaagttcctcaaaatcaagacagtgtccagcgaactgtcctgccgcgagggacagtcttactggaccggcagcttttcccccaaatgtctgtctagccggagatgccatcttgtgggggaatgtcacgtcaatcgctgcctctcctggcgggataacgagacgtctgccgagttcagctttgttggagaatccaccacaatgagagagaataagtgtttcgaacaatgcggcgggtggggctgtggatgctttaacgtgaatcccagctgtctgttcgtgcacacctatctgcagtctgtccggaaggaggcgctccgcgtgtttaactgcattgactgggttcataaactgacacttgaaatcaccgatttcgacggctccgtgagcacgatcgatctgggggcttcttccagcagatttacaaattggggatctgtctccctcagcctggacgccgagggcatttccgggagcaactctttcagcttcatcgagtcccctggaaagggctacgccattgtggatgaaccgttttctgagatcccccggcaggggttcctgggcgaaattagatgtaatagcgagtcctctgttcttagcgctcacgaatcctgcctccgcgcccctaacctggtgtcttataaacccatgatcgaccagctggagtgcaccacaaatctcatcgatccttttgtcgtgttcgagcggggaagcctgccccaaaccagaaacgacaagacctttgcggcttccaaaggcaaccgcggggttcaggccttcagcaagggatctgtgcaggccgatcttacactgatgtttgacaatttcgaagtcgactttgtgggcgctgccgtgtcctgtgatgctgccttcctcaacctgacggggtgctacagctgtaatgcgggagccagagtctgcctgtctattacctccacaggcaccggcacacttagcgctcataacaaggacgggtccctccacatcgttctgccttctgagaatggaaccaaagatcaatgtcagattctgcattttacggtgcccgaagtggaggaggagttcatgtacagctgcgacggcgatgaacggccgctcctggtcaaggggacacttatcgccattgacccttttgatgaccgcagagaagctggaggcgagtccaccgtggttaaccccaaaagcgggtcttggaatttcttcgattggttttccggactgatgagctggttcggcggccctctcaagaccacactgctgatctgtctttatgtggccctgtctatcgggctctttttcctgctcatttacctgggacggaccggccttagcaaaatgtggctggccgctacaaagaaggcgtcctga

SEQ ID NO: 14422 - RNA, 3594 nt, synthetic construct
  misc_feature 1..3594: note = derived and/or modified CDS sequence (opt5) from RVFV(Hv-B375)__DQ380218.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaaggagagatgcctgaggaactgagctgctccatctctggcattagagaggtcaagacaagctcccaggaactttatcgggccctgaaagcgatcatcgctgccgacgggctcaataacattacctgtcacggaaaggatccggaggacaaaatcagcctgattaaggggccccctcataaaaagcgcgtgggcatcgttagatgcgagcggcgcagagatgccaagcaaattggacgggaaacaatggctggcatcgccatgaccgtgctgcccgctctcgccgtctttgcgctggcccctgtggttttcgctgaggacccccaccttcgcaatagacctggcaaagggcataactacattgatggaatgacacaggaagacgccacctgtaagccggtgacgtatgctggcgcctgcagctcctttgatgtcctgctcgagaaagggaagttccccctgtttcagagctacgcgcaccatcggacccttctggaagccgtgcacgacacaatcatcgctaaagccgatcctccctcttgtgacctccagtccgctcacggaaatccttgcatgaaggagaagctggtgatgaaaacccattgtcccaacgattatcaaagcgcccactacctgaataacgacggcaagatggcctctgtcaaatgcccgcctaagaatgagctcacagaagactgtaacttctgccgccagatgaccggggcttccctgaaaaagggaagctatccccttcaggatctgttttgccagtcctctgaggacgatggcagcaaactcaagacgaagatgaaaggcgtttgtgaagtgggggtgcaagcgctgaagaaatgcgacggacagctttccacagcccatgaggtcgtgcctttcgctgtttttaagaatagcaaaaaggtgtacctggataagctcgacctgaaaaccgaagagaacctgctccccgattctttcgtctgttttgagcacaagggccagtacaaagggacaatggactccggacagaccaagagagaactgaaatctttcgatatttctcaatgccccaagatcggcgggcacggaagcaagaaatgtaccggcgacgccgccttttgctccgcttatgagtgtacagcccagtacgcgaatgcttattgctctcatgccaacggcagcgggattgtgcagatccaagtttccggagtgtggaagaaacctctttgtgtcggctacgaacgggtggtcgtgaagcgcgagctgagcgccaaaccgattcagagagttgaaccctgcacgacctgtatcacaaagtgcgagcctcacgggctcgtggtccggtctaccggattcaagatctccagcgctgtggcctgcgcttctggcgtttgtgtgacagggtcccagagcccctccaccgagattacgctgaaatatcctggcatctctcagagctccggaggcgatattggggtccatatggcccacgacgaccaatctgtgagctccaagatcgtggcgcattgtcccccgcaggatccttgccttgttcacggatgcattgtctgtgcccacggcctgatcaattaccagtgccatacagctctcagcgccttcgtggtggtctttgtgttctcttccatcgctattatctgtctggccattctgtatagagttctcaaatgcctgaagatcgcgccccgcaaagtgcttaaccctctgatgtggattaccgcctttatccggtgggtctacaagaaaatggtggctagagttgccgacaacattaatcaggtgaaccgcgaaatcgggtggatggagggaggccaactcgtcctggggaatcccgctcctatcccccggcacgccccgattcctagatacagcacctatctgatgcttctcctgatcgtgtcttacgcctccgcttgtagcgaactgattcaggcgtctagccgcatcacaacctgctccacagagggcgttaacacgaagtgtcggctcagcggaaccgccctgattagagctggctctgtgggggccgaggcctgccttatgctgaagggagtcaaagaagatcagacaaagttcctcaaaatcaagaccgtgtccagcgagctgtcctgccgcgaaggccagtcttattggacagggagcttttcccccaaatgtctgtctagccggagatgccatcttgtgggagagtgtcacgtcaatcgctgcctctcctggcgggacaacgaaacctctgctgagttcagctttgttggcgagtccacgaccatgagagaaaataagtgtttcgagcaatgcgggggctggggatgtggctgctttaacgtgaatcccagctgtctgttcgtgcacacatacctgcagtctgtccggaaggaagccctccgcgtgtttaactgcatcgattgggttcataaactgacccttgagattacagacttcgatgggtccgtgagcaccatcgacctgggagcgtcttccagcagatttacgaattggggctctgtctccctcagcctggatgctgaagggatttccggaagcaactctttcagcttcatcgagtcccctggcaaggggtatgccattgtggacgagccgttttctgaaatcccccggcagggcttcctgggagagatcagatgtaatagcgaatcctctgttcttagcgcccacgagtcctgcctccgcgctcctaacctgatttcttacaaacccatgatcgatcagctggaatgcacaaccaatctcattgacccttttgtggtcttcgagcggggcagcctgccccaaacaagaaacgataagacctttgccgcgtccaaagggaaccgcggagtgcaggctttcagcaagggctctgttcaggccgaccttaccctgatgtttgacaatttcgaggtggattttgtcggggccgctgtgtcctgtgacgccgctttcctcaacctgacaggatgctatagctgtaatgccggcgcgagagtgtgcctgtctatcacgtccaccggcacagggacccttagcgcccataacaaggatggatccctccacattgtcctgccttctgaaaatggcacaaaagaccaatgtcagatcctgcattttaccgttcccgaggtggaagaggagttcatgtacagctgcgatggggacgaacggccgctcctggtgaagggaacgcttatcgctattgatccttttgacgatcgcagagaggccggcggggaatccacagtcgtgaaccccaaaagcggatcttggaatttcttcgactggttttccggcctgatgagctggttcggcgggcctctcaagaccatcctgctgatttgtctttacgttgctctgtctatcggactctttttcctgctcatttatctgggccggaccgggcttagcaaaatgtggctggccgccacaaagaaggcttcctga

SEQ ID NO: 14423 - RNA, 3594 nt, synthetic construct
  misc_feature 1..3594: note = derived and/or modified CDS sequence (opt5) from RVFV(763/70)__DQ380188.1__GP
  source 1..3594: mol_type = other RNA
atgtacgtgctgctcaccatcctgattacagtccttgtttgcgaggccgtgatcagagtgagcctgtcctctacgcgggaagagacctgtttcggcgacagcacaaaccccgaaatgattgagggggcttgggattccctccgcgaagaggagatgcctgaggaactgtcttgcagcatctccggaattagagaagtcaagacctctagccaggagctttatcgggccctgaaagcgatcatcgctgccgacggcctcaataacattacatgtcacgggaaggatccggaggacaaaatctccctggtgaagggaccccctcataaaaagcgcgttggcattgtgagatgcgaacggcgcagagatgccaagcaaatcgggcgggagaccatggctggaattgccatgacagtcctgcccgctctcgccgtgtttgcgctggcccctgttgtgttcgctgaagacccccaccttcgcaatagacctggcaaaggccataactacatcgatgggatgacccaggaggacgccacgtgtaagccggtcacctatgctggagcctgcagctcttttgatgtgctgctcgaaaaaggcaagttccccctgtttcagtcctacgcgcaccatcggacacttctggaggccgtgcacgacaccattatcgctaaagccgatcctcccagctgtgacctccagtctgctcacgggaatccttgcatgaaggagaagctggtcatgaaaacacattgtcccaacgattatcaatccgcccactacctgaataacgacggaaagatggccagcgttaaatgcccgcctaagtatggcctcaccgaagactgtaatttctgccgccagatgacgggggcttctctgaaaaagggatcctacccccttcaggatctgttttgccagagctccgaggacgatggctctaaactcaagacaaagatgaaaggcgtgtgtgaagtgggggtccaagcgctgaagaaatgcgacggacagcttagcaccgcccatgaggtggttcctttcgctgtgtttaagaactccaaaaaggtctacctggataagctcgacctgaaaacagaagagaatctgctccccgatagcttcgtgtgttttgagcacaagggccagtataaagggaccatggactctggacagaccaagagagaactgaaatccttcgatatcagccaatgccccaagattggcgggcacggatctaagaaatgtacaggcgacgccgccttttgcagcgcttacgagtgtacggcccagtatgcgaacgcttactgctcccatgccaatggctctgggatcgttcagattcaagtgagcggagtctggaagaaacctctttgtgtgggctatgaacgggtcgtggttaagcgcgagctgtccgccaaaccgatccagagagtggaaccctgcaccacatgtattaccaagtgcgagcctcacgggctcgtcgtgcggagcacaggattcaagatctcttccgctgttgcctgcgctagcggcgtgtgtgtcaccgggtctcagtcccccagcacggagatcacactgaaataccctggcatttcccagtctagcggaggcgatatcggggtgcatatggcccacgacgaccaatccgtgtctagcaagattgttgcgcattgtcccccgcaggatccttgccttgtccacggatgcatcgtgtgtgcccacggcctgattaactatcagtgccataccgctctctccgccttcgtggtcgtgtttgttttcagctctgtggctatcatctgtctggccattctgtacaaagtcctcaagtgcctgaaaatcgcgcccagaaaggtgcttaatcctctgatgtggattaccgcctttatccgctgggtttacaaaaagatggtggctcgggtcgccgacaacattaaccaggtgaatagagaaatcgggtggatggagggaggccaactcgctctggggaaccccgcccctattccccgccacgccccgatccctcggtattccacatacctgatgcttctcctgatcgttagctatgcttctgcgtgttccgaactgattcaggccagctctagaatcaccacatgcagcacggagggcgtgaataccaagtgtcgcctctccggaacagctctgattcgggccggcagcgtcggggccgaggcttgccttatgctgaaaggagtgaaggaagatcagaccaaattcctcaagatcaaaacagtgtcttccgagctgagctgcagagaaggccagtcctactggaccgggtcttttagccccaagtgtctgtcctctcgccggtgccatcttgtcggagagtgtcacgttaacagatgcctcagctggcgcgacaatgaaacgtccgccgagttctcttttgtgggcgagagcaccacaatgcgggaaaacaagtgtttcgagcaatgcgggggctggggatgtggctgctttaatgtgaacccctcctgtctgttcgtccacacctatctgcagagcgtgagaaaagaagcgctccgggtttttaattgcattgattgggtgcataagctgacacttgagatcaccgacttcgatgggtctgtctccacgatcgacctgggagcttctagctcccgctttacaaactggggcagcgtgtctctctccctggatgccgaagggattagcggatccaatagcttctctttcatcgagagccctggcaaagggtacgccattgttgacgagccgttttccgaaatccccagacagggcttcctgggagagattcggtgtaactctgaaagctccgtgctttctgctcacgagagctgcctcagagcccctaatctgatctcctataagcccatgatcgatcagctggaatgcaccacaaacctcattgacccttttgtcgtgttcgagcgcggctctctgccccaaacccggaatgataaaacctttgcggctagcaaggggaacagaggagttcaggccttctccaagggcagcgtgcaggccgaccttacactgatgtttgacaacttcgaggtcgattttgtgggggctgccgtgtcttgtgacgctgccttcctcaatctgacgggatgctactcctgtaacgcgggcgcccgcgtctgcctgagcatcacctctacaggcaccgggacactttccgctcataataaagatggaagcctccacattgttctgccttccgaaaacggcaccaaggaccaatgtcagatcctgcattttacggtgcccgaggtggaagaggagttcatgtactcttgcgatggggacgaaagaccgctcctggtcaaaggaacacttattgccatcgatccttttgacgatcggcgcgaggctggcggggaaagcaccgtggttaatcccaagtccggaagctggaacttcttcgactggttttctggcctgatgtcctggttcggcgggcctctcaaaaccatcctgctgatttgtctttatgtggccctgagcatcggactctttttcctgctcatttacctgggcagaacagggctttctaagatgtggctggccgctaccaagaaagcgagctga

SEQ ID NO: 14424 - RNA, 3594 nt, synthetic construct
  misc_feature 1..3594: note = derived and/or modified CDS sequence (opt5) from RVFV(RVFBJ01/2016)__KX785331.1__GP
  source 1..3594: mol_type = other RNA
atgtacgtgctgctcaccatcctgattagcgtccttgtttgcgaggccatcattagagtgtccctgtctagcacacgggaagagacgtgtttcggcgactccaccaaccccgaaatgatcgagggggcttgggattctctccgcgaagaggagatgcctgaagaactgagctgctccatttctggaatcagagaagtgaagacaagctcccaggagctttatcgggccctgaaagcgatcattgctgccgacggcctcaataacatcacctgtcacgggaaggatccggaggacaaaattagcctgatcaagggaccccctcataaaaagcgcgtcggcattgtgagatgcgaacggcgcagagatgccaagcaaatcgggcgggagacaatggctggaattgccatgaccgttctgcccgctctcgccgtgtttgcgctggcccctgtcgtgttcgctgaagacccccaccttcgcaatagacctggcaaaggccataactacatcgatgggatgacacaggaggacgccacctgtaagccggttacgtatgctggagcctgcagctcctttgatgtgctgctcgaaaaaggcaagttccccctgtttcagagctacgcgcaccatcggacccttctggaggccgtccacgacacaatcattgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtgaaatgcccgcctaagcatgaactcacagaggactgtaatttctgccgccagatgaccggcgcttccctgaaaaaggggagctatccccttcaggatctgttttgccagtcctctgaagacgatggaagcaaactcaagacgaagatgaaaggcgtctgtgaggttggcgtgcaagcgctgaagaaatgcgacgggcagctttccacagcccacgaagtggtccctttcgctgtgtttaagaacagcaaaaaggtttacctggataagctcgacctgaaaaccgaggagaatctgctccccgattctttcgtgtgttttgaacacaagggacagtacaaaggcacaatggactccgggcagaccaagagagagctgaaatctttcgatatctctcaatgccccaagattggaggccatgggagcaagaaatgtaccggagacgccgccttttgctccgcttatgaatgtacagcccagtacgcgaacgcttattgctctcacgccaatggcagcggcatcgtccagattcaagtgtccggggtttggaagaaacctctttgtgtgggatacgagcgggtcgtggtcaagcgcgaactgagcgccaaaccgatccagagagtggagccctgcacgacctgtatcacaaagtgcgagcctcatggcctcgttgtgcggtctaccgggttcaagatttccagcgctgtcgcctgcgcttctggagtgtgtgttacaggctcccagagcccctccaccgaaatcacgctgaaatatcctgggatttctcagagctccggcggagatatcggcgtgcacatggcccatgacgaccaatctgtcagctccaagattgtggcgcactgtcccccgcaggatccttgccttgtgcacgggtgcatcgtttgtgcccatggactgatcaactaccagtgccacacagctctcagcgccttcgtcgtggtgtttgtcttctcttccgtggctattatctgtctggccattctgtataaagttctcagatgcctgaagatcgcgcccaaaaaggtgcttaatcctctgatgtggattaccgcctttatccgctgggtctacaaaaagatggtggctcgggttgccgacaacattaaccaggtgaatagagagatcggctggatggaagggggacaactcgctctgggcaaccccgcccctatcccccgccatgccccgattcctcggtacagcacctatctgatgcttctcctgatcatttcttacgcttccgcgtgtagcgagctgatccaggcctctagcagaattacaacctgctccacagagggggtcaatacgaagtgtcgcctcagcggcaccgctctgatccgggccggatctgtgggcgccgaggcttgccttatgctgaaaggggttaaggaggatcagacaaaattcctcaagatcaaaaccgtgtccagcgaactgtcctgcagagagggacagtcttattggacaggcagcttttcccccaagtgtctgtctagccgccggtgccaccttgtcggggaatgtcacgtgaacagatgcctctcctggcgcgacaatgagacctctgccgagttcagctttgtgggagaatccacgaccatgcgggagaacaagtgtttcgaacaatgcggcgggtggggctgtggatgctttaatgtcaaccccagctgtctgttcgttcatacatacctgcagtctgtgagaaaagaggcgctccgggtgtttaattgcattgattgggtccacaagctgacccttgaaatcacagacttcgatggctccgtgagcaccattgacctgggggcttcttccagccgctttacgaactggggatctgtttccctcagcctggatgccgagggcatctccgggagcaattctttcagcttcattgagtcccctggaaaaggctatgccatcgtggacgaaccgttttctgagatccccagacaggggttcctgggcgaaattcggtgtaacagcgagtcctctgtccttagcgctcatgaatcctgcctcagagcccctaatctgatctcttacaagcccatgattgatcagctggagtgcacaaccaacctcatcgacccttttgtggttttcgagcgcggaagcctgccccaaacacggaatgataaaacctttgcggcttccaagggcaacagaggggtgcaggccttcagcaagggatctgtccaggccgaccttaccctgatgtttgacaacttcgaagtggattttgttggcgctgccgtgtcctgtgacgctgccttcctcaatctgacagggtgctatagctgtaacgcgggagcccgcgtctgcctgtctattacgtccaccggcacaggcacccttagcgctcacaataaagatgggtccctccatatcgtgctgccttctgagaacggaacaaaggaccaatgtcagatcctgcactttaccgtgcccgaagtcgaggaggagttcatgtacagctgcgatggcgacgaaagaccgctcctggttaaagggacgcttattgccatcgatccttttgacgatcggcgcgaagctggaggcgagtccacagtggtgaatcccaagagcgggtcttggaacttcttcgactggttttccggactgatgagctggttcggcggccctctcaaaaccattctgctgatctgtctttacgtcgccctgtctattgggctctttttcctgctcatctatctgggaagaaccggccttagcaagatgtggctggccgctacaaagaaagcgtcctga

SEQ ID NO: 14425 - RNA, 3594 nt, synthetic construct
  misc_feature 1..3594: note = derived and/or modified CDS sequence (opt5) from RVFV(Lunyo)__KU167026.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcacaatggtgtccgggcagaccaagagagagctgaaatctttcgacatttctcaatgccccaagatcggaggccacgggagcaagaaatgtaccggagatgccgccttttgctccgcttacgaatgtacagcccagtatgcgaacgcttactgctctcatgccaatggcagcggcattgttcagatccaagtgtccggggtctggaagaaacctctttgtgtgggatatgagcgggtcgtggttaagcgcgaactgagcgccaaaccgattcagagagtggagccctgcacgacctgtatcacaaagtgcgagcctcacggcctcgtcgtgcggtctaccgggttcaagatctccagcgctgttgcctgcgcttctggagtgtgtgtcacaggctcccagagcccctccaccgaaattacgctgaaataccctgggatctctcagagctccggcggagacattggcgtgcatatggcccacgatgaccaatctgtgagctccaagatcgttgcgcattgtcccccgcaggacccttgccttgtccacgggtgcattgtgtgtgcccacggactgatcaactatcagtgccatacagctctcagcgccttcgtggtcgtgtttgttttctcttccgtggctatcatttgtctggccatcctgtacaaagtcctcaagtgcctgaaaattgcgcccagaaaggtgcttaatcctctgatgtggatcaccgcctttattcgctgggtttacaaaaagatggtggctcgggtcgccgataacatcaaccaggtgaatagagagattggctggatggaagggggacaactcgctctgggcaaccccgcccctatcccccgccacgccccgatccctcggtatagcacctacctgatgcttctcctgattgtttcttatgcttccgcgtgtagcgagctgatccaggcctctagcagaattacaacctgctccacagagggggtgaatacgcgctgtcggctcagcggcaccgctctgatcagagccggatctgtcggcgccgaggcttgccttatgctgaagggggtgaaagaggaccagacaaagttcctcaaaattaagaccgtgtccagcgaactgtcctgccgcgagggacagtcttactggacaggcagcttttcccccaaatgtctgtctagccggagatgccatcttgtcggggaatgtcacgttaaccgctgcctctcctggcgggataatgagacctctgccgagttcagctttgtgggagaatccacgaccatgagagagaacaagtgtttcgaacaatgcggcgggtggggctgtggatgctttaatgtgaaccccagctgtctgttcgtccacacatatctgcagtctgtgcggaaggaggcgctccgcgtttttaattgcatcgactgggtgcataaactgacccttgaaatcacagatttcgacggctccgtcagcaccattgatctgggggcttcttccagcagatttacgaactggggatctgtgtccctcagcctggacgccgagggcatctccgggagcaattctttcagcttcattgagtcccctggaaagggctacgccatcgttgatgaaccgttttctgagattccccggcaggggttcctgggcgaaatcagatgtaacagcgagtcctctgtgcttagcgctcacgaatcctgcctccgcgcccctaatctgatctcttataaacccatgattgaccagctggagtgcacaaccaacctcatcgatccttttgtcgtgttcgagcggggaagcctgccccaaacaagaaatgacaagacctttgcggcttccaaaggcaaccgcggggttcaggccttcagcaagggatctgtgcaggccgatcttaccctgatgtttgacaacttcgaagtcgactttgtgggcgctgccgtgtcctgtgatgctgccttcctcaatctgacagggtgctacagctgtaacgcgggagccagagtctgcctgtctattacgtccaccggcacaggcacccttagcgctcataataaggacgggtccctccacatcgttctgccttctgagaacggaacaaaagatcaatgtcagattctgcattttaccgtgcccgaagtggaggaggagttcatgtacagctgcgacggcgatgaacggccgctcctggtcaaggggacgcttatcgccatcgacccttttgatgaccgcagagaagctggaggcgagtccacagtggttaatcccaaaagcgggtcttggaacttcttcgattggttttccggactgatgagctggttcggcggccctctcaagaccattctgctgatctgtctttatgtggccctgtctattgggctctttttcctgctcatctacctgggacggaccggccttagcaaaatgtggctggccgctacaaagaaggcgtcctga

SEQ ID NO: 14426 - RNA, 3594 nt, synthetic construct
  misc_feature 1..3594: note = derived and/or modified CDS sequence (opt5) from RVFV(2007000234)__JF326191.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatccggcgcgagacaatggctgggattgccatgaccgtcctgcccgctctcgccgtgtttgcgctggcccctgttgtgttcgctgaagatccccaccttagaaaccggcctggaaaaggccataattacatcgacggcatgacacaggaggatgccacctgtaagccggtcacgtatgctggggcctgcagctcctttgacgtgctgctcgaaaaaggaaagttccccctgtttcagagctacgcgcaccatcgcacccttctggaggccgtgcacgatacaattatcgctaaagccgaccctccctcttgtgatctccagtccgctcacggcaacccttgcatgaaggagaagctggtcatgaaaacccattgtcccaatgactatcaaagcgcccactacctgaacaatgatgggaagatggcctctgttaaatgcccgcctaagtatgaactcacagaggactgtaacttctgcagacagatgaccggagcttccctgaaaaagggcagctacccccttcaggacctgttttgccagtcctctgaagatgacgggagcaaactcaagacgaagatgaaaggagtgtgtgaggtgggcgtccaagcgctgaagaaatgcgatggccagctttccacagcccatgaagtggttcctttcgctgtgtttaagaatagcaaaaaggtctacctggacaagctcgatctgaaaaccgaggagaacctgctccccgactctttcgtgtgttttgaacacaaggggcagtataaaggaacaatggattccggccagaccaagcgggagctgaaatctttcgacatctctcaatgccccaagattgggggacacggcagcaagaaatgtaccggggatgccgccttttgctccgcttacgaatgtacagcccagtatgcgaatgcttactgctctcatgccaacggaagcggcatcgttcagattcaagtgtccggcgtctggaagaaacctctttgtgtggggtatgagcgcgtcgtggttaagagagaactgagcgccaaaccgatccagcgggtggagccctgcacgacctgtattacaaagtgcgagcctcacggactcgtcgtgagatctaccggcttcaagatctccagcgctgttgcctgcgcttctggggtgtgtgtcacaggatcccagagcccctccaccgaaatcacgctgaaataccctggcatttctcagagctccgggggcgacatcggagtgcatatggcccacgatgaccaatctgtgagctccaagattgttgcgcattgtcccccgcaggacccttgccttgtccacggctgcatcgtgtgtgcccacgggctgattaattatcagtgccatacagctctcagcgccttcgtggtcatctttgtgttctcttccaccgctatcatttgtctggccgttctgtaccgcgtgctcaaatgcctgaagatcgcgccccggaaagtccttaaccctctgatgtggattaccgcctttatcagatgggtgtacaagaaaatggttgctcgcgtggccgataacattaatcaggtcaaccgggagatcggatggatggaaggcgggcaactcgctctgggaaatcccgcccctattcccagacacgccccgatccctcgctatagcacatacctgatgcttctcctgatcgtgtcttatgcttccgcgtgtagcgagctgattcaggcctctagccggatcaccacatgctccacggagggcgttaacaccaagtgtagactcagcgggacagctctgattcgcgccggctctgtgggagccgaggcttgccttatgctgaagggcgtcaaagaggaccagaccaagttcctcaaaatcaagacagtgtccagcgaactgtcctgccgggaggggcagtcttactggaccggcagcttttcccccaaatgtctgtctagcagacgctgccatcttgtgggagaatgtcacgtcaatcggtgcctctcctggagagataacgagacgtctgccgagttcagctttgttggggaatccaccacaatgcgggagaataagtgtttcgaacaatgcggaggctgggggtgtggctgctttaacgtgaatcccagctgtctgttcgtgcacacctatctgcagtctgtccgcaaggaggcgctcagagtgtttaactgcattgactgggttcataaactgacacttgaaatcaccgatttcgacggatccgtgagcacgatcgatctgggcgcttcttccagccggtttacaaattgggggtctgtctccctcagcctggacgccgagggaatttccggcagcaactctttcagcttcatcgagtcccctgggaagggatacgccattgtggatgaaccgttttctgagatccccagacagggcttcctgggggaaattcgctgtaatagcgagtcctctgttcttagcgctcacgaatcctgcctccgggcccctaacctggtgtcttataaacccatgatcgaccagctggagtgcaccacaaatctcatcgatccttttgtcgtgttcgagagaggcagcctgccccaaacccgcaacgacaagacctttgcggcttccaaaggaaacagaggcgttcaggccttcagcaaggggtctgtgcaggccgatcttacactgatgtttgacaatttcgaagtcgactttgtgggagctgccgtgtcctgtgatgctgccttcctcaacctgacgggctgctacagctgtaatgcgggggcccgggtctgcctgtctattacctccacaggaaccggcacacttagcgctcataacaaggacggctccctccacatcgttctgccttctgagaatgggaccaaagatcaatgtcagattctgcattttacggtgcccgaagtggaggaggagttcatgtacagctgcgacggagatgaacgcccgctcctggtcaagggcacacttatcgccattgacccttttgatgacagacgggaagctgggggagagtccaccgtggttaaccccaaaagcggctcttggaatttcttcgattggttttccgggctgatgagctggttcggaggccctctcaagaccatcctgctgatctgtctttatgtggccctgtctattggcctctttttcctgctcatctacctggggcgcacaggacttagcaaaatgtggctggccgctaccaagaaggcgtcctga

SEQ ID NO: 14427 - RNA, 3594 nt, synthetic construct
  misc_feature 1..3594: note = derived and/or modified CDS sequence (opt5) from RVFV(KEN07-KUR340)__EF460404.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagacatcggcgtgcatatggcccacgatgaccaatctgtgagctccaagattgttgcgcattgtcccccgcaggacccttgccttgtccacgggtgcatcgtgtgtgcccacggactgattaattatcagtgccatacagctctcagcgccttcgtggtcatctttgtgttctcttccaccgctatcatttgtctggccgttctgtacagaatgctcaaatgcctgaagatcgcgccccgcattgtgcttaaccctctgatgtggatcaccgcctttattcggtgggtctacaaaaagatggtggctagagttgccgataacatcaatcaggtgaaccgcgagattggctggatggaagggggacaactcgctctgggcaatcccgcccctatcccccggcacgccccgatccctagatatagcacatacctgatgcttctcctgattgtctcttatgcttccgcgtgtagcgagctgatccaggcctctagccgcattaccacatgctccacggagggggtgaacaccaaatgtcggctcagcggcacagctctgatcagagccggatctgttggcgccgaggcttgccttatgctgaagggggtgaaggaggaccagaccaaattcctcaagattaaaacagtctccagcgaactgtcctgccgcgagggacagtcttactggaccggcagcttttcccccaagtgtctgtctagccggagatgccatcttgtgggggaatgtcacgtgaatcgctgcctctcctggcgggataacgagacgtctgccgagttcagctttgtcggagaatccaccacaatgagagagaataaatgtttcgaacaatgcggcgggtggggctgtggatgctttaacgttaatcccagctgtctgttcgtgcacacctatctgcagtctgtgcggaaggaggcgctccgcgtctttaactgcatcgactgggtgcataagctgacacttgaaatcaccgatttcgacggctccgttagcacgattgatctgggggcttcttccagcagatttacaaattggggatctgtgtccctcagcctggacgccgagggcatctccgggagcaactctttcagcttcattgagtcccctggaaaaggctacgccatcgtcgatgaaccgttttctgagattccccggcaggggttcctgggcgaaatcagatgtaatagcgagtcctctgtgcttagcgctcacgaatcctgcctccgcgcccctaacctggtttcttataagcccatgatcgaccagctggagtgcaccacaaatctcattgatccttttgtggtcttcgagcggggaagcctgccccaaaccagaaacgacaaaacctttgcggcttccaagggcaaccgcggggtgcaggccttcagcaaaggatctgttcaggccgatcttacactgatgtttgacaatttcgaagtggactttgtcggcgctgccgtgtcctgtgatgctgccttcctcaacctgacggggtgctacagctgtaatgcgggagccagagtgtgcctgtctatcacctccacaggcaccggcacacttagcgctcataacaaggacgggtccctccacattgtcctgccttctgagaatggaaccaaggatcaatgtcagatcctgcattttacggttcccgaagtggaggaggagttcatgtacagctgcgacggcgatgaacggccgctcctggtgaaagggacacttattgccatcgacccttttgatgaccgcagagaagctggaggcgagtccaccgtcgtgaaccccaagagcgggtcttggaatttcttcgattggttttccggactgatgagctggttcggcggccctctcaaaaccatcctgctgatttgtctttatgttgccctgtctatcgggctctttttcctgctcatttacctgggacggacaggccttagcaagatgtggctggccgctaccaaaaaggcgtcctga

SEQ ID NO: 14428 - RNA, 3594 nt, synthetic construct
  misc_feature 1..3594: note = derived and/or modified CDS sequence (opt5) from RVFV(2373/74)__DQ380194.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgttacgggaaggatccggaggacaaaatcagcctgattaagggaccccctcacaaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccatcttcgcaatagacctggcaaaggccacaactatattgatgggatgacacaggaggacgccacctgtaagccggtgacgtacgctggagcctgcagctcctttgatgtcctgctcgaaaaaggcaagttccccctgtttcagagctatgcgcatcaccggacccttctggaggccgtgcatgacacaatcatcgctaaagccgatcctccctcttgtgacctccagtccgctcacgggaatccttgcatgaaggagaagctggtgatgaaaacccactgtcccaacgattaccaaagcgcccattatctgaataacgacggaaagatggcctctgtcaaatgcccgcctaagtacgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccacgaagtcgtgcctttcgctgtttttaagaacagcaaaaaggtgtatctggataagctcgacctgaaaaccgaggagaatctgctccccgattctttcgtctgttttgaacataagggacagtacaaaggcacaatggactccgggcagaccaagagagagctgaaatctttcgatatttctcaatgccccaagatcggaggccacgggagcaagaaatgtaccggagacgccgccttttgctccgcttatgaatgtacagcccagtacgcgaacgcttattgctctcacgccaatggcagcggcattgtgcagatccaagtttccggggtgtggaagaaacctctttgtgtcggatacgagcgggtggtcgtgaagcgcgaactgagcgccaaaccgattcagagagttgagccctgcacgacctgtatcacaaagtgcgagcctcatggcctcgtggtccggtctaccgggttcaagatctccagcgctgtggcctgcgcttctggagtttgtgtgacaggctcccagagcccctccaccgaaattacgctgaaatatcctgggatctctcagagctccggcggagatattggcgtccacatggcccatgacgaccaatctgtgagctccaagatggtggcgcactgtcccccgcaggatccttgccttgttcatgggtgcatcgtctgtgcccacggactgattaactaccagtgccacacagctctcagcgccttcgtggtggtctttgtgttctcttccgttgctatcatctgtctggccattctgtacaaagtgctcaagtgcctgaaaatcgcgcccagaaaggtccttaatcctctgatgtggattaccgcctttatccgctgggtgtataaaaagatggttgctcgggtggccgacaacattaaccaggtcaatagagagatcggctggatggaagggggacaactcgctctgggcaaccccgcccctattccccgccatgccccgatccctcggtacagcacctatctgatgcttctcctgatcgtgtcttacgcttccgcgtgtagcgagctgattcaggcctctagcagaatcacaacctgctccacagagggggttaatacgaagtgtcgcctcagcggcaccgctctgattcgggccggatctgtgggcgccgaggcttgccttatgctgaaaggggtcaaggaggatcagacaaaattcctcaagatcaaaaccgtgtccagcgaactgtcctgcagagagggacagtcttattggacaggcagcttttcccccaagtgtctgtctagccgccggtgccaccttgtgggggaatgtcatgtcaacagatgcctctcctggcgcgacaatgagacctctgccgagttcagctttgttggagaatccacgaccatgcgggagaacaagtgtttcgaacaatgcggcgggtggggctgtggatgctttaatgtgaaccccagctgtctgttcgtgcacacatacctgcagtctgtcagaaaagaggcgctccgggtgtttaattgcattgattgggttcacaagctgacccttgaaatcacagacttcgatggctccgtgagcaccctggacctcggggcttcttccagccgctttacgaactggggatctgtctccctgagcctggatgccgagggcatctccgggagcaattctttcagcttcattgagtcccctggaaaaggctatgccatcgtggacgaaccgttttctgagattcccagacaggggttccttggcgaaatccggtgtaacagcgagtcctctgttctcagcgctcatgaatcctgcctgagagcccctaatctgatttcttacaagcccatgatcgatcagctcgagtgcacaaccaacctgatcgacccttttgtggtcttcgagcgcggaagccttccccaaacacggaatgagaaaacctttgcggcttccaagggcaacagaggggtgcaggccttcagcaagggatctgttcaggccgatctgaccctcatgtttgacaacttcgaagtggactttgtcggcgctgccgtgtcctgtgatgctgccttcctgaatctgacagggtgctacagctgtaacgcgggagcccgcgtgtgcctttctattacgtccaccggcacaggcaccctcagcgctcacaataaagacgggtccctgcatatcgtcctgccttctgaaaacggaacaaaggatcaatgtcagattctccactttaccgttcccgaggtggaggaagagttcatgtatagctgcgacggcgatgaaagaccgctgcttgtgaaagggacgctgatcgccattgacccttttgatgaccggcgcgaggctggaggcgaatccacagtcgtgaatcccaagagcgggtcttggaacttcttcgattggttttccggactcatgagctggttcggcggccctctgaaaaccatcctgcttatctgtctgtacgttgccctctctattgggctgtttttcctcctgatctatcttggaagaaccggcctgagcaagatgtggctcgccgctacaaagaaagcgtcctga

SEQ ID NO: 14429 - RNA, 3594 nt, synthetic construct
  misc_feature 1..3594: note = derived and/or modified CDS sequence (opt5) from RVFV(200803169)__JF311384.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacctctttgtgtgggatatgagcgggtcgtggttaagcgcgaactgagcgccaaaccgatccagagagtggagccctgcacgacctgtattacaaagtgcgagcctcacggcctcgtcgtgcggtctaccgggttcaagatctccagcgctgttgcctgcgcttctggagtgtgtgtcacaggctcccagagcccctccaccgaaatcacgctgaaataccctgggatttctcagagctccggcggagacatcggcgtgcatatggcccacgatgaccaatctgtgagctccaagattgttgcgcattgtcccccgcaggacccttgccttgtccacgggtgcatcgtgtgtgcccacggactgattaattatcagtgccatacagctctcagcgccttcgtggtcatctttgtgttctcttccaccgctatcatttgtctggccgttctgtacagagtgctcaaatgcctgaagatcgcgccccgcaaagtccttaaccctctgatgtggattaccgcctttatccggtgggtgtacaagaaaatggttgctagagtggccgataacattaatcaggtcaaccgcgagatcggctggatggaagggggacaactcgctctgggcaatcccgcccctattccccggcacgccccgatccctagatatagcacatacctgatgcttctcctgatcgtgtcttatgcttccgcgtgtagcgagctgattcaggcctctagccgcatcaccacatgctccacggagggggttaacaccaagtgtcggctcagcggcacagctctgattagagccggatctgtgggcgccgaggcttgccttatgctgaagggggtcaaagtggaccagaccaagttcctcaaaatcaagacagtgtccagcgagctgtcctgccgcgaaggacagtcttactggaccggcagcttttcccccaaatgtctgtctagccggagatgccatcttgtcggggagtgtcacgttaatcgctgcctctcctggcgggataacgaaacgtctgccgagttcagctttgtgggagagtccaccacaatgagagaaaataagtgtttcgagcaatgcggcgggtggggctgtggatgctttaacgtgaatcccagctgtctgttcgtccacacctatctgcagtctgtgcggaaggaagcgctccgcgtttttaactgcattgactgggtgcataaactgacacttgagatcaccgatttcgacggctccgtcagcacgatcgatctgggggcttcttccagcagatttacaaattggggatctgtgtccctcagcctggacgccgaaggcatttccgggagcaactctttcagcttcatcgagtcccctggaaagggctacgccattgttgatgagccgttttctgaaatcccccggcaggggttcctgggcgaggtgagatgtaatagcgaatcctctgtccttagcgctcacgagtcctgcctccgcgcccctaacctggtgtcttataaacccatgattgaccagctggaatgcaccacaaatctcatcgatccttttgttgtgttcgagcggggaagcctgccccaaaccagaaacgacaagacctttgcggcttccaaaggcaaccgcggggtccaggccttcagcaagggatctgtgcaggccgatcttacactgatgtttgacaatttcgaggtggactttgtcggcgctgccgtttcctgtgatgctgccttcctcaacctgacggggtgctacagctgtaatgcgggagccagagtgtgcctgtctatcacctccacaggcaccggcacacttagcgctcataacaaggacgggtccctccacattgtgctgccttctgaaaatggaaccaaagatcaatgtcagatcctgcattttacggtccccgaggtggaagaggagttcatgtacagctgcgacggcgatgaacggccgctcctggttaaggggacacttattgccatcgacccttttgatgaccgcagagaggctggaggcgaatccaccgtggtcaaccccaaaagcgggtcttggaatttcttcgattggttttccggactgatgagctggttcggcggccctctcaagaccattctgctgatctgtctttatgtggccctgtctatcgggctctttttcctgctcatttacctgggacggacaggccttagcaaaatgtggctggccgctaccaagaaggcgtcctga

SEQ ID NO: 14430 - RNA, 3594 nt, synthetic construct
  misc_feature 1..3594: note = derived and/or modified CDS sequence (opt5) from RVFV(200803167)__JF311382.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatcttcatctgcgcaacagacccggcaaaggccacaattacatcgacgggatgacacaggaggatgccacctgtaagcctgtcacgtatgctggagcctgcagctcctttgacgtgctcctggaaaaaggcaagttcccgctttttcagagctacgcgcaccatcggaccctgctcgaggccgtgcacgatacaattatcgctaaagccgatcccccttcttgtgacctgcagtccgctcacgggaacccctgcatgaaggagaagctggtcatgaaaacccattgtcctaatgactatcaaagcgcccactacctcaacaatgatggaaagatggcctctgttaaatgtcccccgaagtatgaactgacagaggactgcaacttctgccgccagatgaccggcgcttcccttaaaaaggggagctaccctctgcaggacctcttttgccagtcctctgaagatgacggaagcaaactgaagacgaagatgaaaggcgtgtgtgaggtgggcgtccaagcgcttaagaaatgcgatgggcagctgtccacagcccatgaagtggttcccttcgctgtgtttaagaatagcaaaaaggtctacctcgacaagctggatctgaaaaccgaggagaacctcctgcctgactctttcgtgtgttttgaacacaagggacagtataaaggcacaatggattccgggcagaccaagagagagcttaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtccggggtctggaagaaacccctgtgtgtgggatatgagcgggtcgtggttaagcgcgaactcagcgccaaacctatccagagagtggagccgtgcacgacctgtattacaaagtgcgagccccacggcctggtcgtgcggtctaccgggttcaagatctccagcgctgttgcctgcgcttctggagtgtgtgtcacaggctcccagagcccttccaccgaaatcgcccttaaataccccgggatttctcagagctccggcggagacatcggcgtgcatatggcgcacgatgaccaatctgtgagctccaagattgttgcccattgccctccccaggacccgtgtctggtccacgggtgcatcgtgtgtgctcacggactcattaattatcagtgccatacggccctgagcgctttcgtggtcgtgtttgttttctcttccatcgccatcatttgtctggcgatcctctacagagtgctgaaatgccttaagattgcccctcgcaaagtcctgaaccccctcatgtggatcacagcttttattcggtgggtgtacaagaaaatggttgccagagtggctgataacatcaatcaggtcaaccgcgagattggctggatggaagggggacaactggtgctgggcaatcctgcccccatccctcggcacgcccccatcccgagatatagcacctaccttatgctcctgctgattgtttcttatgcttccgcgtgtagcgagctcatccaggcctctagccgcattaccacatgctccaccgagggggtgaacacaaagtgtcggctgagcggcacggctcttatcagagccggatctgtcggcgccgaggcttgcctgatgctcaagggggtgaaagaggaccagaccaagttcctgaaaattaagacagtgtccagcgaactgtcctgccgcgagggacagtcttactggaccggcagcttttcccctaaatgtctttctagccggagatgccatctcgtcggggaatgtcacgttaatcgctgcctgtcctggcgggataacgagacatctgccgagttcagctttgtgggagaatccaccacgatgagagagaataagtgtttcgaacaatgcggcgggtggggctgtggatgctttaacgtgaatcccagctgtctgttcgtccacacctatctccagtctgtgcggaaggaggcgctgcgcgtttttaactgcatcgactgggtgcataaacttacactggaaatcaccgatttcgacggctccgtcagcacaattgatctcggggcttcttccagcagatttaccaattggggatctgtgtccctgagcctggacgccgagggcatctccgggagcaactctttcagcttcattgagtcccccggaaagggctacgccatcgttgatgaacctttttctgagattccgcggcaggggttccttggcgaaatcagatgtaatagcgagtcctctgtgctcagcgctcacgaatcctgcctgcgcgcccccaacctgatctcttataaacctatgattgaccagctcgagtgcacgacaaatctgatcgatccctttgtcgtgttcgagcggggaagccttcctcaaaccagaaacgacaagacatttgcggcttccaaaggcaaccgcggggttcaggccttcagcaagggatctgtgcaggccgatctgaccctcatgtttgacaatttcgaagtcgactttgtgggcgctgccgtgtcctgtgatgctgccttcctgaacctgaccgggtgctacagctgtaatgcgggagccagagtctgcctttctattacatccacgggcaccggcacactcagcgctcataacaaggacgggtccctgcacatcgttctgccctctgagaatggaaccaaagatcaatgtcagattctccattttacagtgcctgaagtggaggaggagttcatgtacagctgcgacggcgatgaacggcccctgcttgtcaaggggaccctgatcgccatcgacccgtttgatgaccgcagagaagctggaggcgagtccacggtggttaaccctaaaagcgggtcttggaatttcttcgattggttttccggactcatgagctggttcggcggccccctgaagacaatgctgcttatttgtctgtatgtggccctctctatcgggctgtttttcctcctgatttaccttggacggaccggcctgagcaaaatgtggctcgccgctaccaagaaggcgtcctga

SEQ ID NO: 14431 - RNA, 3594 nt, synthetic construct
  misc_feature 1..3594: note = derived and/or modified CDS sequence (opt5) from RVFV(Entebbe)__DQ380191.1__GP
  source 1..3594: mol_type = other RNA
atgtacgccctgctcaccatcctgattagcgtgcttgtctgcgaggctgttatcagagtgtccctgtctagcacacgggaagagacgtgtttcggcgactccaccaaccccgaaatgattgagggggcctgggattctctccgcgaagaggagatgcctgaagaactgagctgctccatctctggaattagagaagtgaagacaagctcccaggagcttcaccgggcgctgaaagctatcatcgccgccgacggcctcaataacattacctgtcatgggaaggatccggaggacaaaatcagcctgattaagggaccccctcacaaaaagcgcgtcggcgtggttagatgcgaacggcgcagagatgctaagcaaatcgggcgggagacaatggccggaattgctatgaccgtgctgcccgccctcgcggtctttgccctggctcctgtggttttcgccgaagacccccatcttcgcaatagacctggcaaaggccacaactatatcgatgggatgacacaggaggacgctacctgtaagccggtgacgtacgccggagcgtgcagctcctttgatgtcctgctcgaaaaaggcaagttccccctgtttcagagctatgcccatcaccggacccttctggaggctgtgcacgacacaattatcgccaaagctgatcctccctcttgtgacctccagtccgcccatgggaatccttgcatgaaggagaagctggtgatgaaaacccactgtcccaacgattaccaaagcgcccattatctgaataacgacggaaagatggcttctgtcaaatgcccgcctaagtacgaactcacagaggactgtaatttctgccgccagatgaccggcgcgtccctgaaaaaggggagctatccccttcaggatctgttttgccagtcctctgaagacgatggaagcaaactcaagacgaagatgaaaggcgtttgtgaggtgggcgtgcaagccctgaagaaatgcgacgggcagctttccacagctcacgaagtcgtgcctttcgccgtttttaagaacagcaaaaaggtgtacctggataagctcgacctgaaaaccgaggagaatctgctccccgattctttcgtctgttttgaacacaagggacagtacaaaggcacaatggactccgggcagatcaagagagagctgaaatctttcgatatttctcaatgccccaagatcggaggccatgggagcaagaaatgtaccggagacgccgctttttgctccgcctatgaatgtaccgcgcagtacgctaacgcctattgctctcacgccaatggcagcggcattgtgcagatccaagtttccggggtgtggaagaaacctctttgtgtcggatacgagcgggtggtcgtgaagcgcgaactgagcgctaaaccgattcagagagttgagccctgcacaacgtgtatcaccaagtgcgagcctcatggcctcgtggtccggtctacagggttcaagatctccagcgccgtggcttgcgcctctggagtttgtgtgaccggctcccagagcccctccacagaaattaccctgaaatatcctgggatctctcagagctccggcggagatattggcgtccacatggcgcatgacgaccaatctgtgagctccaagatcgtggcccactgtcccccgcaggatccttgccttgttcacgggtgcattgtctgtgctcatggactgatcaactaccagtgccacacggccctcagcgctttcgtggtggtctttgtgttctcttccgttgccatcatttgtctggcgatcctgtataaagtgctcaagtgcctgaaaattgcccccagaaaggtccttaatcctctgatgtggatcacagcttttattcgctgggtgtacaaaaagatggttgcccgggtggctgacaacatcaaccaggtcaatagagagattggctggatggaagggggacaactcgtgctgggcaaccccgcccctatcccccgccatgccccgatccctcggtacagcacctatctgatgcttctcctgattgtttcttacgcttccgcgtgtagcgagctgatccaggcctctagcagaattaccacatgctccaccgagggggtgaatacaaagtgtcgcctcagcggcacggctctgatccgggccggatctgtcggcgccgaggcttgccttatgctgaaaggggtgaaggaggatcagaccaaattcctcaagattaaaacagtgtccagcgaactgtcctgcagagagggacagtcttattggaccggcagcttttcccccaagtgtctgtctagccgccggtgccaccttgtcggggaatgtcacgttaacagatgcctctcctggcgcgacaatgagacatctgccgagttcagctttgtgggagaatccaccacgatgcgggagaacaagtgtttcgaacaatgcggcgggtggggctgtggatgctttaatgtgaaccccagctgtctgttcgtccatacctacctgcagtctgtgagaaaagaggcgctccgggtttttaattgcatcgattgggtgcacaagctgacacttgaaatcaccgacttcgatggctccgtcagcacagtggacctgggggcttcttccagccgctttaccaactggggatctgtttccctcagcctggatgccgagggcatttccgggagcaattctttcagcttcatcgagtcccctggaaaaggctatgccattgtggacgaaccgttttctgagatccccagacaggggttcctgggcgaaattcggtgtaacagcgagtcctctgtccttagcgctcatgaatcctgcctcagagcccctaatctgatctcttacaagcccatgatcgatcagctggagtgcacgacaaacctcattgacccttttgtggttttcgagcgcggaagcctgccccaaacccggaatgataaaacatttgcggcttccaagggcaacagaggggtgcaggccttcagcaagggatctgtccaggccgaccttaccctgatgtttgacaacttcgaagtggattttgtgggcgctgccgtctcctgtgacgctgccttcctcaatctgaccgggtgctatagctgtaacgcgggagcccgcgtttgcctgtctatcacatccacgggcaccggcacacttagcgctcacaataaagatgggtccctccatattgtgctgccttctgagaacggaaccaaggaccaatgtcagatcctgcactttacagtgcccgaagtcgaggaggagttcatgtacagctgcgatggcgacgaaagaccgctcctggtgaaagggacccttattgccatcgatccttttgacgatcggcgcgaagctggaggcgagtccacggttgtgaatcccaagagcgggtcttggaacttcttcgactggttttccggactgatgagctggttcggcggccctctcaaaacaatcctgctgatttgtctttacgtcgccctgtctatcgggctctttttcctgctcatttatctgggaagaaccggccttagcaagatgtggctggccgctaccaagaaagcgtcctga

SEQ ID NO: 14432 - RNA, 3594 nt, synthetic construct
  misc_feature 1..3594: note = derived and/or modified CDS sequence (opt5) from RVFV(25010-24)__KM210509.1__GP
  source 1..3594: mol_type = other RNA
atgtacgtgctgctcacaatcctgattagcgtccttgtttgcgaggccgtgatcagagtgtccctgtctagcacacgggaagagacgtgtttcggcgactccaccaaccccgaaatgattgagcgcgcttgggattctctcagagaagaggagatgcctgaagaactgagctgctccatctctgggattcgggaagtcaagacaagctcccaggagctttatcgcgccctgaaagcgatcatcgctgccgacggactcaataacattacctgtcacggcaaggatccggaggacaaaatcagcctgattaaggggccccctcataaaaagagagtgggaatcgttcggtgcgaacgcagacgggatgccaagcaagtgggccgcgagacaatggctgggattgccatgaccgtcctgcccgctctcgccgtgtttgcgctggcccctgttgtgttcgctgaagacccccaccttagaaatcggcctggaaaaggccataactacatcgatggcatgacacaggaggacgccacctgtaagccggtcacgtatgctggggcctgcagctcctttgatgtgctgctcgaaaaaggaaagttccccctgtttcagagctacgcgcaccatcgcacccttctggaggccgtgcacgacacaattatcgctaaagccgatcctccctcttgtgacctccagtccgctcacggcaatccttgcatgaaggagaagctggtcatgaaaacccattgtcccaacgattatcaaagcgcccactacctgaataacgacgggaagatggcctctgttaaatgcccgcctaagtatgaactcacagaggactgtaatttctgcagacagatgaccggagcttccctgaaaaagggcagctacccccttcaggatctgttttgccagtcctctgaagacgatgggagcaaactcaagacgaagatgaaaggagtgtgtgaggtgggcgtccaagcgctgaagaaatgcgacggccagctttccacagcccatgaagtggttcctttcgctgtgtttaagaacagcaaaaaggtctacctggataagctcgacctgaaaaccgaggagaatctgctccccgattctttcgtgtgttttgaacacaaggggcagtataaaggaacaatggactccggccagaccaagcgggagctgaaatctttcgatatctctcaatgccccaagattgggggacacggcagcaagaaatgtaccggggacgccgccttttgctccgcttacgaatgtacagcccagtatgcgaacgcttactgctctcatgccaatggaagcggcatcgttcagattcaagtgtccggcgtctggaagaaacctctttgtgtggggtatgagcgcgtcgtggttaagagagaactgagcgccaaaccgatccagcgggtggagccctgcacgacctgtattacaaagtgcgagcctcacggactcatcgtcagatctaccggcttcaagatctccagcgctgtggcctgcgcttctggggtttgtgtgacaggatcccagagcccctccaccgaaattacgctgaaataccctggcatctctcagagctccgggggcgatattggagtccatatggcccacgacgaccaatctgtgagctccaagatcgtggcgcattgtcccccgcaggatccttgccttgttcacggctgcattgtctgtgcccacgggctgatcaactatcagtgccatacagctctcagcgccttcgtggtggtctttgtgttctcttccgttgctatcatttgtctggccatcctgtacaaagtgctcaagtgcctgaaaattgcgcccaagaaagtccttaatcctctgatgtggatcaccgcctttattcgctgggtgtacaagaagatggttgctcgggtggccgacaacatcaaccaggtcaatagagagattggatggatggaaggcgggcaactcgctctgggaaaccccgcccctatcccccgccacgccccgatccctcggtatagcacctacctgatgcttctcctgattgtgtcttatgcttccgcgtgtagcgagctgatccaggcctctagcagaattacaacctgctccacagagggcgttaatacgaaatgtcgcctcagcgggaccgctctgatccgggccggctctgtgggagccgaggcttgccttatgctgaagggcgtcaaagatgaccagacaaagttcctcaaaattaagaccgtgtccagcgagctgtcctgcagagaagggcagtcttactggacaggcagcttttcccccaagtgtctgtctagccgccggtgccatcttgtgggagagtgtcacgtcaacagatgcctctcctggcgcgataatgaaacctctgccgagttcagctttgttggggagtccacgaccatgcgggaaaacaaatgtttcgagcaatgcggaggctgggggtgtggctgctttaatgtgaaccccagctgtctgttcgtgcacacatatctgcagtctgtcagaaaggaagcgctccgggtgtttaattgcatcgactgggttcataaactgacccttgagatcacagatttcgacggatccgtgagcaccattgatctgggcgcttcttccagccgctttacgaactgggggtctgtctccctcagcctggacgccgaaggaatctccggcagcaattctttcagcttcattgagtcccctgggaagggatacgccatcgtggatgagccgttttctgaaattcccagacagggcttcctgggggagatccggtgtaacagcgaatcctctgttcttagcgctcacgagtcctgcctcagagcccctaatctgatctcttataaacccatgattgaccagctggaatgcacaaccaacctcatcgatccttttgtggtcttcgagcgcggcagcctgccccaaacacggaatgacaagacctttgcggcttccaagggaaacagaggcgtgcaggccttcagcaaagggtctgttcaggccgaccttaccctgatgtttgataacttcgaggtggactttgtcggagctgccgtgtcctgtgatgctgccttcctcaatctgacaggctgctacagctgtaacgcgggggcccgcgtgtgcctgtctattacgtccaccggaacaggcacccttagcgctcataataaggacggctccctccacatcgtcctgccttctgaaaacgggacaaaagatcaatgtcagattctgcattttaccgttcccgaggtggaagaggagttcatgtacagctgcgacggagatgaaagaccgctcctggtgaagggcacgcttatcgccatcgacccttttgatgaccggcgcgaggctgggggagaatccacagtcgtgaatcccaaaagcggctcttggaacttcttcgattggttttccgggctgatgagctggttcggaggccctctcaagaccattctgctgatctgtctttatgttgccctgtctattggcctctttttcctgctcatctacctggggagaaccggacttagcaagatgtggctggccgctaccaaaaaggcgtcctga

SEQ ID NO: 14433 - RNA, 3594 nt, synthetic construct
  misc_feature 1..3594: note = derived and/or modified CDS sequence (opt5) from RVFV(Kenya 9800523)__DQ380196.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaggaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacacaaagcaaatcgggcgggagaccatggccggaattgctatgacagtcctgcccgccctcgctgtgtttgccctggcgcctgttgtgttcgccgaagatccccaccttcgcaacagacctggcaaaggccataattacatcgacgggatgacccaggaggatgctacgtgtaagccggtcacctatgccggagcttgttcttcctttgacgtgctgctcgaaaaaggcaagttccccctgtttcagagctacgcccaccatcggacacttctggaggcggtgcacgataccattatcgccaaagctgaccctccctcttgcgatctccagtccgcccacgggaacccttgcatgaaggagaagctggtcatgaaaacacattgtcccaatgactatcaaagcgctcactacctgaacaatgatggaaagatggcctctgttaaatgcccgcctaagtatgaactcaccgaggactgtaacttctgccgccagatgacgggcgcctccctgaaaaaggggagctacccccttcaggacctgttttgccagtcctctgaagatgacggaagcaaactcaagacaaagatgaaaggcgtgtgtgaggtgggcgtccaagctctgaagaaatgcgatgggcagctttccaccgcgcatgaagtggttcctttcgccgtgtttaagaatagcaaaaaggtctacctggacaagctcgatctgaaaacagaggagaacctgctccccgactctttcgtgtgttttgaacacaagggacagtataaaggcaccatggattccgggcagaccaagagagagctgaaatctttcgacatctctcaatgccccaagattggaggccacgggagcaagaaatgtacaggagatgctgccttttgctccgcctacgaatgtacggctcagtatgccaatgcgttctgctctcatgctaacggcagcggcatcgttcagattcaagtgtccggggtctggaagaaacctctttgtgtgggatacgagcgggtcgtggttaagcgcgaactgagcgccaaaccgatccagagagtggagccctgcaccacatgtattaccaagtgcgagcctcacggcctcgtcgtgcggtctacagggttcaagatctccagcgccgttgcttgcgcctctggagtgtgtgtcaccggctcccagagcccctccacggaaatcacactgaaatatcctgggatttctcagagctccggcggagacatcggcgtgcatatggctcacgatgaccaatctgtgagctccaagattgttgcccattgtcccccgcaggacccttgccttgtccacgggtgcatcgtgtgtgcgcacggactgattaattaccagtgccataccgccctcagcgcttttgtggtcgtgttcgtttttagctccatcgccatcatttgtctggctatcctgtatagagtgctcaaatgcctgaagattgcgccccgcaaagtccttaaccctctgatgtggatcaccgccttcattcggtgggtgtacaagaaaatggttgccagagtggctgataacatcaatcaggtcaaccgcgagattggctggatggaagggggacaactcgtgctgggcaatcccgcccctatcccccggcacgctccgatccctagatacagcacatatctgatgcttctcctgattgtttcttacgcctccgcctgtagcgagctgatccaggcttctagccgcattaccacatgctccacggagggggtgaacaccaagtgtcggctcagcggcacagcgctgatcagagccggatctgtcggcgctgaagcctgccttatgctgaagggggtgaaagaggaccagaccaagtttctcaaaattaagacagtgtccagcgaactgtcctgccgcgagggacagtcttattggaccggcagcttctcccccaaatgtctgtctagccggagatgccatcttgtcggggaatgtcacgttaatcgctgcctctcctggcgggataacgagacgtctgccgagtttagcttcgtgggagaatccaccacaatgagagagaataagtgttttgaacaatgcggcgggtggggctgtggatgcttcaacgtgaatcccagctgtctgtttgtccacacctacctgcagtctgtgcggaaggaggctctccgcgttttcaactgcatcgactgggtgcataaactgacacttgaaatcaccgattttgacggctccgtcagcacgattgatctgggggcctcttccagcagattcacaaattggggatctgtgtccctcagcctggacgcggagggcatctccgggagcaactctttcagctttattgagtcccctggaaagggctatgctatcgttgatgaaccgttctctgagattccccggcaggggtttctgggcgaaatcagatgtaatagcgagtcctctgtgcttaacgcccacgaaagctgcctccgcgcccctaatctgatctcctacaaacccatgattgaccagctggagtgcaccacaaacctcatcgatcctttcgtcgtgtttgagcggggatctctgccccaaaccagaaacgacaagaccttcgctgccagcaaaggcaatcgcggggttcaggcgttttccaagggaagcgtgcaggctgatcttacactgatgttcgacaactttgaagtcgacttcgtgggcgccgccgtgtcttgtgatgctgcctttctcaatctgacggggtgctattcctgtaacgctggagccagagtctgcctgagcattacctctacaggcaccggcacactttccgcgcataataaggaggggagcctccacatcgttctgccttccgaaaacggaaccaaagaccaatgtcagattctgcatttcacggtgcccgaggtggaggaagagtttatgtactcttgcgatggcgacgaacggccgctcctggtcaaggggacacttatcgccatcgatcctttcgacgatcgcagagaggctggaggcgaaagcaccgtggttaatcccaaatccgggagctggaacttctttgactggttctctggactgatgtcctggtttggcggccctctcaagaccattctgctgatctgtctttacgtggccctgagcattggactcttctttctgctcatctatctggggcggacaggcctttctaaaatgtggctggctgccaccaagaaggccagctga

SEQ ID NO: 14434 - RNA, 3594 nt, synthetic construct
  misc_feature 1..3594: note = derived and/or modified CDS sequence (opt5) from RVFV(ANK-6087)__DQ380216.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaggaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgttcttcctttgatgtcctgctcgaaaaaggcaagttccccctgtttcagagctacgcgcaccatcggacccttctggaggccgtgcacgacacaatcatcgctaaagccgatcctccctcttgcgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccatgaagtcgtgcctttcgctgtttttaagaacagcaaaaaggtgtacctggataagctcgacctgaaaaccgaggagaatctgctccccgattctttcgtctgttttgaacacaagggacagtataaaggcaagctggactccgggcagacaaaaagagagcttaagagcttcgatatttctcaatgccccaagatcggaggccacgggagcaaaaagtgtaccggagacgccgccttttgctccgcttacgaatgtaccgcccagtatgcgaacgcttactgctctcatgccaatggcagcggcattgtgcagatccaagtttccggggtgtggaaaaagcctctgtgtgtcggatatgagcgggtggtcgtgaaacgcgaactcagcgccaagccgattcagagagttgagccctgcacaacgtgtatcaccaagtgcgagcctcacggcctggtggtccggtctacagggttcaaaatctccagcgctgtggcctgcgcttctggagtttgtgtgaccggctcccagagcccctccacagaaattacccttaagtaccctgggatctctcagagctccggcggagatattggcgtccatatggcccacgacgaccaatctgtgagctccaaaatcgtggcgcattgtcccccgcaggatccttgcctggttcacgggtgcattgtctgtgcccacggactcatcaactatcagtgccatacggctctgagcgccttcgtggtggtctttgtgttctcttccatcgctattatctgtctggccattctctacagagttctgaagtgccttaaaatcgcgccccgcaaggtgctgaatcctctcatgtggattacagcctttatccggtgggtctacagaaaaatggtggctcgcgttgccgacaacattaaccaggtgaatcgggagatcggctggatggaagggggacaactggtcctgggcaaccccgctcctatccccagacacgtgccgattcctcgctatagcacctaccttatgctcctgctgatcgtttcttatgcctccgcctgtagcgagctcattcaggcttctagccggatcaccacatgctccaccgagggggtgaatacaaagtgtagactgagcggcacggcgcttattcgcgccggatctgtcggcgctgaagcctgcctgatgctcaagggggtgaaagaggatcagaccaagttcctgaaaatcaagacagtgtccagcgaactgtcctgccgggagggacagtcttactggaccggcagcttttcccccaaatgtctttctagcagacgctgccatctcgtcggggaatgtcacgttaaccggtgcctgtcctggagagacaatgagacatctgccgagttcagctttgtgggagaatccaccacgatgcgggagaacaagtgtttcgaacaatgcggcgggtggggctgtggatgctttaatgtgaaccccagctgtctgttcgtccacacctatctccagtctgtgcgcaaggaggctctgagagtttttaattgcatcgattgggtgcataaacttacactggaaattaccgacttcgatggctccgtcagcacaatcgacctcggggcctcttccagccggtttaccaactggggatctgtgtccctgagcctggatgcggagggcatttccgggagcaattctttcagcttcatcgagtcccctggaaagggctacgctattgttgacgaaccgttttctgagatccccagacaggggttccttggcgaaatccgctgtaacagcgagtcctctgtgctcagcgcccacgaatcctgcctgcgggcccctaatctgatttcttataaacccatgatcgatcagctcgagtgcagcacgaacctgattgacccttttgtcgtgttcaagagaggatcccttccccaaacacgcaatgataaaacctttgctgccagcaagggcaacagaggggttcaggcgttctctaagggatccgtgcaggctgacctgacactcatgtttgacaacttcgaggtcgattttgtgggcgccgccgtgagctgtgacgctgccttcctgaatctgaccgggtgctactcttgtaacgctggagcccgggtctgcctttccatcaccagcacaggcacgggcaccctctccgcgcataataaagatgggtctctgcacattgttctgcctagcgaaaacggaacaaaggaccaatgtcagatcctccattttaccgtgcccgaggtggaagaggagttcatgtactcctgcgatggcgacgaacgcccgctgcttgtcagagggacactgatcgccattgatccttttgacgatcggcgcgaggctggaggcgaaagcaccgtggttaatcccaaatctgggtcctggaacttcttcgactggtttagcggactcatgtcttggttcggcggccctctgaagacgatcctgcttatttgtctgtatgtggccctcagcatcgggctgtttttcctcctgatttaccttggaagaacaggcctgtccaaaatgtggctcgctgccaccaagaaggcctcttga

SEQ ID NO: 14435 - RNA, 3594 nt, synthetic construct
  misc_feature 1..3594: note = derived and/or modified CDS sequence (opt5) from RVFV(SAUDI 200010901)__KU978778.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaggaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgggcggcgcagagacacaaagcaaatcggacgggaaaccatggccggcattgctatgacagtcctgcccgccctcgctgtgtttgccctggcgcctgttgtgttcgccgaggatccccaccttcgcaacagacctggcaaagggcataattacatcgacggaatgacccaggaagatgctacgtgtaagccggtcacctatgccggcgcttgttcttcctttgacgtgctgctcgagaaagggaagttccccctgtttcagagctacgcccaccatcggacacttctggaagcggtgcacgataccattatcgccaaagctgaccctccctcttgcgatctccagtccgcccacggaaacccttgcatgaaggagaagctggtcatgaaaacacattgtcccaatgactatcaaagcgctcactacctgaacaatgatggcaagatggcctctgttaaatgcccgcctaagtatgagctcaccgaagactgtaacttctgccgccagatgacgggggcctccctgaaaaagggaagctacccccttcaggacctgttttgccagtcctctgaggatgacggcagcaaactcaagacaaagatgaaaggcgtgtgtgaagtgggggtccaagctctgaagaaatgcgatggacagctttccaccgcgcatgaggtggttcctttcgccgtgtttaagaatagcaaaaaggtctacctggacaagctcgatctgaaaacagaagagaacctgctccccgactctttcgtgtgttttgagcacaagggccagtataaagggaccatggattccggacagaccaagagagaactgaaatctttcgacatctctcaatgccccaagattggcgggcacggaagcaagaaatgtacaggcgatgctgccttttgctccgcctacgagtgtacggctcagtatgccaatgcgttctgctctcatgctaacggcagcgggatcgttcagattcaagtgtccggagtctggaagaaacctctttgtgtgggctacgaacgggtcgtggttaagcgcgagctgagcgccaaaccgatccagagagtggaaccctgcaccacatgtattaccaagtgcgagcctcacgggctcgtcgtgcggtctacaggattcaagatctccagcgccgttgcttgcgcctctggcgtgtgtgtcaccgggtcccagagcccctccacggagatcacactgaaatatcctggcatttctcagagctccggaggcgacatcggggtgcatatggctcacgatgaccaatctgtgagctccaagattgttgcccattgtcccccgcaggacccttgccttgtccacggatgcatcgtgtgtgcgcacggcctgattaattaccagtgccataccgccctcagcgcttttgtggtcgtgttcgtttttagctccatcgccatcatttgtctggctatcctgtatagagtgctcaaatgcctgaagattgcgccccgcaaagtccttaaccctctgatgtggatcaccgccttcattcggtgggtgtacaagaaaatggttgccagagtggctgataacatcaatcaggtcaaccgcgaaattgggtggatggagggaggccaactcgtgctggggaatcccgcccctatcccccggcacgctccgatccctagatacagcacatatctgatgcttctcctgattatctcttacgcctccgcctgtagcgaactgattcaggcttctagccgcatcaccacatgctccacggagggcgttaacaccaagtgtcggctcagcggaacagcgctgattagagccggctctgtgggggctgaggcctgccttatgctgaagggagtcaaagaagaccagaccaagtttctcaaaatcaagacagtgtccagcgagctgtcctgccgcgaaggccagtcttattggaccgggagcttctcccccaaatgtctgtctagccggagatgccatcttgtgggagagtgtcacgtcaatcgctgcctctcctggcgggataacgaaacgtctgccgagtttagcttcgttggcgagtccaccacaatgagagaaaataagtgttttgagcaatgcgggggctggggatgtggctgcttcaacgtgaatcccagctgtctgtttgtgcacacctacctgcagtctgtccggaaggaagctctccgcgtgttcaactgcatcgactgggttcataaactgacacttgagattaccgattttgacgggtccgtgagcacgatcgatctgggagcctcttccagcagattcacaaattggggctctgtctccctcagcctggacgcggaagggatttccggaagcaactctttcagctttatcgagtcccctggcaaggggtatgctattgtggatgagccgttctctgaaatcccccggcagggctttctgggagagatcagatgtaatagcgaatcctctgttcttagcgcccacgagtcctgcctccgcgcccctaacctgatttcttacaaacccatgatcgaccagctggaatgcaccacaaatctcattgatcctttcgtggtctttgagcggggcagcctgccccaaaccagaaacgagaagaccttcgctgcctccaaagggaaccgcggagtgcaggcgtttagcaagggctctgttcaggctgaccttacactgatgttcgataattttgaagtggacttcgtcggggccgccgtgtcctgtgacgctgcctttctcaacctgacgggatgctatagctgtaatgctggcgccagagtgtgcctgtctatcacctccacaggcaccgggacacttagcgcgcataacaaggatggatccctccacattgtcctgccttctgagaatggcaccaaagaccaatgtcagatcctgcatttcacggttcccgaagtggaggaggaatttatgtacagctgcgatggggacgagcggccgctcctggtgaagggaacacttatcgccattgatcctttcgacgatcgcagagaagctggcggggagtccaccgtcgtgaaccccaaaagcggatcttggaatttctttgactggttctccggcctgatgagctggtttggcgggcctctcaagaccatcctgctgatttgtctttacgttgccctgtctatcggactcttctttctgctcatttatctgggccggacagggcttagcaaaatgtggctggctgccaccaagaaggcctcctga

SEQ ID NO: 14436 - RNA, 3594 nt, synthetic construct
  misc_feature 1..3594: note = derived and/or modified CDS sequence (opt5) from RVFV(35/74)__JF784387.1__GP
  source 1..3594: mol_type = other RNA
atgtacgtgctgctcaccatcctgattacagtccttgtttgcgaggccgtgatcagagtgagcctgtcctctacgcgggaagagacctgtttcggcgactatacaaaccccgaaatgattgagggggcttgggatagcctccgcgaagaggagatgcctgaagaactgtcctgctctatcagcggaattagagaagtcaaaacctcctctcaggagctttaccgggccctgaaagcgatcatcgctgccgacggcctcaataacattacatgtcacgggaaggatccggaggacaaaatcagcctggtgaagggaccccctcataaaaagcgcgttggcattgtgagatgcgaacggcgcagagatgccaagcaaatcgggcgggagaccatggctggaattgccatgacagtcctgcccgctctcgccgtgtttgcgctggcccctgttgtgttcgctgaagacccccaccttcgcaatagacctggcaaaggccataactatatcgatgggatgacccaggaggacgccacgtgtaagccggtcacctacgctggagcctgctccagctttgatgtgctgctcgaaaaaggcaagttccccctgtttcagtcttatgcgcaccatcggacacttctggaggccgtgcacgacaccattatcgctaaagccgatcctccctcctgtgacctccagagcgctcacgggaatccttgcatgaaggagaagctggtcatgaaaacacattgtcccaacgattaccaatctgcccactatctgaataacgacggaaagatggcctccgttaaatgcccgcctaagtacgaactcaccgaggactgtaatttctgccgccagatgacgggcgctagcctgaaaaaggggtcttacccccttcaggatctgttttgccagtccagcgaagacgatggatccaaactcaagacaaagatgaaaggcgtgtgtgaggtgggcgtccaagcgctgaagaaatgcgacgggcagctttctaccgcccatgaagtggttcctttcgctgtgtttaagaacagcaaaaaggtctatctggataagctcgacctgaaaacagaggagaatctgctccccgattccttcgtgtgttttgaacacaagggacagtacaaaggcaccatggacagcgggcagaccaagagagagctgaaatctttcgatatctcccaatgccccaagattggaggccacgggagcaagaaatgtacaggagacgccgccttttgctctgcttatgaatgtacggcccagtacgcgaacgcttattgcagccatgccaatggctccggcgttgtgcagatccaagtctctggggtgtggaagaaacctctttgtgtcggatacgagcgggtggttgtgaagcgcgaactgagcgccaaaccgattcagagagtcgagccctgcaccacatgtatcaccaagtgcgagcctcacggcctcgtggttcggtccacagggttcaagattagctctgctgtggcctgcgcttccggagtctgtgtgaccggcagccagtctccctccacggaaatcacactgaaatatcctgggatcagccagtcctctggcggagatattggcgtgcatatggcccacgacgaccaaagcgtttcctctaagatcgtcgcgcattgtcccccgcaggatccttgccttgtgcacgggtgcattgtgtgtgcccacggactgatcaactaccagtgccataccgctctcagcgccttcgtcgtggtttttgtgttctccagcgtcgctattatctgtctggccatcctgtacaaagtgctcaagtgcctgaaaattgcgcccagaaaggttcttgaccctctgatgtggatcaccgtgtttattcgctgggtctataaaaagatggtggcccgggttgctgataatatcaaccaggtgaacagagagattggctggatggaagggggacaactcgccctgggcaatcccgctcctatcccccgccacgccccgattcctcggtactctacatatctgatgcttctcctgatcgtctcctacgccagcgcttgttctgagctgatccaggcgtccagcagaattaccacatgctctacggagggggtgaacaccaagtgtcgcctcagcggcacagccctgatccgggctggatccgtgggcgccgaagcctgccttatgctgaaaggggtcaaggaggaccagaccaaattcctcaagattaaaacagttagctctgaactgtcctgcagagagggacagagctattggaccggctccttttctcccaagtgtctgagctcccgccggtgccatcttgtgggggaatgtcacgtgaatagatgcctctcttggcgcgataacgagacgagcgctgagttctcctttgtcggagaatctaccacaatgcgggagaataagtgtttcgaacaatgcggcgggtggggctgtggatgctttaacgtgaatcccagctgtctgttcgttcacacctacctgcagtccgtgagaaaagaggccctccgggtctttaactgcatcgactgggtgcataagctgacacttgaaattaccgatttcgacggcagcgtttctacgatcgatctgggggcgtccagctctcgctttacaaattggggatccgtgagcctctctctggacgctgagggcatctccgggagcaactccttcagcttcattgagtctcctggaaaaggctatgccatcgtcgatgaaccgtttagcgagattcccagacaggggttcctgggcgaaatccggtgtaattccgagtctagcgtgctttccgcccacgaatcttgcctcagagctcctaacctgattagctacaagcccatgatcgaccagctggagtgcaccacaaatctcatcgatccttttgttgtgttcgagcgcggatccctgccccaaacccggaacgacaaaacctttgccgcgtctaagggcaatagaggggtccaggctttcagcaagggatccgtgcaggccgaccttacactgatgtttgataacttcgaagtggactttgtcggcgccgctgttagctgtgatgccgctttcctcaacctgacggggtgctactcttgtaatgccggagcgcgcgtgtgcctgtccattaccagcacaggcaccggcacactttctgcccataacaaagacgggtccctccacatcgtgctgcctagcgagaatggaaccaaggatcaatgtcagattctgcattttacggtccccgaagtggaggaggagttcatgtattcctgcgacggcgatgagagaccgctcctggttaaagggacacttatcgctattgacccttttgatgaccggcgcgaagccggaggcgagtctaccgtggtcaaccccaagagcgggtcctggaatttcttcgattggtttagcggactgatgtcttggttcggcggccctctcaaaaccatcctgctgatctgtctttacgtggctctgtccattgggctctttttcctgctcatctatctgggaagaacaggccttagcaagatgtggctggccgccaccaagaaggcttcttga

SEQ ID NO: 14437 - RNA, 3594 nt, synthetic construct
  misc_feature 1..3594: note = derived and/or modified CDS sequence (opt5) from RVFV(KEN/Kil-006/07)__HM586966.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcgtggtcagatgcgaacggcgcagagacgccaagcaaattgggcgggagacaatggctggaatcgccatgaccgtgctgcccgctctcgccgtttttgcgctggcccctgtggtcttcgctgaagatccccaccttcgcaacagacctggcaaaggccataattacattgacgggatgacacaggaggatgccacctgtaagccggtgacgtatgctggagcctgcagctcctttgacgtgctgctcgaaaaaggcaagttccccctgtttcagagctacgcgcaccatcggacccttctggaggccgtccacgatacaatcattgctaaagccgaccctccctcttgtgatctccagtccgctgacgggaacaagtgcatgaaggagaaactggttatgaagacccactgtcctaatgattatcaaagcgcccattacctgaacaatgacggaaaaatggcctctgtgaagtgtcccccgaaatatgaactcacagaggactgcaacttctgccgccagatgaccggcgcttccctgaagaaagggagctaccctcttcaggatctgttttgccagtcctctgaagacgatggaagcaagctcaagacgaaaatgaagggcgtgtgtgaggtcggcgtgcaagcgctgaaaaagtgcgacgggcagctttccacagcccacgaagttgtgcccttcgctgtctttaaaaatagcaagaaggtgtacctggataaactcgacctgaagaccgaggagaacctgctccctgattctttcgtttgttttgaacataaaggacagtataagggcacaatggactccgggcagaccaaaagagagctgaagtctttcgatatctctcaatgccccaagatcggaggccacgggagcaaaaagtgtaccggagacgccgccttttgctccgcttacgaatgtacagcccagtatgcgaatgcttactgctctcacgccaacggcagcggcattgtgcagatccaagtctccggggtgtggaaaaagcccctttgtgtcggatatgagcgggtggttgtgaaacgcgaactgagcgccaagcctattcagagagtcgagccgtgcacgacctgtatcacaaagtgcgagccccatggcctcgtggttcggtctaccgggttcaaaatttccagcgctgtggcctgcgcttctggagtctgtgtgacaggctcccagagcccttccaccgaaatcacgctgaagtaccccgggatctctcagagctccggcggagatattggcgtgcacatggcccatgacgaccaatctgttagctccaaaatcgtcgcgcactgccctccccaggatccgtgtcttgtgcatgggtgcattgtgtgtgcccacggactgatcaattatcagtgccacacagctctcagcgccttcgtcgtgatttttgttttctcttccaccgctatcatctgtctggccgtgctgtacagagtcctcaagtgcctgaaaattgcgcctcgcaaggtgcttaaccccctgatgtggatcaccgcctttattcggtgggtttacaaaaagatggtggctagagtcgccgacaacatcaatcaggtgaaccgcgagattggctggatggaagggggacaactcgctctgggcaatcctgcccccatccctcggcatgcccccattccgagatatagcacatacctgatgcttctcctgatcgtttcttatgcttccgcgtgtagcgagctgatccaggcctctagccgcattaccacatgctccacggagggggtgaacaccaagtgtcggctcagcggcacagctctgatcagagccggatctgtcggcgccgaggcttgccttatgctgaaaggggtgaaggaggatcagaccaaattcctcaagattaaaacagtgtccagcgaactgtcctgccgcgagggacagtcttactggaccggcagcttttcccctaagtgtctgtctagccggagatgccaccttgtcggggaatgtcatgttaatcgctgcctctcctggcgggacaacgagacgtctgccgagttcagctttgtgggagaatccaccacaatgagagagaataagtgtttcgaacaatgcggcgggtggggctgtggatgctttaacgtgaatcccagctgtctgttcgtccacacctatctgcagtctgtgcggaaagaggcgctccgcgtttttaactgcatcgattgggtgcacaagctgacacttgaaattaccgacttcgatggctccgtcagcacgatcgacctgggggcttcttccagcagatttacaaattggggatctgtgtccctcagcctggatgccgagggcatctccgggagcaactctttcagcttcattgagtcccccggaaaaggctacgccatcgttgacgaacctttttctgagattccgcggcaggggttcctgggcgaaatcagatgtaatagcgagtcctctgtgcttagcgctcatgaatcctgcctccgcgcccccaacctggtctcttataagcctatgattgatcagctggagtgcaccacaaatctcatcgacccctttgtggttttcgagcggggaagcctgcctcaaaccagaaacgataaaacctttgcggcttccaagggcaaccgcggggtgcaggccttcagcaagggatctgtccaggccgaccttacactgatgtttgacaatttcgaagtggattttgtgggcgctgccgtctcctgtgacgctgccttcctcaacctgacggggtgctacagctgtaatgcgggagccagagtttgcctgtctatcacctccacaggcaccggcacacttagcgctcacaacaaagatgggtccctccatattgtgctgccctctgagaatggaaccaaggaccaatgtcagatcctgcactttacggtgcctgaagtcgaggaggagttcatgtacagctgcgatggcgacgaacggcccctcctggtgaaagggacacttattgccatcgatccgtttgacgatcgcagagaagctggaggcgagtccaccgttgtgaaccctaagagcgggtcttggaatttcttcgactggttttccggactgatgagctggttcggcggccccctcaaaaccattctgctgatctgtctttatgtcgccctgtctatcgggctctttttcctgctcatttacctgggacggacaggccttagcaagatgtggctggccgctaccaagaaagcgtcctga

SEQ ID NO: 14438 - RNA, 3594 nt, synthetic construct
  misc_feature 1..3594: note = derived and/or modified CDS sequence (opt5) from RVFV(MgH824)__DQ380210.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggctacaactatattgatgggatgacacaggaggacgccacctgtaagccggtgacgtacgctggagcctgcagctcctttgatgtcctgctcgaaaaaggcaagttccccctgtttcagagctatgcgcatcaccggacccttctggaggccgtgcatgacacaatcatcgctaaagccgatcctccctcttgtgacctccagtccgctcacgggaatccttgcatgaaggagaagctggtgatgaaaacccactgtcccaacgattaccaaagcgcccattatctgaataacgacggaaagatggcctctgtcaaatgcccgcctaagtacgaactcacagaggactgtaatttctgccgccagatgaccggcgcttccctgaaaaaggggagctacccccttcaggatctgttttgccagtcctctgaagacgatggaagcaaactcaagacgaagatgaaaggcgtttgtgaggtgggcgtgcaagcgctgaagaaatgcgacgggcagctttccacagcccacgaagtcgtgcctttcgctgtttttaagaacagcaaaaaggtgtatctggataagctcgacctgaaaaccgaggagaatctgctccccgattctttcgtctgttttgaaagaaagggacagtacaaaggcacaatggactccgggcagaccaagcgggagctgaaatctttcgatatttctcaatgccccaagatcggaggccatgggagcaagaaatgtaccggagacgccgccttttgctccgcttatgaatgtacaacgcagtacgccaacgcgtattgctctcacgctaatggcagcggcgtggttcagattcaagtgtccggggtctggaagaaacctctttgtgtgggatacgagcgcgtcgtggttaagagagaactgagcgccaaaccgatccagcgggtggagccctgcaccacatgtattaccaagtgcgagcctcacggcctcgtcgtgagatctacagggttcaagatctccagcgccgttgcttgcgcctctggagtgtgtgtcaccggctcccagagcccctccacggaaatcacactgaaatatcctgggatttctcagagctccggcggagatatcggcgtgcatatggctcacgacgaccaatctgtgagctccaagattgttgcccattgtcccccgcaggatccttgccttgtccacgggtgcatcgtgtgtgcgcatggactgattaactaccagtgccacaccgccctcagcgctttcgtggtcgtgtttgttttctcttccatcgccatcatttgtctggctatcctgtaccgcgtgctcaaatgcctgaagattgcgccccggaaagtccttaatcctctgatgtggatcaccgcctttattagatggatctataagaaaatggtggcccgcgttgctgacaacattaaccaggtgaatcgggagatcggctggatggaagggggacaactcgtcctgggcaaccccgcccctatccccagacacgctccgattcctcgctacagcacatatctgatgcttctcctgatcgtgtcttacgcctccgcctgtagcgagctgattcaggcttctagccggatcaccacatgctccacggagggggttgataccaagtgtagactcagcggcacagcgctgattcgcgccggatctgtgggcgctgaagcctgccttatgctgaagggggtcaaagaggaccagaccaagttcctcaaaatcaagacagtgtccagcgaactgtcctgccgggagggacagtcttattggaccggcagcttttcccccaaatgtctgtctagcagacgctgccatcttgtgggggaatgtcacgtcaatcggtgcctctcctggagagataacgagacgtctgccgagttcagctttgttggagaatccaccacaatgcgggagaataagtgtttcgaacaatgcggcgggtggggctgtggatgctttaacgtgaatcccagctgtctgttcgtgcatacctacctgcagtctgtccgcaaggaggctctcagagtgtttaactgcatcgactgggttcacaaactgacacttgaaattaccgatttcgacggctccgtgagcacgatcgatctgggggcctcttccagccggtttacaaattggggatctgtctccctcagcctggacgcggagggcatttccgggagcaactctttcagcttcatcgagtcccctggaaagggctatgctattgtggatgaaccgtttcccgagatccctagacaggggttcctgggcgaaatccgctgtaattctgagagctccgttctttctgcccacgaaagctgcctccgggcccccaacctgatttcctacaaacctatgatcgaccagctggagtgcaccacaaatctcattgatccctttgtggtcttcgagagaggatctctgcctcaaacccgcaacgacaagacctttgctgccagcaaaggcaatagaggggtgcaggcgttctccaagggaagcgttcaggctgaccttacactgatgtttgataacttcgaagtggactttgtcggcgccgccgtgtcttgtgatgctgccttcctcaacctgacggggtgctactcctgtaatgctggagcccgggtgtgcctgagcatcacctctacaggcaccggctcccttagcgcgcataacaaggacgggtccctccacattgtcctgccctctgagaatggaacaaaagatcaatgtcagatcctgcattttaccgttccggaagtggaggaggagttcatgtatagctgcgacggcgatgagcgccctctcctggtgaaggggacgcttatcgccattgacccctttgatgacagacgggaagctggaggcgagtccacagtcgtgaaccctaaaagcgggtcttggaatttcttcgattggttttccggactgatgagctggttcggcggccccctcaagaccatcctgctgatttgtctttacgttgccctgtctatcgggctctttttcctgctcatttatctgggacgcaccggccttagcaaaatgtggctggctgccacaaagaaggcctcctga

SEQ ID NO: 14439 - RNA, 3594 nt, synthetic construct
  misc_feature 1..3594: note = derived and/or modified CDS sequence (opt5) from RVFV(Kenya 57 (Rintoul))__DQ380192.1__GP
  source 1..3594: mol_type = other RNA
atgtacgccctgctcaccatcctgattagcgtgcttgtctgcgaggctgttatcagagtgtccctgtctagcacacgggaagagacgtgtttcggcgactccaccaaccccgaaatgattgagggggcctgggattctctccgcgaagaggagatgcctgaagaactgagctgctccatctctggaattagagaagtgaagacaagctcccaggagcttcaccgggcgctgaaagctatcatcgccgccgacggcctcaataacattacctgtcatgggaaggatccggaggacaaaatcagcctgattaagggaccccctcacaaaaagcgcgtcggcgtggttagatgcgaacggcgcagagatgctaagcaaatcgggcgggagacaatggccggaattgctatgaccgtgctgcccgccctcgcggtctttgccctggctcctgtggttttcgccgaagacccccatcttcgcaatagacctggcaaaggccacaactatatcgatgggatgacacaggaggacgctacctgtaagccggtgacgtacgccggagcgtgcagctcctttgatgtcctgctcgaaaaaggcaagttccccctgtttcagagctatgcccatcaccggacccttctggaggctgtgcacgacacaattatcgccaaagctgatcctccctcttgtgacctccagtccgcccatgggaatccttgcatgaaggagaagctggtgatgaaaacccactgtcccaacgattaccaaagcgcccattatctgaataacgacggaaagatggcttctgtcaaatgcccgcctaagtacgaactcacagaggactgtaatttctgccgccagatgaccggcgcgtccctgaaaaaggggagctatccccttcaggatctgttttgccagtcctctgaagacgatggaagcaaactcaagacgaagatgaaaggcgtttgtgaggtgggcgtgcaagccctgaagaaatgcgacgggcagctttccacagctcacgaagtcgtgcctttcgccgtttttaagaacagcaaaaaggtgtacctggataagctcgacctgaaaaccgaggagaatctgctccccgattctttcgtctgttttgaacacaagggacagtacaaaggcacaatggactccgggcagatcaagagagagctgaaatctttcgatatttctcaatgccccaagatcggaggccatgggagcaagaaatgtaccggagacgccgctttttgctccgcctatgaatgtaccgcgcagtacgctaacgcctattgctctcacgccaatggcagcggcattgtgcagatccaagtttccggggtgtggaagaaacctctttgtgtcggatacgagcgggtggtcgtgaagcgcgaactgagcgctaaaccgattcagagagttgagccctgcacaacgtgtatcaccaagtgcgagcctcatggcctcgtggtccggtctacagggttcaagatctccagcgccgtggcttgcgcctctggagtttgtgtgaccggctcccagagcccctccacagaaattaccctgaaatatcctgggatctctcagagctccggcggagatattggcgtccacatggcgcatgacgaccaatctgtgagctccaagatcgtggcccactgtcccccgcaggatccttgccttgttcacgggtgcattgtctgtgctcatggactgatcaactaccagtgccacacggccctcagcgctttcgtggtggtctttgtgttctcttccgttgccatcatttgtctggcgatcctgtataaagtgctcaagtgcctgaaaattgcccccagaaaggtccttaatcctctgatgtggatcacagcttttattcgctgggtgtacaaaaagatggttgcccgggtggctgacaacatcaaccaggtcaatagagagattggctggatggaagggggacaactcgtgctgggcaaccccgcccctatcccccgccatgccccgatccctcggtacagcacctatctgatgcttctcctgattgtttcttacgcttccgcgtgtagcgagctgatccaggcctctagcagaattaccacatgctccaccgagggggtgaatacaaagtgtcgcctcagcggcacggctctgatccgggccggatctgtcggcgccgaggcttgccttatgctgaaaggggtgaaggaggatcagaccaaattcctcaagattaaaacagtgtccagcgaactgtcctgcagagagggacagtcttattggaccggcagcttttcccccaagtgtctgtctagccgccggtgccaccttgtcggggaatgtcacgttaacagatgcctctcctggcgcgacaatgagacatctgccgagttcagctttgtgggagaatccaccacgatgcgggagaacaagtgtttcgaacaatgcggcgggtggggctgtggatgctttaatgtgaaccccagctgtctgttcgtccatacctacctgcagtctgtgagaaaagaggcgctccgggtttttaattgcatcgattgggtgcacaagctgacacttgaaatcaccgacttcgatggctccgtcagcacagtggacctgggggcttcttccagccgctttaccaactggggatctgtttccctcagcctggatgccgagggcatttccgggagcaattctttcagcttcatcgagtcccctggaaaaggctatgccattgtggacgaaccgttttctgagatcagcagacaggggttcctgggcgaaattcggtgtaactccgagtctagcgtcctttccgctcatgaatcttgcctcagagcccccaatctgatcagctacaagcctatgatcgatcagctggagtgcacgacaaacctcattgacccctttgtggttttcgagcgcggatccctgcctcaaacccggaatgataaaacatttgcggctagcaagggcaacagaggggtgcaggccttctctaagggatccgtccaggccgaccttaccctgatgtttgacaacttcgaagtggattttgtgggcgctgccgtcagctgtgacgctgccttcctcaatctgaccgggtgctattcttgtaacgcgggagcccgcgtttgcctgtccatcacaagcacgggcaccggcacactttccgctcacaataaagatgggtctctccatattgtgctgcccagcgagaacggaaccaaggaccaatgtcagatcctgcactttacagtgcctgaagtcgaggaggagttcatgtactcctgcgatggcgacgaaagacccctcctggtgaaagggacccttattgccatcgatccgtttgacgatcggcgcgaagctggaggcgagagcacggttgtgaatcctaagtctgggtcctggaacttcttcgactggtttagcggactgatgtcttggttcggcggccccctcaaaacaatcctgctgatttgtctttacgtcgccctgagcatcgggctctttttcctgctcatttatctgggaagaaccggcctttccaagatgtggctggccgctaccaagaaagcgtcttga

SEQ ID NO: 14440 - RNA, 3594 nt, synthetic construct
  misc_feature 1..3594: note = derived and/or modified CDS sequence (opt5) from RVFV(SA-75)__DQ380189.1__GP
  source 1..3594: mol_type = other RNA
atgtacgtgctgctcaccatcctgattacagtccttgtttgcgaggccgtgatcagagtgagcctgtcctctacgcgggaagagacctgtttcggcgactatacaaaccccgaaatgattgagggggcttgggatagcctccgcgaagaggagatgcctgaagaactgtcctgctctatcagcggaattagagaagtcaaaacctcctctcaggagctttaccgggccctgaaagcgatcatcgctgccgacggcctcaataacattacatgtcacgggaaggatccggaggacaaaatcagcctggtgaagggaccccctcataaaaagcgcgttggcattgtgagatgcgaacggcgcagagatgccaagcaaatcgggcgggagaccatggctcgcattgccatgacagtcctgcccgctctcgccgtgtttgcgctggcccctgttgtgttcgctgaagacccccaccttagaaatcggcctggaaaaggccataactatatcgatggcatgacccaggaggacgccacgtgtaagccggtcacctacgctggggcctgctccagctttgatgtgctgctcgaaaaaggaaagttccccctgtttcagtcttatgcgcaccatcgcacacttctggaggccgtgcacgacaccattatcgctaaagccgatcctccctcctgtgacctccagagcgctcacggcaatccttgcatgaaggagaagctggtcatgaaaacacattgtcccaacgattaccaatctgcccactatctgaataacgacgggaagatggcctccgttaaatgcccgcctaagtacgaactcaccgaggactgtaatttctgcagacagatgacgggagctagcctgaaaaagggctcttacccccttcaggatctgttttgccagtccagcgaagacgatgggtccaaactcaagacaaagatgaaaggagtgtgtgaggtgggcgtccaagcgctgaagaaatgcgacggccagctttctaccgcccatgaagtggttcctttcgctgtgtttaagaacagcaaaaaggtctatctggataagctcgacctgaaaacagaggagaatctgctccccgattccttcgtgtgttttgaacacaaggggcagtacaaaggaaccatggacagcggccagaccaagcgggagctgaaatctttcgatatctcccaatgccccaagattgggggacacggcagcaagaaatgtacaggggacgccgccttttgctctgcttatgaatgtacggcccagtacgcgaacgcttattgcagccatgccaatggatccggcgttgtgcagatccaagtctctggcgtgtggaagaaacctctttgtgtcgggtacgagcgcgtggttgtgaagagagaactgagcgccaaaccgattcagcgggtcgagccctgcaccacatgtatcaccaagtgcgagcctcacggactcgtggttagatccacaggcttcaagattagctctgctgtggcctgcgcttccggggtctgtgtgaccggaagccagtctccctccacggaaatcacactgaaatatcctggcatcagccagtcctctgggggcgatattggagtgcatatggcccacgacgaccaaagcgtttcctctaagatcgtcgcgcattgtcccccgcaggatccttgccttgtgcacggctgcattgtgtgtgcccacgggctgatcaactaccagtgccataccgctctcagcgccttcgtcgtggtttttgtgttctccagcgtcgctattatctgtctggccatcctgtacaaagtgctcaagtgcctgaaaattgcgccccgcaaggttcttaatcctctgatgtggatcaccgtgtttattcggtgggtctataaaaagatggtggccagagttgctgacaacatcaaccaggtgaatcgcgagattggatggatggaaggcgggcaactcgccctgggaaaccccgctcctatcccccggcacgccccgattcctagatactctacatatctgatgcttctcctgatcgtctcctacgccagcgcttgttctgagctgatccaggcgtccagccgcattaccacatgctctacggagggcgtgaataccaagtgtcggctcagcgggacagccctgatcagagctggctccgtgggagccgaagcctgccttatgctgaaaggcgtcaaggaggatcagaccaaattcctcaagattaaaacagttagctctgaactgtcctgccgcgaggggcagagctattggaccggatccttttctcccaagtgtctgagctcccggagatgccatcttgtgggcgaatgtcacgtgaaccgctgcctctcttggcgggacaatgagacgagcgctgagttctcctttgtcggggaatctaccacaatgagagagaacaagtgtttcgaacaatgcggaggctgggggtgtggctgctttaatgtgaaccccagctgtctgttcgttcacacctacctgcagtccgtgcggaaagaggccctccgcgtctttaattgcatcgattgggtgcataagctgacacttgaaattaccgacttcgatggaagcgtttctacgatcgacctgggcgcgtccagctctagatttacaaactgggggtccgtgagcctctctctggatgctgagggaatctccggcagcaattccttcagcttcattgagtctcctgggaaaggatatgccatcgtcgacgaaccgtttagcgagattccccggcagggcttcctgggggaaatcagatgtaactccgagtctagcgtgctttccgcccacgaatcttgcctccgcgctcctaatctgattagctacaagcccatgatcgatcagctggagtgcaccacaaacctcatcgacccttttgttgtgttcgagcggggctccctgccccaaaccagaaatgataaaacctttgccgcgtctaagggaaaccgcggcgtccaggctttcagcaaggggtccgtgcaggccgaccttacactgatgtttgacaacttcgaagtggattttgtcggagccgctgttagctgtgacgccgctttcctcaatctgacgggctgctactcttgtaacgccggggcgagagtgtgcctgtccattaccagcacaggaaccggcacactttctgcccataataaagatggctccctccacatcgtgctgcctagcgagaacgggaccaaggaccaatgtcagattctgcattttacggtccccgaagtggaggaggagttcatgtattcctgcgatggagacgagcggccgctcctggttaaaggcacacttatcgctattgatccttttgacgatcgcagagaagccgggggagagtctaccgtggtcaatcccaagagcggctcctggaacttcttcgactggtttagcgggctgatgtcttggttcggaggccctctcaaaaccatcctgctgatctgtctttacgtggctctgtccattggcctctttttcctgctcatctatctggggcggacaggacttagcaagatgtggctggccgccaccaagaaggcttcttga

SEQ ID NO: 14441 - RNA, 3594 nt, synthetic construct
  misc_feature 1..3594: note = derived and/or modified CDS sequence (opt5) from RVFV(SA01-1322)__KX096942.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaggaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgggcggcgcagagacacaaagcaaatcggacgggaaaccatggccggcattgctatgacagtcctgcccgccctcgctgtgtttgccctggcgcctgttgtgttcgccgaggatccccaccttcgcaacagacctggcaaagggcataattacatcgacggaatgacccaggaagatgctacgtgtaagccggtcacctatgccggcgcttgttcttcctttgacgtgctgctcgagaaagggaagttccccctgtttcagagctacgcccaccatcggacacttctggaagcggtgcacgataccattatcgccaaagctgaccctccctcttgcgatctccagtccgcccacggaaacccttgcatgaaggagaagctggtcatgaaaacacattgtcccaatgactatcaaagcgctcactacctgaacaatgatggcaagatggcctctgttaaatgcccgcctaagtatgagctcaccgaagactgtaacttctgccgccagatgacgggggcctccctgaaaaagggaagctacccccttcaggacctgttttgccagtcctctgaggatgacggcagcaaactcaagacaaagatgaaaggcgtgtgtgaagtgggggtccaagctctgaagaaatgcgatggacagctttccaccgcgcatgaggtggttcctttcgccgtgtttaagaatagcaaaaaggtctacctggacaagctcgatctgaaaacagaagagaacctgctccccgactctttcgtgtgttttgagcacaagggccagtataaagggaccatggattccggacagaccaagagagaactgaaatctttcgacatctctcaatgccccaagattggcgggcacggaagcaagaaatgtacaggcgatgctgccttttgctccgcctacgagtgtacggctcagtatgccaatgcgttctgctctcatgctaacggcagcgggatcgttcagattcaagtgtccggagtctggaagaaacctctttgtgtgggctacgaacgggtcgtggttaagcgcgagctgagcgccaaaccgatccagagagtggaaccctgcaccacatgtattaccaagtgcgagcctcacgggctcgtcgtgcggtctacaggattcaagatctccagcgccgttgcttgcgcctctggcgtgtgtgtcaccgggtcccagagcccctccacggagatcacactgaaatatcctggcatttctcagagctccggaggcgacatcggggtgcatatggctcacgatgaccaatctgtgagctccaagattgttgcccattgtcccccgcaggacccttgccttgtccacggatgcatcgtgtgtgcgcacggcctgattaattaccagtgccataccgccctcagcgcttttgtggtcgtgttcgtttttagctccatcgccatcatttgtctggctatcctgtatagagtgctcaaatgcctgaagattgcgccccgcaaagtccttaaccctctgatgtggatcaccgccttcattcggtgggtgtacaagaaaatggttgccagagtggctgataacatcaatcaggtcaaccgcgaaattgggtggatggagggaggccaactcgtgctgggggaccccgcccctatcccccggcacgctccgatccctagatacagcacatatctgatgcttctcctgattatctcttacgcctccgcctgtagcgaactgattcaggcttctagccgcatcaccacatgctccacggagggcgttaataccaagtgtcggctcagcggaacagcgctgattagagccggctctgtgggggctgaggcctgccttatgctgaagggagtcaaagaagatcagaccaagtttctcaaaatcaagacagtgtccagcgagctgtcctgccgcgaaggccagtcttattggaccgggagcttctcccccaaatgtctgtctagccggagatgccatcttgtgggagagtgtcacgtcaaccgctgcctctcctggcgggacaatgaaacgtctgccgagtttagcttcgttggcgagtccaccacaatgagagaaaacaagtgttttgagcaatgcgggggctggggatgtggctgcttcaatgtgaaccccagctgtctgtttgtgcacacctacctgcagtctgtccggaaggaagctctccgcgtgttcaattgcatcgattgggttcataaactgacacttgagattaccgactttgatgggtccgtgagcacgatcgacctgggagcctcttccagcagattcacaaactggggctctgtctccctcagcctggatgcggaagggatttccggaagcaattctttcagctttatcgagtcccctggcaaggggtatgctattgtggacgagccgttctctgaaatcccccggcagggctttctgggagagatcagatgtaacagcgaatcctctgttcttagcgcccacgagtcctgcctccgcgcccctaatctgatttcttacaaacccatgatcgatcagctggaatgcaccacaaacctcattgaccctttcgtggtctttgagcggggcagcctgccccaaaccagaaatgagaagaccttcgctgcctccaaagggaaccgcggagtgcaggcgtttagcaagggctctgttcaggctgatcttacactgatgttcgacaactttgaagtggacttcgtcggggccgccgtgtcctgtgatgctgcctttctcaatctgacgggatgctatagctgtaacgctggcgccagagtgtgcctgtctatcacctccacaggcaccgggacacttagcgcgcataataaggacggatccctccacattgtcctgccttctgagaacggcaccaaagatcaatgtcagatcctgcatttcacggttcccgaagtggaggaggaatttatgtacagctgcgacggggatgagcggccgctcctggtgaagggaacacttatcgccattgaccctttcgatgaccgcagagaagctggcggggagtccaccgtcgtgaatcccaaaagcggatcttggaacttctttgattggttctccggcctgatgagctggtttggcgggcctctcaagaccatcctgctgatttgtctttacgttgccctgtctatcggactcttctttctgctcatttatctgggccggacagggcttagcaaaatgtggctggctgccaccaagaaggcctcctga

SEQ ID NO: 14442 - RNA, 3594 nt, synthetic construct
  misc_feature 1..3594: note = derived and/or modified CDS sequence (opt5) from RVFV(KEN/Mal-032/07)__HM586967.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggcggctgcaggaggatgccacatgtaagccggtcacctatgctggagcctgttcttcctttgacgtgctcctggaaaaaggcaagttccccctttttcagagctacgcgcaccatcgcacgctgctcgaggccgtgcacgataccattatcgctaaagccgaccctccctcttgcgatctgcagtccgctgacgggaacaagtgcatgaaggagaaactggtcatgaagacacactgtcctaatgattatcaaagcgcccattacctcaacaatgacggaaaaatggcctctgttaagtgtcccccgaaatatgaactgaccgaggactgcaacttctgcagacagatgacaggcgcttcccttaagaaagggagctaccctctgcaggatctcttttgccagtcctctgaagacgatggaagcaagctgaagaccaaaatgaagggcgtgtgtgaggtgggcgtccaagcgcttaaaaagtgcgacgggcagctgtccacggcccacgaagtggttcccttcgctgtgtttaaaaatagcaagaaggtctacctcgataaactggacctgaagacagaggagaacctcctgcctgattctttcgtgtgttttgaacataaaggacagtataagggcaccatggactccgggcagacaaaacgggagcttaagagcttcgatatctctcaatgccccaagattggaggccacgggagcaaaaagtgtaccggagacgccgccttttgctccgcttacgaatgtaccgcccagtatgcgaatgcttactgctctcacgccaacggcagcggcatcgttcagattcaagtgtccggggtctggaaaaagcccctgtgtgtgggatatgagcgcgtcgtggttaaaagagaactcagcgccaagcctatccagcgggtggagccgtgcacaacgtgtattaccaagtgcgagccccatggcctggtcgtgagatctacagggttcaaaatctccagcgctgttgcctgcgcttctggagtgtgtgtcaccggctcccagagcccttccacagaaatcacccttaagtaccccgggatttctcagagctccggcggagatatcggcgtgcacatggcccatgacgaccaatctgtgagctccaaaattgttgcgcactgccctccccaggatccgtgtctggtccatgggtgcatcgtgtgtgcccacggactcattaattatcagtgccacacggctctgagcgccttcgtggtcatctttgtgttctcttccacagctatcatttgtctggccgttctctaccgcgtgctgaagtgccttaaaatcgcgcctcggaaggtcctgaaccccctcatgtggattaccgcctttatcagatgggtgtacaaaaagatggttgctcgcgtggccgacaacattaatcaggtcaaccgggagatcggctggatggaagggggacaactggctctgggcaatcctgcccccattcctagacatgcccccatcccgcgctatagcacctaccttatgctcctgctgatcgtgtcttatgcttccgcgtgtagcgagctcattcaggcctctagccggatcacaacctgctccacagagggggttaacacgaagtgtagactgagcggcaccgctcttattcgcgccggatctgtgggcgccgaggcttgcctgatgctcaaaggggtcaaggaggatcagacaaaattcctgaagatcaaaaccgtgtccagcgaactgtcctgccgggagggacagtcttactggacaggcagcttttcccctaagtgtctttctagcagacgctgccacctcgtgggggaatgtcatgtcaatcggtgcctgtcctggagagacaacgagacctctgccgagttcagctttgttggagaatccacgaccatgcgggagaataagtgtttcgaacaatgcggcgggtggggctgtggatgctttaacgtgaatcccagctgtctgttcgtgcacacatatctccagtctgtccgcaaagaggcgctgagagtgtttaactgcattgattgggttcacaaacttaccctggaaatcacagacttcgatggctccgtgagcaccatcgacctcggggcttcttccagccggtttacgaattggggatctgtctccctgagcctggatgccgagggcatttccgggagcaactctttcagcttcatcgagtcccccggaaagggctacgccattgtggacgaacctttttctgagatcccgagacaggggttccttggcgaaattcgctgtaatagcgagtcctctgttctcagcgctcatgaatcctgcctgcgggcccccaacctggtgtcttataagcctatgatcgatcagctcgagtgcacaaccaatctgatcgacccctttgtcgtgttcgagagaggaagccttcctcaaacacgcaacgataaaacctttgcggcttccaagggcaacagaggggttcaggccttcagcaagggatctgtgcaggccgacctgaccctcatgtttgacaatttcgaagtcgattttgtgggcgctgccgtgtcctgtgacgctgccttcctgaacctgacagggtgctacagctgtaatgcgggagcccgggtctgcctttctattacgtccaccggcacaggcaccctcagcgctcacaacaaagatgggtccctgcatatcgttctgccctctgagaatggaacaaaggaccaatgtcagattctccactttaccgtgcctgaagtggaggaggagttcatgtacagctgcgatggcgacgaacgccccctgcttgtcaaagggacgctgatcgccattgatccgtttgacgatagacgggaagctggaggcgagtccacagtggttaaccctaagagcgggtcttggaatttcttcgactggttttccggactcatgagctggttcggcggccccctgaaaaccatcctgcttatctgtctgtatgtggccctctctattgggctgtttttcctcctgatctaccttggacgcaccggcctgagcaagatgtggctcgccgctacaaagaaagcgtcctga

SEQ ID NO: 14443 - RNA, 3594 nt, synthetic construct
  misc_feature 1..3594: note = derived and/or modified CDS sequence (opt5) from RVFV(KEN/Gar-008/06)__HM586965.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaatcccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggagcaagaaatgtaccggagatgccgccttttgctccgcttacgaatgtacagcccagtatgcgaatgcttactgctctcatgccaacggcagcggcatcgttcagattcaagtgtcccgggtctggaagaaacctctttgtgtggggtatgagcgcgtcgtggttaagagagaactgagcgccaaaccgatccagcgggtggagccctgcacgacctgtattacaaagtgcgagcctcacggactcgtcgtgagatctaccggcttcaagatctccagcgctgttgcctgcgcttctggggtgtgtgtcacaggatcccagagcccctccaccgaaatcacgctgaaataccctggcatttctcagagctccgggggcgacatcggagtgcatatggcccacgatgaccaatctgtgagctccaagattgttgcgcattgtcccccgcaggacccttgccttgtccacggctgcatcgtgtgtgcccacgggctgattaattatcagtgccatacagctctcagcgccttcgtggtcatctttgtgttctcttccaccgctatcatttgtctggccgttctgtaccgcgtgctcaaatgcctgaagatcgcgccccggaaagtccttaaccctctgatgtggattaccgcctttatcagatgggtgtacaagaaaatggttgctcgcgtggccgataacattaatcaggtcaaccgggagatcggatggatggaaggcgggcaactcgctctgggaaatcccgcccctattcccagacacgccccgatccctcgctatagcacatacctgatgcttctcctgatcgtgtcttatgcttccgcgtgtagcgagctgattcaggcctctagccggatcaccacatgctccacggagggcgttaacaccaagtgtagactcagcgggacagctctgattcgcgccggctctgtgggagccgaggcttgccttatgctgaagggcgtcaaagaggaccagaccaagttcctcaaaatcaagacagtgtccagcgaactgtcctgccgggaggggcagtcttactggaccggcagcttttcccccaaatgtctgtctagcagacgctgccatcttgtgggagaatgtcacgtcaatcggtgcctctcctggagagataacgagacgtctgccgagttcagctttgttggggaatccaccacaatgcgggagaataagtgtttcgaacaatgcggaggctgggggtgtggctgctttaacgtgaatcccagctgtctgttcgtgcacacctatctgcagtctgtccgcaaggaggcgctcagagtgtttaactgcattgactgggttcataaactgacacttgaaatcaccgatttcgacggatccgtgagcacgatcgatctgggcgcttcttccagccggtttacaaattgggggtctgtctccctcagcctggacgccgagggaatttccggcagcaactctttcagcttcatcgagtcccctgggaagggatacgccattgtggatgaaccgttttctgagatccccagacagggcttcctgggggaaattcgctgtaatagcgagtcctctgttcttagcgctcacgaatcctgcctccgggcccctaacctggtgtcttataaacccatgatcgaccagctggagtgcaccacaaatctcatcgatccttttgtcgtgttcgagagaggcagcctgccccaaacccgcaacgacaagacctttgcggcttccaaaggaaacagaggcgttcaggccttcagcaaggggtctgtgcaggccgatcttacactgatgtttgacaatctcaaggtcgacttcgtgggagctgccgtgtcctgtgatgctgcctttctgaacctgacgggctgctacagctgtaatgcgggggcccgggtctgcctttctattacctccacaggaaccggcacactcagcgctcataacaaagacggctccctgcacatcgttctgccttctgaaaatgggaccaaggatcaatgtcagattctccatttcacggtgcccgaggtgaaagaagagtttatgtacagctgcgacggagatgagcgcgccctgcttatgaagggcacactgatcgctattgacccgttcgatgacagacgggaagccgggggagagtccaccgtcgtgaaccctaaaagcggctcttggaactttttcgattggttctccgggctcatgagctggtttggaggccccctgaagaccatcctgcttatctgtctgtatgttgccctctctattggcctgttctttctcctgatctaccttgggcgcacaggactgagcaagatgtggctcgctgcgaccaaaaaggcctcctga

SEQ ID NO: 14444 - RNA, 3594 nt, synthetic construct
  misc_feature 1..3594: note = derived and/or modified CDS sequence (opt5) from RVFV(Kenya 56 (IB8))__DQ380190.1__GP
  source 1..3594: mol_type = other RNA
atgtacgtgctgctcaccatcctgattacagtccttgtttgcgaggccgtgatcagagtgagcctgtcctctacgcgggaagagacctgtttcggcgacagcacatcccccgaaatgattgagggggcttgggattctctccgcgaagaggagatgcctgaggaactgagctgctccatctctggaattagagaagtcaagaccagctcccaggagctttatcgggccctgaaagcgatcatcgctgccgacggcctcaacaatattacatgtcacgggaaggatccggaggacaaaatcagcctgattaagggaccccctcataaaaagcaagtgggcatcgttcgctgcgaaagacggcgcgatgccaagcagattgggagagagaccatggctggaatcgccatgacagtgctgcccgctctcgccgtctttgcgctggcccctgtggttttcgctgaagacccccaccttcggaaccgccctggcaaaggccataattacattgatgggatgacccagggagacgccacgtgtaagccggtgacctatgctggcgcctgcagctcctttgatgtcctgctcgagaaagggaagttccccctgtttcagagctacgcgcaccatagaacacttctggaagccgtgcacgacaccatcatcgctaaagccgatcctccctcttgtgacctccaatccgctcacggaaacccttgcatgaaggagaagctggtgatgaaaacacattgtcccaaggattatcagagcgcccactacctgaataacgacggcaaaatggcctctgtcaagtgcccgcctaaatatgagctcaccgaagactgtaatttctgccggcagatgacgggggcttccctgaagaaaggaagctacccccttcaggatctgttttgccaatcctctgaggacgatggcagcaagctcaagacaaaaatgaagggcgtttgtgaagtgggggtgcaggcgctgaaaaagtgcgacggacagctttccaccgcccatgaggtcgtgcctttcgctgtttttaaaaacagcaagaaggtgtacctggataaactcgacctgaagacagaagagaatctgctccccgattctttcgtctgttttgagcacaaaggccagtataaggggaccatggactccggacaaaccaaacgcgaactgaagtctttcgatatttctcagtgccccaagatcggcgggcacggaagcaaaaagtgtacaggcgacgccgccttttgctccgcttacgagtgtacggcccagtatgcgaacgcttactgctctcatgccaatggcagcgggattgtgcaaatccaggtttccggagtgtggaaaagacctctttgtgtcggctatgaacgggtggtcgtgaagcgcgagctgagcgccaaaccgattcagagagttgaaccctgcaccacatgtatcaccaagtgcgagcctcacgggctcgtggtccggtctacaggattcaagatctccagcgctgtggcctgcgcttctggcgtttgtgtgaccgggtcccagagcccctccacggagattacactgaaataccctggcatgtctcaaagctccggaggcgatatcggggtccatatggcccacgacgaccagtctgtgagctccaagattgtggcgcattgtcccccgcaggatccttgccttgttcacggatgcatcgtctgtgcccacggcctgattaactatcagtgccataccgctctcagcgccttcgtggtggtctttgtgttctcttccgttgctatcatctgtctggccattctgtacaaagtgctcaagtgcctgaaaatcgcgcccagaaaggtccttaatcctctgatgtggattaccgcctttatccgctgggtgtacaaaaagatggttgctcgggtggccgacaacattaatcaagtcaacagagaaatcgggtggatggagggaggccagcccgctctcgggaaccctgcccccattccgcgccacgcccctatcccccggtatagcacatacctgatgctgcttctcatcgtgtcttatgcttccgcgtgtagcgaactgattcaggcctctagcagaatcaccacatgctccacggagggcgttaataccaagtgtcgcctgagcggaacagctctcattcgggccggctctgtgggggccgaggcttgcctgatgcttaaaggagtcaaggaagatcagaccaaattcctgaagatcaaaacagtgtccagcgagctctcctgcagagaaggccaatcttactggaccgggagcttttcccccaagtgtctgtctagccgccggtgccatctggtgggagagtgtcacgtcaacagatgcctttcctggcgcgacaatgaaacgtctgccgagttcagctttgttggcgagtccaccacaatgcgggaaaacaagtgtttcgagcagtgcgggggctggggatgtggctgctttaatgtgaaccctagctgtctcttcgtgcacacctatctgcagtctgtcagaaaagaagcgctgcgggtgtttaattgcattgattgggttcataagctcacactggagatcaccgacttcgatgggtccgtgagcacgatcgaccttggagcttcttccagccgctttacaaactggggctctgtctccctgagcctcgatgccgaagggatttccggaagcaattctttcagcttcatcgagtccccgggcaaagggtacgccattgtggacgagcccttttctgaaatccctagacagggcttcctgggagagattcggtgtaacagcgaatcctctgttctgagcgctcacgagtcctgccttagagcccccaatctcatctcttataagcctatgatcgatcaactggaatgcaccacaaacctgattgacccctttgtggcgttcgagcgcggcagcctccctcagacccggaatgataaaacctttgctgcctccaaggggaacagaggagtccaggccttcagcaagggctctgtgcaagctgacctgacacttatgtttgacaatttcgaggttgattttgtgggggccgctgtctcctgtgacgccgcgttcctgaacctcacgggatgctacagctgtaacgccggcgctcgcgtgtgcctgtctatcacctccacaggcaccgggacactgagcgcccataataaagatggatcccttcacattgtgctcccctctgaaaacggcaccaaggaccagtgtcagatcctgcattttacggtcccggaggttgaagaggagttcatgtacagctgcgatggggacgaaagacctctgctcgtgaaaggaacactgattgctatcgatccctttgacgatcggcgcgaggccggcggggaatccaccgtggtcaatcctaagagcggatcttggaacttcttcgactggttttccggccttatgagctggttcggcgggcccctgaaaaccatcctcctgatttgtctgtatgtggccctttctatcggactgtttttcctcctgatttacctcggcagaacagggctgagcaagatgtggcttgctgcgaccaagaaagcctcctga

SEQ ID NO: 14445 - RNA, 3594 nt, synthetic construct
  misc_feature 1..3594: note = derived and/or modified CDS sequence (opt5) from RVFV(KEN/Bar-035/07)__HM586969.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggcggctgcaggaggatgccacatgtaagccggtcacctatgctggagcctgcagctcctttgacgtgctcctggaaaaaggcaagttccccctttttcagagctacgcgcaccatcgcacgctgctcgaggccgtgcacgataccattatcgctaaagccgaccctccctcttgtgatctgcagtccgctgacgggaacaagtgcatgaaggagaaactggtcatgaagacacactgtcctaatgattatcaaagcgcccattacctcaacaatgacggaaaaatggcctctgttaagtgtcccccgaaatatgaactgaccgaggactgcaacttctgcagacagatgacaggcgcttcccttaagaaagggagctaccctctgcaggatctcttttgccagtcctctgaagacgatggaagcaagctgaagaccaaaatgaagggcgtgtgtgaggtgggcgtccaagcgcttaaaaagtgcgacgggcagctgtccacggcccacgaagtggttcccttcgctgtgtttaaaaatagcaagaaggtctacctcgataaactggacctgaagacagaggagaacctcctgcctgattctttcgtgtgttttgaacataaaggacagtataagggcaccatggactccgggcagacaaaacgggagcttaagagcttcgatatctctcaatgccccaagattggaggccacgggagcaaaaagtgtaccggagacgccgccttttgctccgcttacgaatgtaccgcccagtatgcgaatgcttactgctctcacgccaacggcagcggcatcgttcagattcaagtgtccggggtctggaaaaagcccctgtgtgtgggatatgagcgcgtcgtggttaaaagagaactcagcgccaagcctatccagcgggtggagccgtgcacaacgtgtattaccaagtgcgagccccatggcctggtcgtgagatctacagggttcaaaatctccagcgctgttgcctgcgcttctggagtgtgtgtcaccggctcccagagcccttccacagaaatcacccttaagtaccccgggatttctcagagctccggcggagatatcggcgtgcacatggcccatgacgaccaatctgtgagctccaaaattgttgcgcactgccctccccaggatccgtgtctggtccatgggtgcatcgtgtgtgcccacggactcattaattatcagtgccacacggctctgagcgccttcgtggtcatctttgtgttctcttccacagctatcatttgtctggccgttctctaccgcgtgctgaagtgccttaaaatcgcgcctcggaaggtcctgaaccccctcatgtggattaccgcctttatcagatgggtgtacaaaaagatggttgctcgcgtggccgacaacattaatcaggtcaaccgggagatcggctggatggaagggggacaactggctctgggcaatcctgcccccattcctagacatgcccccatcccgcgctatagcacctaccttatgctcctgctgatcgtgtcttatgcttccgcgtgtagcgagctcattcaggcctctagccggatcacaacctgctccacagagggggttaacacgaagtgtagactgagcggcaccgctcttattcgcgcccggtctgtgggagccgaggcttgcctgatgctcaaaggcgtcaaggaggatcagacaaaattcctgaagatcaaaaccgtgtccagcgaactgtcctgcagagaggggcagtcttactggacaggatctttttcccctaagtgtctttctagccgccggtgccacctcgtgggcgaatgtcatgtcaatagatgcctgtcctggcgggacaacgagacctctgccgagttcagctttgttggggaatccacgaccatgcgcgagaataagtgtttcgaacaatgcggaggctgggggtgtggctgctttaacgtgaatcccagctgtctgttcgtgcacacatatctccagtctgtcagaaaagaggcgctgcgggtgtttaactgcattgattgggttcacaaacttaccctggaaatcacagacttcgatggatccgtgagcaccatcgacctcggcgcttcttccagcagatttacgaattgggggtctgtctccctgagcctggatgccgagggaatttccggcagcaactctttcagcttcatcgagtcccccgggaagggatacgccattgtggacgaacctttttctgagatcccgcgccagggcttccttggggaaattcggtgtaatagcgagtcctctgttctcagcgctcatgaatcctgcctgagagcccccaacctggtgtcttataagcctatgatcgatcagctcgagtgcacaaccaatctgatcgacccctttgtcgtgttcgagcgcggcagccttcctcaaacaagaaacgataaaacctttgcggcttccaagggaaaccggggcgttcaggccttcagcaaggggtctgtgcaggccgacctgaccctcatgtttgacaatttcgaagtcgattttgtgggagctgccgtgtcctgtgacgctgccttcctgaacctgacaggctgctacagctgtaatgcgggggcccgcgtctgcctttctattacgtccaccggaacaggcaccctcagcgctcacaacaaagatggctccctgcatatcgttctgccctctgagaatgggacaaaggaccaatgtcagattctccactttaccgtgcctgaagtggaggaggagttcatgtacagctgcgatggagacgaaagacccctgcttgtcaaaggcacgctgatcgccattgatccgtttgacgatcggcgcgaagctgggggagagtccacagtggttaaccctaagagcggctcttggaatttcttcgactggttttccgggctcatgagctggttcggaggccccctgaaaaccatcctgcttatctgtctgtatgtggccctctctattggcctgtttttcctcctgatctaccttgggagaaccggactgagcaagatgtggctcgccgctacaaagaaagcgtcctga

SEQ ID NO: 14446 - RNA, 3594 nt, synthetic construct
  misc_feature 1..3594: note = derived and/or modified CDS sequence (opt5) from RVFV(TAN/Dod-002/07)__HM586971.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggatgacacaggaggatgccacctgtaagccggtcacgtatgctggagcctgcagctcctttgacgtgctgctcgaaaaaggcaagttccccctgtttcagagctacgcgcaccatcggacccttctggaggccgtgcacgatacaattatcgctaaagccgaccctccctcttgtgatctccagtccgctcacgggaacccttgcatgaaggagaagctggtcatgaaaacccattgtcccaatgactatcaaagcgcccactacctgaacaatgatggaaagatggcctctgttaaatgcccgcctaagtatgaactcacagaggactgtaacttctgccgccagatgaccggcgcttccctgaaaaaggggagctacccccttcaggacctgttttgccagtcctctgaagatgacggaagcaaactcaagacgaagatgaaaggcgtgtgtgaggtgggcgtccaagcgctgaagaaatgcgatgggcagctttccacagcccatgaagtggttcctttcgctgtgtttaagaatagcaaaaaggtctacctggacaagctcgatctgaaaaccgaggagaacctgctccccgactctttcgtgtgttttgaacacaagggacagtataaaggcacaatggattccgggcagaccaagagagagctgaaatctttcgacatctctcaatgccccaagattggaggccacgggcggaagaaatgtaccggagatgccgccttttgcagcgcttacgaatgtacagcccagtatgcgaatgcttactgctcccatgccaacggctctggcatcgttcagattcaagtgagcggggtctggaagaaacctctttgtgtgggatatgagcgcgtcgtggttaagagagaactgtccgccaaaccgatccagcgggtggagccctgcacgacctgtattacaaagtgcgagcctcacggcctcgtcgtgagaagcaccgggttcaagatctcttccgctgttgcctgcgctagcggagtgtgtgtcacaggctctcagtcccccagcaccgaaatcacgctgaaataccctgggatttcccagtctagcggcggagacatcggcgtgcatatggcccacgatgaccaatccgtgtctagcaagattgttgcgcattgtcccccgcaggacccttgccttgtccacgggtgcatcgtgtgtgcccaggcttggattatctcccagtggcacacagccctgagcgctttcgtggtcatctttgtgttctcttccaccgccattatctgcctcgcggttctgtatcgcgtgctgaaatgtctcaagattgctccccggaaagtcctgaatcctcttatgtggatcaccgcctttattagatgggtgtacaagaaaatggttgcccgcgtggctgataacatcaaccaagtcaatcgggagattggatggatggaaggcgggcagctggccctcggaaaccccgcccctatccccagacatgctccgatccctcgctacagcacatatctgatgctgcttctcattgtgtcttacgcgtccgcctgcagcgagctgatccaggcttctagccggattaccacatgttccacggagggcgttaataccaagtgcagactgagcgggacagccctcatccgcgccggctctgtgggagctgaagcctgtctgatgcttaagggcgtcaaagaggaccagaccaagttcctgaaaattaagacagtgtccagcgaactctcctgccgggaggggcaatcttattggaccggcagcttttcccccaaatgcctgtctagcagacgctgtcacctggtgggagaatgccatgtcaaccggtgtctttcctggagagataatgagacgtctgcggagttcagctttgttggggaatccaccacaatgcgggagaacaagtgcttcgaacagtgtggaggctgggggtgcggctgttttaatgtgaaccccagctgcctcttcgtgcacacctacctgcagtctgtccgcaaggaggctctgagagtgtttaattgtatcgactgggttcacaaactcacactggaaatcaccgatttcgacggatccgtgagcacgattgatcttggcgcctcttccagccggtttacaaactgggggtctgtctccctgagcctcgacgccgagggaatctccggcagcaattctttcagcttcattgagtcccctgggaagggatatgctatcgtggatgaaccgttttctgagattcccagacagggcttcctgggggaaatccgctgcaacagcgagtcctctgttctgagcgcccatgaatcctgtcttcgggcgcctaatctcgtgtcttacaaacccatgatcgaccaactggagtgcaccacaaacctgattgatccttttgtcgtgttcgagagaggcagcctcccccagacccgcaatgacaagacctttgctgcctccaaaggaaacagaggcgttcaggccttcagcaaggggtctgtgcaagctgatctgacacttatgtttgacaacttcgaagtcgactttgtgggagccgctgtgtcctgcgatgccgcgttcctgaatctcacgggctgttatagctgcaacgccggggctcgggtctgtctgtctatcacctccacaggaaccggcacactgagcgcccacaataaggacggctcccttcatattgttctcccttctgagaacgggaccaaagatcagtgccagatcctgcactttacggtgcccgaagtggaggaggagttcatgtacagctgtgacggagatgagcgcccgctgctcgtcaagggcacactgattgctatcgacccttttgatgacagacgggaagccgggggagagtccaccgtggttaatcccaaaagcggctcttggaacttcttcgattggttttccgggcttatgagctggttcggaggccctctgaagaccatcctcctgatttgcctgtacgtggccctttctatcggcctgtttttcctcctgatttatctcgggcgcacaggactgagcaaaatgtggcttgctgcgaccaagaaggcctcctga

SEQ ID NO: 14447 - RNA, 3594 nt, synthetic construct
  misc_feature 1..3594: note = derived and/or modified CDS sequence (opt5) from RVFV(Beijing-01)__KX611606.1__GP
  source 1..3594: mol_type = other RNA
atgtacgtgctgctcaccatcctgattagcgtccttgttttcgaggtggtgatcagagtctccctgtctagcacacgggaagagacgtgctttggcgactccaccaaccccgaaatgattgagggggcctgggattctctccgcgaagaggagatgcctgaggaactgagctgttccatctctggaattagagaagtgaagacaagctcccaggagctttatcgggctctgaaagccatcatcgcggctgacggcctcaataacattacctgccacgggaaggatccggaggacaaaatcagcctgattaagggaccccctcataaaaagcgcgttggcatcgtgagatgtgaacggcgcagagatgccaagcaaattgggcgggagacaatggccggaatcgctatgaccgtcctgcccgccctcgctgtgttcgccctggcgcctgttgtgtttgccgaagacccccaccttcgcaatagacctggcaaaggccataactacattgatggggtcacacaggaggacgctacctgcaagccggtgacgtatgccggagcttgttcttccttcgatgtgctgctcgaaaaaggcaagtttcccctgttccagagctacgcccaccatcggacccttctggaggcggtccacgacacaatcatcgccaaagctgatcctccctcttgcgacctccagtccgcccacgggaatccttgtatgaaggagaagctggttatgaaaacccattgccccaacgattatcaaagcgctcactacctgaataacgacggaaagatggcctctgtgaaatgtccgcctaagtatgaactcacagaggactgcaatttttgtcgccagatgaccggcgcctccctgaaaaaggggagctacccccttcaggatctgttctgccagtcctctgaagacgatggaagcaaactcaagacgaagatgaaaggcgtgtgcgaggtcggcgtgcaagctctgaagaaatgtgacgggagactttccacagcgcatgaagttgtgccttttgccgtcttcaagaacagcaaaaaggtgtacctggataagctcgacctgaaaaccgaggagaatctgctccccgattcttttgtttgcttcgaacacaagggacagtataaaggcacaatggactccgggcagaccaagcgggagctgaaatcttttgatatttctcagtgtcccaagatcggaggccacgggagcaagaaatgcaccggagacgctgccttctgttccgcctacgaatgcacagctcaatatgccaacgcgtactgttctcatgctaatggcagcggcattgtgcagatccaggtctccggggtgtggaagaaacctctttgcgtcggatatgagcgcgtggttgtgaagagagaactgagcgccaaaccgattcaacgggtcgagccctgtacgacctgcatcacaaagtgtgagcctcacggcctcgtggttagatctaccgggttcaagatctccagcgccgtggcttgcgcctctggagtctgcgtgacaggctcccagagcccctccaccgaaattacgctgaaataccctgggatctctcagagctccggcggagatattggcgtgcatatggctcacgacgaccagtctgttagctccaagatcgtctttgattgtcccccgcaagacccttgccttgtgcatgggtgtattgtgtgcgcccacggactgatcaactatcagtgtcacacagcgctcagcgccttcgtcgtggtttttgtgttctcttccgtcgctatcatttgcctggccatcctgtacaaagtgctccgctgtctgaagattgctcccaaaaaggttcttaatcctctgatgtggatcaccgcctttattcggtgggtgtacaaaaagatggtcgcgagagtggccgataacatcaaccaggttaatcgcgagattggctggatggaagggggacagctcgctctgggcaaccccgcccctatcccccggcatgctccgatccctagatatagcacctacctgatgcttctcctgattatctcttatgcctccgcctgcagcgagctgattcaagctagcagccgcatcacaacctgttccacagagggggtgaatacgaagtgccggctcagcggcaccgcgctgattagagccggatctgtcggcgctgaagcctgtcttatgttcgagggggtgaaagaagaccagacaaagtttctgaaaatcaagaccgtgtccagcgagctctcctgccgcgaaggacagtcttactggacaggcagcttctcccccaaatgcctgtctagccggagatgtcacctggtcggggagtgccatgttaaccgctgtctttcctggcgggataatgagacctctgccgaatttagcttcgtgggagagtccacgaccatgagagaaaacaagtgctttgagcagtgtggcgggtggggctgcggatgtttcaatgtgaaccccagctgcctctttgtccacacatatctgcaatctgtgcggaaggaagctctgcgcgttttcaattgtatcgactgggtgcacaaactcaccctggagattacagatttcgacggctccgtcagcaccatcgatcttggggcctcttccagcagatttacgaactggggatctgtgtccctgagcctcgacgcggagggcatttccgggagcaattctttcagctttatcgaatcccctggaaagggctacgctattgttgatgagccgttctctgaaatcccccggcaggggtttctgggcgagatcagatgcaacagcgaatcctctgtgctgagcgcccatgagtcctgtcttcgcgcccctaatctcatttcttataaacccatgatcgaccagctggagtgcacaaccaacctgattgatcctttcgtcgtgtttgaacggggaagcctcccccagacaagaaatgacaagaccttcgctgcctccaaaggcaaccgcggggttcaagcgtttagcaagggatctgtgcaggctgacctgacccttatgttcgataactttgaggtcgacttcgtgggcgccgccgtgtcctgcgatgctgcctttctgaatctcacagggtgttacagctgcaacgctggagccagagtctgtctgtctatcacgtccaccggcacaggcaccctgagcgcgcacaataaggacgggtcccttcatattgttctcccttctgaaaacggaacaaaagatcagtgccaaatcctgcacttcaccgtgcccgaggtggaggaagagttcatgtacagctgtgacggcgatgaacggccgctgctcgtcaaggggacgctgatcgccattgacccttttgatgaccgcagagaggctggaggcgaatccacagtggttaatcccaaaagcgggtcttggaacttctttgattggttctccggacttatgagctggtttggcggccctctgaagaccatcctcctgatttgcctgtatgtggccctttctatcgggctgttctttctcctgatttacctcggacggaccggcctgagcaaaatgtggcttgctgccacaaagaaggcctcctga

SEQ ID NO: 14448 - RNA, 3594 nt, synthetic construct
  misc_feature 1..3594: note = derived and/or modified CDS sequence (opt5) from RVFV(Smithburn)__DQ380193.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaggaactgagctgctccatctctggaattagagaagtcaagacaagctcccaggagctttatcgggccctgaaagcgaccatcgctgccgacggcctcaataacatcacatgtcacgggaaggatccggaggacaaaattagcctgatcaagggaccccctcataaaaagcgcgtgggcgttgtgagatgcgaacggcaacgcgatgccaagcagattgggagaggaaccatggctggcatcgccatgacagtctttcccgctctggtggttttcgccctcgcgcctgtggtctttgccgaggacccccatctgcggaatcgccctggcaaagggcacaactacattgatggaatgacccaggaagacgctacgtgtaagccggtgacctatgccggcgcttgttcttccttcgatgtgcttctggagaaagggaagtttcccctcttccagagctacgcccaccatagaacactgcttgaagcggtccacgacatcattatcgccaaagctgatcctccctcttgcaatctgcaatccgcccacggaaacccttgcatgaaggagaagctcgttatgaaaacctattgtcccaatgactaccagagcgctcattatctgaacaatgatggcaagatggcctctgtgaaatgcccgcctaagcacgagctgacagaagactgtaacttttgccggcagatgaccggggcctccctcaaagagggaagctaccccctgcaggaccttttctgccaatcctctgaagatgacggcagcaagctgaaaacgaagatgaagggcgtgtgtgaggtcggggtgcaggttctcaaaaagtgcgatggacagctgtccacagctcatgaagtggtcccttttgcggtgttcaaaaatagcaagaaagtttaccttgacaagctggatctcaagaccgaggagaacctgctgcccgactcttttgtgtgtttcgaacacaaaggccagtataaggggacaatggattccggacaaatcaaacgcgagctcaagagctttgacatttctcagtgccccaaaatcggcgggcacggaagcaagaagtgtaccggcgatgccgctttctgctccgcctacgaatgtaccgcccagtatgctaatgcctactgctctcatgcgaacggcagcgggattgtccaaatccaggtgtccggagtctggaaaaagcctctgtgtgtgggctatgagagagttgtggtcaaacgggaacttagcgctaagccgattcagcgcgtggagccctgcacaacgtgtatcaccaaatgcgagcctcacgggctggttgtgagatctacaggattcaagatctccagcgccgtcgcctgcgcttctggcgtgtgtgtgaccgggtcccagagcccctccacagaaattaccctcaagtaccctggcatctctcaaagctccggaggcgacattggggttcatatggcccacgatgaccagtctgtcagctccaaaatcgtggctcattgtcccccgcaggacccttgcctggtgcacggatgcattgtctgtgcccacggccttatcaattatcagtgccatacggcgtttagcgccttcgtggttgtgtttgtcttctcttccgtggttatcatttgtctggctatcctctacaaggtgctgaaatgcctgaagattgctccccggaaagtcctcaaccctctgatgtggatcacagcctttattagatgggtgtacaagaaaatggttgcccgcgtggcggataacatcaatcaagtcaaccgggagattgggtggatggaaggaggccagcttgtgctggggaatcccgcccctatccccagacacgctccgatccctcgctatagcacctacctcatgctgctgcttattgtgtcttatgcctccgcttgtagcgagctcatccaggcctctagccggattaccacatgctccaccgagggcgtcaacacaaagtgtagactgagcggaacggccctgatccgcgctggctctgttggggcggaagcctgcctcatgctgaagggagtgaaagaggaccagaccaagttccttaaaattaagacagtgtccagcgaactgtcctgccgggagggccaatcttactggaccgggagcttttcccccaaatgtctctctagcagacgctgccatctggtcggagaatgtcacgtgaatcggtgcctgtcctggagagataacgagacatctgctgagttcagctttgttggcgaatccaccacgatgcgcgagaataagtgtttcgaacagtgcgggggctggggatgtggctgctttaacgtgaatcccagctgtcttttcgtccacacctatctccagtctgtgcggaaggaggccctgagagtttttaactgcatcgactgggtgcataaactgacactcgaaatcaccgatttcgacgggtccgtcagcacagtggatctgggagcctcttccagccggttcaccaattggggctctgtttcccttagcctggacgctgaggggatttccggaagcaactcttttagcttcatcgagtcccctggcaaggggtacgccattgtggatgaaccgttttctgagatcccccgccagggcttcctcggagaaattagatgtaatagcgagtcctctgtcctgagcgcgcacgaatcctgcctgcgggctcctaaccttatctcttataaacccatgatcgaccaactcgagtgcacgacaaatctgattgatccttttgtggtgttcgagagaggcagcctgccccagacccgcaacgacaagacatttgccgcctccaaagggaaccggggagtccaggctttcagcaagggctctgttcaagccgatctcaccctgatgtttgacaatttcgaagtggactttgtgggggcggctgtctcctgtgatgccgccttccttaacctgaccggatgctacagctgtaatgctggcgccagagtgtgcctctctatcacatccacgggcaccgggacactgagcgctcataacaaggacggatccctgcacattgttcttccttctgagaatggcaccaaagatcagtgtcagatcctccattttacagtgcccgaagtcgaggaggaatttatgtacagctgcgacggggatgagcgcccgctgctggtgaagggaaccctcattgccatcgaccctttcgatgacagacgggaagcgggcggggagtccacggttgtgaaccccaaaagcggatcttggaatttcttcgattggttttccggcctgatgagctggttcggcgggcctcttaagacaatcctgctcatttgtctgtatgtcgccctgtctatcggactgtttttctttcttatttacctcggccgcaccgggctgagcaaaatgtggctcgctgccaccaagaaggcttcctga

SEQ ID NO: 14449 - RNA, 3594 nt, synthetic construct
  misc_feature 1..3594: note = derived and/or modified CDS sequence (opt5) from RVFV(KEN/Bar-032/07)__HM586968.1__GP
  source 1..3594: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccgtctctggaatcagagaagtgaagacaagctcccaggagctttatcgggccctgaaagcgattatcgctgccgacggcctcaataacatcacctgtcacgggaagaatccggaggataaaattagcctgatcaagggaccccctcataaaaagcgcgttggcattgtgagatgcgaacggcgcagagacgccaagcaaatcgggcgggagacaatggctggaattgccatgaccgtcctgcccgctctcgccgtgtttgcgctggcccctgttgtgttcgctgaagatccccaccttcgcaacagacctggcaaaggccataattacatcgacgggcggctgcaggaggatgccacatgtaagccggtcacctatgctggagcctgttcttcctttgacgtgctcctggaaaaaggcaagttccccctttttcagagctacgcgcaccatcgcacgctgctcgaggccgtgcacgataccattatcgctaaagccgaccctccctcttgcgatctgcagtccgctgacgggaacaagtgcatgaaggagaaactggtcatgaagacacactgtcctaatgattatcaaagcgcccattacctcaacaatgacggaaaaatggcctctgttaagtgtcccccgaaatatgaactgaccgaggactgcaacttctgcagacagatgacaggcgcttcccttaagaaagggagctaccctctgcaggatctcttttgccagtcctctgaagacgatggaagcaagctgaagaccaaaatgaagggcgtgtgtgaggtgggcgtccaagcgcttaaaaagtgcgacgggcagctgtccacggcccacgaagtggttcccttcgctgtgtttaaaaatagcaagaaggtctacctcgataaactggacctgaagacagaggagaacctcctgcctgattctttcgtgtgttttgaacataaaggacagtataagggcaccatggactccgggcagacaaaacgggagcttaagagcttcgatatctctcaatgccccaagattggaggccacgggagcaaaaagtgtaccggagacgccgccttttgctccgcttacgaatgtaccgcccagtatgcgaatgcttactgctctcacgccaacggcagcggcatcgttcagattcaagtgtccggggtctggaaaaagcccctgtgtgtgggatatgagcgcgtcgtggttaaaagagaactcagcgccaagcctatccagcgggtggagccgtgcacaacgtgtattaccaagtgcgagccccatggcctggtcgtgagatctacagggttcaaaatctccagcgctgttgcctgcgcttctggagtgtgtgtcaccggctcccagagcccttccacagaaatcacccttaagtaccccgggatttctcagagctccgtgggcgatatcggagtgcacatggcccatgacgaccaatctgttagctccaaaattgtcgcgcactgccctccccaggatccgtgtctggtgcatggctgcatcgtgtgtgcccacgggctcattaattatcagtgccacacggctctgagcgccttcgtcgtgatctttgttttctcttccacagctatcatttgtctggccgtgctctaccgcgtcctgaagtgccttaaaatcgcgcctcggaaggtgctgaaccccctcatgtggattaccgcctttatcagatgggtttacaaaaagatggtggctcgcgtcgccgacaacattaatcaggtgaaccgggagatcggatggatggaaggcgggcaactggctctgggaaatcctgcccccattcctagacatgcccccatcccgcgctatagcacctaccttatgctcctgctgatcgtttcttatgcttccgcgtgtagcgagctcattcaggcctctagccggatcacaacctgctccacagagggcgtgaacacgaagtgtagactgagccacaccgctcttattcgcgccgggtctgtcggcgccgaggcttgcctgatgctcaaaggagtgaaggaggatcagacaaaattcctgaagatcaaaaccgtgtccagcgaactgtcctgccgggagggccagtcttactggacagggagcttttcccctaagtgtctttctagcagacgctgccatctcgtcggagaatgtcacgttaatcggtgcctgtcctggagagacaacgagacctctgccgagttcagctttgtgggcgaatccacgaccatgcgggagaataagtgtttcgaacaatgcgggggatggggctgtgggtgctttaacgtgaatcccagctgtctgttcgtccacacatatctccagtctgtgcgcaaagaggcgctgagagtttttaactgcattgattgggtgcataaacttaccctggaaatcacagacttcgatggctccgtcagcaccatcgacctcggagcttcttccagccggtttacgaattggggctctgtgtccctgagcctggatgccgaggggatttccggaagcaactctttcagcttcatcgagtcccccggcaaggggtacgccattgttgacgaacctttttctgagatcccgagacagggattccttggcgaaattcgctgtaatagcgagtcctctgtgctcagcgctcacgaatcctgcctgcgggcccccaacctggtctcttataagcctatgatcgatcagctcgagtgcacaaccaatctgatcgacccctttgtggttttcgagagagggagccttcctcaaacacgcaacgataaaacctttgcggcttccaagggcaacagaggagtgcaggccttcagcaagggctctgtccaggccgacctgaccctccggtttgacaatttcgaagtggattttgtgggggctgccgtctcctgtgacgctgccttcctgaacctgacaggatgctacagctgtaatgcgggcgcccgcgtttgcctttctattacgtccaccgggacaggaaccctcagcgctcataacaaagatggctccctgcacatcgtgctgccctctgagaatggcacaaaggaccaatgtcagattctccattttaccgtgcctgaagtcgaggaggagttcatgtacagctgcgatggggacgaaagacccctgcttgtgaaaggaacgctgatcgccattgatccgtttgacgatcggcgcgaagctggcggggagtccacagttgtgaaccctaagagcggatcttggaatttcttcgactggttttccggcctcatgagctggttcgggggacccctgaaaaccatcctgcttatctgtctgtatgtcgccctctctattggcctgtttttcctcctgatctaccttggcagaaccgggctgagcaagatgtggctcgccgctacaaagaaagcgtcctga

SEQ ID NO: 14450 - RNA, 3594 nt, synthetic construct
  misc_feature 1..3594: note = derived and/or modified CDS sequence (opt5) from RVFV(KEN/Gar-004/06)__HM586964.1__GP
  source 1..3594: mol_type = other RNA
atgtacgtgctgctcacaatcctgattagcgtctgggtttgcgaggccgtgatcagagtgtccctttctagcacacgggaagagacgtgtttcggcgactccaccaaccccgaaatgattgagggggcttgggattctctgcgcgaagaggagatgcctgaagaactcagctgctccgtctctggaatcagagaagtgaagacaagctcccaggagctgtatcgggcccttaaagcgattatcgctgccgacggcctgaataacatcacctgtcacgggaagaatccggaggataaaattagcctcatcaagggaccccctcataaaaagcgcgttggcattgtgagatgcgaacggcgcagagacgccaagcaaatcgggcgggagacaatggctggaattgccatgaccgtcctgcccgctctggccgtgtttgcgctcgcccctgttgtgttcgctgaagatccccatctgcgcaacagacctggcaaaggccacaattacatcgacgggatgacacaggaggatgccacctgtaagccggtcacgtatgctggagcctgttcttcctttgacgtgcttctggaaaaaggcaagttccccctctttcagagctacgcgcaccatcggaccctgcttgaggccgtgcacgatacaattatcgctaaagccgaccctccctcttgcgatctgcagtccgctcacgggaacccttgcatgaaggagaagctcgtcatgaaaacccattgtcccaatgactatcaaagcgcccactacctgaacaatgatggaaagatggcctctgttaaatgcccgcctaagtatgaactgacagaggactgtaacttctgccgccagatgaccggcgcttccctcaaaaaggggagctaccccctgcaggaccttttctgccagtcctctgaagatgacggaagcaaactgaagacgaagatgaaaggcgtgtgtgaggtgggcgtccaagcgctcaagaaatgcgatgggcagctgtccacagcccatgaagtggttcctttcgctgtgtttaagaatagccagaaagtctaccttgacaagctggatctcaagaccgaggagaacctgctgcccgactctttcgtgtgttttgaacacaaaggacagtataagggcacaatggattccgggcaaaccaaaagagagctcaagagcttcgacatctctcagtgccccaaaattggaggccacgggcggaagaagcgcaccggagatgccgccttttgtagcgcttacgaatgcacagcccagtatgcgaatgcttactgttccagagccaacggctctggcatcgttcaaattcaggtgagccgggtctggaaaaagcctctgtgcgtggggtatgagagagtcgtggttaaacgcgaactttccgccaagccgatccagcgggtggagccctgtacgacctgcattacaaaatgtgagcctcatggactggtcgtgagaagcaccggcttcaagatctcttccgctgttgcctgcgctagcggggtgtgcgtcacaggatctcagtcccccagcaccgaaatcacgctcaagtaccctggcatttcccaatctagcgggggcgacatcggagtgcacatggcccatgatgaccagtccgtgtctagcaaaattgttgcgcactgtcccccgcaggacccttgcctggtccatggctgtatcgtgtgcgcccacgggcttattaataaccagtcccacagcgctctgtctgccttcgtggtcatctttgtgttctccagcacagctatcatttgtctcgccgttctgtatcgcgtgctgaagtgcctcaaaatcgcgccccggaaggtcctgaaccctcttatgtggattaccgcctttatcagatgggtgtacaaaaagatggttgctcgcgtggccgataatattaaccaagtcaatcgggagatcggatggatggaaggcgggcagctggctctcggaaaccccgcccctattcccagacatgccccgatccctcgctactctacctatctgatgctgcttctcatcgtgtcctacgctagcgcgtgttctgagctgattcaggccagctcccggatcacaacctgcagcacagagggcgttaatacgaaatgtagactgtctgggaccgctctcattcgcgccggctccgtgggagccgaggcttgcctgatgcttaagggcgtcaaggaggaccagacaaaattcctgaagatcaaaaccgtgagctccgaactctcttgtcgggaggggcaaagctattggacaggatccttttctcccaagtgcctgagctccagacggtgccacctggtgggcgaatgtcatgtcaaccgctgcctttcttggagagataatgagaccagcgccgagttctcctttgttggggaaagcacgaccatgcgggagaacaaatgtttcgaacagtgcggaggctgggggtgtggctgctttaatgtgaacccctcttgtctcttcgtgcacacatacctgcagtccgtcagaaaggaggcgctgcgcgtgtttaattgcattgactgggttcacaagctcaccctggaaatcacagatttcgacggaagcgtgtctaccatcgatcttggcgcttccagctctcggtttacgaactgggggtccgtcagcctgtccctcgacgccgagggaattagcggctctaatagcttctccttcatcgagtctcctgggaaaggatatgccattgtggatgaaccgtttagcgagatccccagacagggcttcctgggggaaattcgctgtaactccgagtctagcgttctgtccgctcatgaatcttgccttagagcccctaatctcgtgagctacaagcccatgatcgaccaactggagtgtacaaccaacctgatcgatccttttgtcgtgttcgagcggggctccctcccccagacacgcaacgacaaaacctttgcggctagcaagggaaatagaggcgttcaggccttctctaaagggtccgtgcaagccgatctgacccttcggtttgacaacttcgaagtcgactttgtgggagctgccgtgagctgcgatgctgccttcctgaatctcacaggctgctattcttgtaacgcgggggcccgcgtctgcctgtccattacgagcaccggaacaggcaccctgtccgctcacaataaggacggctctcttcatatcgttctccctagcgagaacgggacaaaggatcagtgtcagattctgcactttaccgtgcccgaagtggaggaggaatttatgtactcctgcgacggagatgagagaccgctgctcgtcaaaggcacgctgatcgccattgacccttttgatgaccggcgcgaagctgggggagagagcacagtggttaatcccaagtctggctcctggaacttcttcgattggtttagcgggcttatgtcttggttcggaggccctctgaaaaccatcctcctgatctgtctgtacgtggcccttagcattggcctgtttttcctcctgatctatctcgggagaaccggactgtccaagatgtggcttgccgctaccaaaaaggcgtcttga

SEQ ID NO: 14451 - RNA, 3621 nt, synthetic construct
  misc_feature 1..3621: note = derived and/or modified CDS sequence (opt5) from RVFV(RVFV)__M11157.1__GP
  source 1..3621: mol_type = other RNA
atgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaggaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctccagtccgctcacgggaatccttgcatgaaggagaagctggtgatgaaaacccattgtcccaacgattatcaaagcgcccactacctgaataacgacggaaagatggcctctgtcaaatgcccgcctaagtatggcctcacagaagactgtaatttctgccgccagatgaccggggcttccctgaaaaagggaagctacccccttcaggatctgttttgccagtcctctgaggacgatggcagcaaactcaagacgaagatgaaaggcgtttgtgaagtgggggtgcaagcgcataagaaatgcgacggacagctgtccacagcccacgaggtcgtgcctttcgctgtttttaagaacagcaaaaaggtgtaccttgataagctggacctcaaaaccgaagagaatctgctgcccgattctttcgtctgttttgagcacaagggccagtataaagggacaatggactccggacagaccaagagagaactcaaatctttcgatatttctcaatgccccaagatcggcgggcatggaagcaagaaatgtaccggcgacgccgccttttgctccgcttacgagtgtacagcccagtatgcgaacgcttactgctctcacgccaatggcagcgggattgtgcagatccaagtttccggagtgtggaagaaacctctgtgtgtcggctatgaacgggtggtcgtgaagcgcgagcttagcgccaaaccgattcagagagttgaaccctgcacgacctgtatcacaaagtgcgagcctcatgggctggtggtccggtctaccggattcaagatctccagcgctgtggcctgcgcttctggcgtttgtgtgacagggtcccagagcccctccaccgagattacgctcaaataccctggcatctctcagagctccggaggcgatattggggtccacatggcccatgacgaccaatctgtgagctccaagatcgtggcgcactgtcccccgcaggatccttgcctggttcacggatgcattgtctgtgcccatggccttatcaactatcagtgccacacagctctgagcgccttcgtggtggtctttgtgttctcttccatcgctattatctgtctcgccgttctgtacagagtgctgaaatgcctcaagattgcgccccgcaaagtcctgaatcctcttatgtggatcaccgcctttattcggtggatctacaagaaaatggtggctagagttgcccataacattaaccaggtgaatcgcgaaatcgggtggatggagggaggccaactggtcctcgggaaccccgctcctatcccccggcacgccccgattcctagatatagcacctacctgatgctgcttctcatcgtgtcttatgcctccgcttgtagcgaactgattcaggcgtctagccgcatcacaacctgctccacagagggcgttaatacgaagtgtcggctgagcggaaccgccctcattagagctggctctgtgggggccgaggcctgcctgatgcttaagggagtcaaagaagaccagacaaagttcctgaaaatcaagaccgtgtccagcgagctctcctgccgcgaaggccagtcttactggacagggagcatctcccccaaatgtctgtctagccggagatgccacctggtgggagagtgtcatgtcaaccgctgcctttcctggcgggataatgaaacctctgctgagtttagcttcgttggcgagtccacgaccatgagagaaaacaagtgttttgagcaatgcgggggctggggatgtggctgcttcaatgtgaaccccagctgtctctttgtgcacacatatctgcagtctgtccggaaggaagccctgcgcgtgttcaattgcattgactgggttcataaactcaccctggagatcacagattttgacgggtccgtgagcaccattgatcttggagcgtcttccagcagattcacgaactggggctctgtctccctgagcctcgacgctgaagggatctccggaagcaattcttttagcttcattgagtccccttctaagggctacgccatcgtggatgagccgttcagcgaaatcccccggcaggggtttctgggcgagattagatgtaactccgaatctagcgttctgtccgcccacgagtcttgccttcgcgctcctaatctcatcagctataaacccatgattgaccagctggaatgcacaaccaacctgatcgatcctttcgtggtctttgagcggggatccctcccccaaacaagaaatgacaagaccttcgccgcgagcaaaggcaaccgcggggtgcaggctttttctaagggatccgttcaggccgatctgacccttatgttcgacaactttgaggtggacttcgtcggcgccgctgtgagctgtgatgccgcttttctgaatctcacagggtgctactcttgtaacgccggagcgagagtgtgcctgtccattacgagcaccggcacaggctccctgtctgcccataataaggacgggagccttcacatcgtcctcccttccgaaaacggaaccaaagatcaatgtcagatcctgcacttcacagttcccgaggtggaagaggagtttatgtacagctgcgacggcgatgaacggccgctgctcgtgaaggggaccctgattgctatcgaccctttcgatgaccgcagagaggccggaggcgaatctacggtcgtgaatcccaaatccgggagctggaactttttcgattggttctctggacttatgagctggtttggcggccctctgaagctctattcctctttcgcttgtatgctgcattaccagctggggagcttttcctctctttatattctggaggaacaggccagcctcaaatgcggactgctccccctgcggcgcccgcacagatccgttcgggtgaaggtcatctgttga

SEQ ID NO: 14452 - RNA, 3480 nt, synthetic construct
  misc_feature 1..3480: note = derived and/or modified CDS sequence (opt5) from RVFV(ZH-548)__DQ380206.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgctcagcgcccacggcaacccctgcatgaaggaaaagctggtgatgaaaacccattgtcctaatgactaccagtctgctcactatcttaacaatgatgggaagatggcctccgttaaatgtcccccgaagtacgagctgacggaagactgcaacttttgcagacaaatgaccggagccagcctcaaaaagggctcttatcctctgcaggacctgttctgtcagtccagcgaggatgacgggtctaaactcaagacaaagatgaaaggagtgtgcgaggtcggcgtgcaggctctgaagaaatgcgatggccaactttccaccgcgcatgaagtggtcccctttgccgttttcaagaatagcaaaaaggtgtacctggacaagctcgatctgaaaacagaggaaaaccttctgcctgactcctttgtgtgtttcgagcacaaggggcagtacaaaggaaccatggattctggccagacgaagcgggaactcaaatcctttgacatttcccagtgccccaagatcgggggacacggcagcaagaaatgtacaggggatgctgccttctgctctgcctatgagtgtaccgctcaatacgccaatgcgtattgctcccatgctaacggaagcggcatcgtccagattcaggtgtctggcgtttggaagaaacccctgtgtgtggggtacgagcgcgtcgtggttaagagagaactgagcgccaaacctatccaacgggtggagccgtgcacaacctgtattaccaagtgcgaaccccacggactcgtcgtgcgctccacaggctttaagatctctagcgccgtcgcttgtgcctccggggtgtgcgttacgggaagccagtctccttccaccgagattacactgaaatatcccggcatcagccagtcttccgggggcgacatcggagtgcatatggctcacgatgaccagagcgtctcctctaagattgtggcccattgccctccccaagacccgtgtcttgttcacgattgcatcgtgtgtgcgcacggcctgattaattaccagtgccataccgccctcagcgctttcgtcgtggtgttcgtttttagctctatcgccattatctgtctggctatcctttatagagtcctgaaatgcctcaagattgcccctcggaaagtgctgaaccccctgatgtggatcacagcgttcattagatggatctacaagaaaatggtggcccgcgtcgctgacaatattaaccaggtgaaccgggaaatcgggtggatggagggaggccagctcgttctggggaatcctgcccccattcctagacacgctcccatcccgcgctacagcacctatcttatgctgctcctgatcgtgtcctacgccagcgcctgttctgagctgattcaggcttccagccggatcacgacatgctctaccgaaggagtcaacaccaagtgtagactttccggcacagcgctcattcgcgccgggagcgtgggcgctgaggcctgcctgatgctgaagggagttaaagaagatcaaaccaagtttctcaaaatcaagacagtgtctagcgagctgtcctgtcgggagggccagagctattggacggggtctttctcccctaaatgccttagctccagacgctgccatctggtcggagaatgtcacgtgaatcggtgcctctcttggagagacaacgagaccagcgccgaattttccttcgttggcgagtctacaaccatgcgcgaaaataagtgttttgagcagtgcgggggatggggctgtgggtgcttcaacgtgaatcccagctgtctgtttgtccacacatacctgcaatccgtgcggaaggaggctcttagagtgttcaactgcattgattgggtccataaactcaccctggaaatcacggactttgatggctctgttagcaccatcgacctgggagcctccagctctcggttcacaaattggggctccgtgagcctctctctggatgcggaggggatttccggaagcaactctttttccttcatcgaaagccccggcaaggggtatgctattgtggacgagcctttctccgaaatcccgcgccagggatttcttggcgagattagatgtaatagcgagtctagcgtcctgtccgcccacgaatcttgcctccgggcccccaacctgatcagctacaaacctatgatcgatcagctggagtgtaccacaaatcttattgaccccttcgtggtttttgaaagagggtccctccctcagacccgcaacgataagacgttcgctgcctctaaaggcaatcggggagtgcaagcgtttagcaagggctccgtccaggctgacctgacactgatgttcgacaactttgaggtggatttcgttggggccgccgtgtcttgcgacgctgcctttctcaacctgaccggatgctatagctgtaatgctggcgccagagtctgcctttccatcacaagcaccgggaccggatctctgtccgcgcataacaaggatggcagcctccacattgtgctgccctctgaaaatggcacaaaagaccagtgtcaaatcctgcatttcacggttcctgaggtggaggaagagtttatgtactcctgcgatggggacgaacgcccccttctcgtcaagggaaccctgattgccatcgatccgttcgacgatagacgggaggctggcggggagagcacagtggtgaaccctaaatccggatcttggaactttttcgactggttcagcggcctgatgtcctggtttgggggacccctcaagaccatcctgcttatttgtctgtacgtcgccctcagcatcggcctgttctttctgcttatttatctgggccgcacagggctctctaaaatgtggctggctgccaccaagaaggcctcctga

SEQ ID NO: 14453 - RNA, 3480 nt, synthetic construct
  misc_feature 1..3480: note = derived and/or modified CDS sequence (opt5) from RVFV(ZS-6365)__DQ380205.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggattctggccagacgaagcgggaactgaaatcctttgacatttcccaatgccccaagatcgggggacacggcagcaagaaatgtacaggggatgctgccttctgctctgcctatgagtgtaccgctcagtacgccaatgcgtattgctcccatgctaacggaagcggcatcgtccagattcaagtgtctggcgtttggaagaaacccctctgtgtggggtacgagcgcgtcgtggttaagagagaactgagcgccaaacctatccagcgggtggagccgtgcacaacctgtattaccaagtgcgaaccccacggactggtcgtgcgctccacaggctttaagatctctagcgccgtcgcttgtgcctccggggtgtgcgttacgggaagccagtctccttccaccgagattacactcaaatatcccggcatcagccagtcttccgggggcgacatcggagtgcatatggctcacgatgaccaaagcgtctcctctaagattgtggcccattgccctccccaggacccgtgtctggttcacggctgcatcgtgtgtgcgcacgggcttattaattaccagtgccataccgccctgagcgctttcgtcgtggtgttcgtttttagctctatcgccattatctgtctcgctatcctgtatagagtccttaaatgcctgaagattgcccctcggaaagtgctcaaccccctgatgtggatcacagcgttcattagatggatctacaagaaaatggtggcccgcgtcgctgataatattaaccaggtgaaccgggaaatcggatggatggagggcgggcaactggttctcggaaatcctgcccccattcctagacacgctcccatcccgcgctacagcacctatctgatgcttctgctcatcgtgtcctacgccagcgcctgttctgagctgattcaggcttccagccggatcacgacatgctctaccgaaggcgtcaacaccaagtgtagactgtccgggacagcgcttattcgcgccggcagcgtgggagctgaggcctgcctcatgctgaagggcgttaaagaagaccagaccaagtttctgaaaatcaagacagtgtctagcgagctctcctgtcgggaggggcagagctattggacgggatctttctcccctaaatgcctgagctccagacgctgccatcttgtcggcgaatgtcacgtgaatcggtgcctgtcttggagagataacgagaccagcgccgaattttccttcgttggggagtctacaaccatgcgcgaaaataagtgttttgagcaatgcggaggctgggggtgtggctgcttcaacgtgaatcccagctgtctctttgtccacacatacctgcagtccgtgcggaaggaggctctgagagtgttcaactgcattgactgggtccataaacttaccctcgaaatcacggattttgacggatctgttagcaccatcgatctgggcgcctccagctctcggttcacaaattgggggtccgtgagcctgtctctcgacgcggagggaatttccggcagcaactctttttccttcatcgaaagccccgggaagggatatgctattgtggatgagcctttctccgaaatcccgcgccagggctttctgggggagattagatgtaatagcgagtctagcgtcctttccgcccacgaatcttgcctgcgggcccccaacctcatcagctacaaacctatgatcgaccagctggagtgtaccacaaatctgattgatcccttcgtggtttttgaaagaggctcccttcctcaaacccgcaacgacaagacgttcgctgcctctaaaggaaatcggggcgtgcaggcgtttagcaaggggtccgtccaggctgatctcacactgatgttcgacaactttgaggtggacttcgttggagccgccgtgtcttgcgatgctgcctttctgaacctcaccggctgctatagctgtaatgctggggccagagtctgcctgtccatcacaagcaccggaaccggctctctttccgcgcataacaaggacggcagcctgcacattgtgctcccctctgaaaatgggacaaaagatcaatgtcagatcctgcatttcacggttcctgaggtggaggaagagtttatgtactcctgcgacggagatgaacgccccctgcttgtcaagggcaccctcattgccatcgacccgttcgatgacagacgggaggctgggggagagagcacagtggtgaaccctaaatccggctcttggaactttttcgattggttcagcgggctgatgtcctggtttggaggccccctgaagaccatcctcctgatttgtctttacgtcgccctgagcatcggcctcttctttctgctgatttatcttgggcgcacaggactgtctaaaatgtggctcgctgccaccaagaaggcctcctga

SEQ ID NO: 14454 - RNA, 3480 nt, synthetic construct
  misc_feature 1..3480: note = derived and/or modified CDS sequence (opt5) from RVFV(MP-12)__DQ380208.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgctcagcgcccacggcaacccctgcatgaaggaaaagctggtgatgaaaacccattgtcctaatgactaccagtctgctcaccatcttaacaatgatgggaagatggcctccgttaaatgtcccccgaagtatgagctgacggaagactgcaacttttgcagacaaatgaccggagccagcctcaaaaagggctcttaccctctgcaggacctgttctgtcagtccagcgaggatgacgggtctaaactcaagacaaagatgaaaggagtgtgcgaggtcggcgtgcaggctctgaagaaatgcgatggccaactttccaccgcgcacgaagtggtcccctttgccgttttcaagaatagcaaaaaggtgtatctggacaagctcgatctgaaaacagaggaaaaccttctgcctgactcctttgtgtgtttcgagcacaaggggcagtacaaaggaaccatggattctggccagacgaagcgggaactcaaatcctttgacatttcccagtgccccaagatcgggggacatggcagcaagaaatgtacaggggatgctgccttctgctctgcctacgagtgtaccgctcaatatgccaatgcgtactgctcccacgctaacggaagcggcatcgtccagattcaggtgtctggcgtttggaagaaacccctgtgtgtggggtatgagcgcgtcgtggttaagagagaactgagcgccaaacctatccaacgggtggagccgtgcacaacctgtattaccaagtgcgaaccccatggactcgtcgtgcgctccacaggctttaagatctctagcgccgtcgcttgtgcctccggggtgtgcgttacgggaagccagtctccttccaccgagattacactgaaataccccggcatcagccagtcttccgggggcgacatcggagtgcacatggctcatgatgaccagagcgtctcctctaagattgtggcccactgccctccccaagacccgtgtcttgttcacgattgcatcgtgtgtgcgcatggcctgattaattatcagtgccacaccgccctcagcgctttcgtcgtggtgttcgtttttagctctatcgccattatctgtctggctatcctttacagagtcctgaaatgcctcaagattgcccctcggaaagtgctgaaccccctgatgtggatcacagcgttcattagatggatctataagaaaatggtggcccgcgtcgctgacaatattaaccaggtgaaccgggaaatcgggtggatggagggaggccagctcgttctggggaatcctgcccccattcctagacatgctcccatcccgcgctacagcacctaccttatgctgctcctgatcgtgtcctatgccagcgcctgttctgagctgattcaggcttccagccggatcacgacatgctctaccgaaggagtcaacaccaagtgtagactttccggcacagcgctcattcgcgccgggagcgtgggcgctgaggcctgcctgatgctgaagggagttaaagaagatcaaaccaagtttctcaaactgaagacagtgtctagcgagctttcctgtcgggagggccagagctactggacggggtctttctcccctaaatgcctgagctccagacgctgccacctcgtcggagaatgtcacgtgaatcggtgcctgtcttggagagacaacgagaccagcgccgaattttccttcgttggcgagtctacaaccatgcgcgaaaataagtgttttgagcagtgcgggggatggggctgtgggtgcttcaacgtgaatcccagctgtctgtttgtccatacatatcttcaatccgtgcggaaggaggctctcagagtgttcaactgcatcgattgggtccacaaactgaccctggaaattacggactttgatggctctgttagcaccatcgacctcggagcctccagctctcggttcacaaattggggctccgtgagcctgtctcttgatgcggaggggatctccggaagcaactctttttccttcattgaaagccccggcaaggggtacgctatcgtggacgagcctttctccgaaattccgcgccagggatttctgggcgagatcagatgtaatagcgagtctagcgtcctctccgcccatgaatcttgcctgcgggcccccaacctgattagctataaacctatgatcgatcagcttgagtgtaccacaaatctcatcgaccccttcgtggtttttgaaagagggtccctgcctcagacccgcaacgataagacgttcgctgcctctaaaggcaatcggggagtgcaagcgtttagcaagggctccgtccaggctgacctgacactcatgttcgacaactttgaggtggatttcgttggggccgccgtgtcttgcgacgctgcctttctgaaccttaccggatgctacagctgtaatgctggcgccagagtctgcctgtccattacaagcaccgggaccggatctctctccgcgcacaacaaggatggcagcctgcatatcgtgctgccctctgaaaatggcacaaaagaccagtgtcaaattcttcacttcacggttcctgaggtggaggaagagtttatgtattcctgcgatggggacgaacgccccctcctggtcaagggaaccctgatcgccattgatccgttcgacgatagacgggaggctggcggggagagcacagtggtgaaccctaaatccggatcttggaactttttcgactggttcagcggcctcatgtcctggtttgggggacccctgaagaccatccttctgatctgtctctacgtcgccctgagcattggcctgttctttcttctgatctacctcggcgggacaggactgtctaaaatgtggctcgctgccaccaagaaggcctcctga

SEQ ID NO: 14455 - RNA, 3480 nt, synthetic construct
  misc_feature 1..3480: note = derived and/or modified CDS sequence (opt5) from RVFV(T1)__DQ380201.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggattctggccagacgaagcgggaactgaaatcctttgacatttcccaatgccccaagatcgggggacacggcagcaagaaatgtacaggggatgctgccttctgctctgcctatgagtgtaccgctcagtacgccaatgcgtattgctcccatgctaacggaagcggcatcgtccagattcaagtgtctggcgtttggaagaaacccctctgtgtggggtacgagcgcgtcgtggttaagagagaactgagcgccaaacctatccagcgggtggagccgtgcacaacctgtattaccaagtgcgaaccccacggactggtcgtgcgctccacaggctttaagatctctagcgccgtcgcttgtgcctccggggtgtgcgttacgggaagccagtctccttccaccgagattacactcaaatatcccggcatcagccagtcttccgggggcgacatcggagtgcatatggctcacgatgaccaaagcgtctcctctaagattgtggcccattgccctccccaggacccgtgtctggttcacggctgcatcgtgtgtgcgcacgggcttattaattaccagtgccataccgccctgagcgctttcgtcgtggtgttcgtttttagctctatcgccattatctgtctcgctgtcctgtatagagtgcttaaatgcctgaagatcgcccctcggaaagtgctcaaccccctgatgtggattacagcgttcatcagatggatttacaagaaaatggtcgcccgcgtggctgataatatcaaccaggttaaccgggaaattggatggatggagggcgggcaactggtgctcggaaatcctgcccccatccctagacacgctcccattccgcgctacagcacctatctgatgcttctgctcatcgtctcctacgccagcgcctgttctgagctgatccaggcttccagccggattacgacatgctctaccgaaggcgtgaacaccaagtgtagactgtccgggacagcgcttatccgcgccggcagcgttggagctgaggcctgcctcatgctgaagggcgtgaaagaagaccagaccaagtttctgaaaattaagacagtctctagcgagctctcctgtcgggaggggcagagctattggacgggatctttctcccctaaatgcctgagctccagacgctgccatcttgtgggcgaatgtcacgttaatcggtgcctgtcttggagagataacgagaccagcgccgaattttccttcgtgggggagtctacaaccatgcgcgaaaataagtgttttgagcaatgcggaggctgggggtgtggctgcttcaacgtcaatcccagctgtctctttgtgcacacatacctgcagtccgtgcggaaggaggctctgagagtcttcaactgcatcgactgggttcataaacttaccctcgaaattacggattttgacggatctgtgagcaccatcgatctgggcgcctccagctctcggttcacaaattgggggtccgtgagcctgtctctcgacgcggagggaatctccggcagcaactctttttccttcattgaaagccccgggaagggatatgctatcgtcgatgagcctttctccgaaattccgcgccagggctttctgggggagatcagatgtaatagcgagtctagcgtgctttccgcccacgaatcttgcctgcgggcccccaacctcattagctacaaacctatgatcgaccagctggagtgtaccacaaatctgatcgatcccttcgttgtgtttgaaagaggctcccttcctcaaacccgcaacgacaagacgttcgctgcctctaaaggaaatcggggcgtccaggcgtttagcaaggggtccgtgcaggctgatctcacactgatgttcgacaactttgaggttgacttcgtgggagccgccgtctcttgcgatgctgcctttctgaacctcaccggctgctatagctgtaatgctggggccagagtgtgcctgtccattacaagcaccggaaccggctctctttccgcgcataacaaggacggcagcctgcacatcgttctcccctctgaaaatgggacaaaagatcaatgtcagattctgcatttcacggtgcctgaggtcgaggaagagtttatgtactcctgcgacggagatgaacgccccctgcttgtgaagggcaccctcatcgccattgacccgttcgatgacagacgggaggctgggggagagagcacagtggtcaaccctaaatccggctcttggaactttttcgattggttcagcgggctgatgtcctggtttggaggccccctgaagaccatcctcctgatctgtctttacgttgccctgagcattggcctcttctttctgctgatctatcttgggcgcacaggactgtctaaaatgtggctcgctgccaccaagaaggcctcctga

SEQ ID NO: 14456 - RNA, 3480 nt, synthetic construct
  misc_feature 1..3480: note = derived and/or modified CDS sequence (opt5) from RVFV(1853/78)__DQ380220.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggattctggccagacgaagcgggaactgaaatcctttgacattagccaatgccccaagatcgggggacacggcagcaagaaatgtacaggggatgctgccttctgctctgcctatgagtgtaccgctcagtacgccaatgcgtattgctcccatgctaacggaagcggcgtcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgacatcggagtccatatggctcacgatgaccaaagcgtgtcctctaagatcgttgcccattgccctccccaggacccgtgtctggtgcacggctgcattgtctgtgcgcacgggcttatcaattaccagtgccataccgccctgagcgctttcgtggtggttttcgtcttttcctctattgccatcatttgtctcgctatcctgtatagagtgcttaaatgcctgaagatcgcccctcggaaagtgctcaaccccctgatgtggattacagcgttcatcagatgggtctacaagaaaatggtggcccgcgttgctgataatattaaccaggtgaaccgggaaatcggatggatggagggcgggcaactggtcctcggaaatcctgcccccattcctagacacgctcccatcccgcgctacagcacctatctgatgcttctgctcattgtgtcctacgccagcgcctgttctgagctgatccaggcttccagccggatcacgacatgctctaccgaaggcgttaacaccaagtgtagactgtccgggacagcgcttattcgcgccggcagcgtgggagctgaggcctgcctcatgctgaagggcgtcaaagaagaccagaccaagtttctgaaaatcaagacagtgtctagcgagctctcctgtcgggaggggcagagctattggacgggatctttctcccctaaatgcctgagctccagacgctgccatcttgttggcgaatgtcacgtgaatcggtgcctgtcttggagagataacgagaccagcgccgaattttccttcgtcggggagtctacaaccatgcgcgaaaataagtgttttgagcaatgcggaggctgggggtgtggctgcttcaacgtgaatcccagctgtctctttgtgcacacatacctgcagtccgtccggaaggaggctctgagagttttcaactgcattgactgggtgcataaacttaccctcgaaatcacggattttgacggatctgtgagcaccattgatctgggcgcctccagctctcggttcacaaattgggggtccgtcagcctgtctctcgacgcggagggaatctccggcagcaactctttttccttcatcgaaagccccgggaagggatatgctattgtggatgagcctttctccgaaatcccgcgccagggctttctgggggagattagatgtaatagcgagtctagcgttctttccgcccacgaatcttgcctgcgggcccccaacctcatcagctacaaacctatgattgaccagctggagtgtaccacaaatctgatcgatcccttcgtggtctttgaaagaggctcccttcctcaaacccgcaacgacaagacgttcgctgcctctaaaggaaatcggggcgtgcaggcgtttagcaaggggtccgttcaggctgatctcacactgatgttcgacaactttgaggtggacttcgtcggagccgccgtgtcttgcgatgctgcctttctgaacctcaccggctgctatagctgtaatgctggggccagagtttgcctgtccatcacaagcaccggaaccggcacactttctgcgcataacaaggacggctccctgcacattgtgctccccagcgaaaatgggacgaaagatcaatgtcagatcctgcatttcaccgtccctgaggtggaggaagagtttatgtactcttgcgacggagatgaacgccccctgcttgtgaagggcacactcattgccatcgacccgttcgatgacagacgggaggctgggggagagtccaccgtcgttaaccctaaaagcggctcctggaactttttcgattggttctctgggctgatgagctggtttggaggccccctgaagacaattctcctgatctgtctttacgtggccctgtccatcggcctcttctttctgctgatttatcttgggcgcaccggactgagcaaaatgtggctcgctgccacgaagaaggcctcttga

SEQ ID NO: 14457 - RNA, 3480 nt, synthetic construct
  misc_feature 1..3480: note = derived and/or modified CDS sequence (opt5) from RVFV(CAR-R1622)__DQ380219.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggattctggccagacgaagcgggaactgaaatcctttgacatttcccaatgccccaagatcgggggacacggcagcaagaaatgtacaggggatgctgccttctgctctgcctatgagtgtaccgctcagtacgccaatgcgtattgctcccatgctaacggaagcggcatcgtccagattcaagtgtctggcgtttggaagaaacccctctgtgtggggtacgagcgcgtcgtggttaagagagaactgagcgccaaacctatccagcgggtggagccgtgcacaacctgtattaccaagtgcgaaccccacggactggtcgtgcgctccacaggctttaagatctctagcgccgtcgcttgtgcctccggggtgtgcgttacgggaagccagtctccttccaccgagattacactcaaatatcccggcatcagccagtcttccgggggcgacatcggagtgcatatggctcacgatgaccaaagcgtctcctctaagattgtggcccattgccctccccaggacccgtgtctggttcacggctgcatcgtgtgtgcgcacgggcttattaattaccagtgccataccgccctgagcgctttcgtcgtggtgttcgtttttagctctatcgccattatctgtctcgctatcctgtatagagtccttaaatgcctgaagattgcccctcggaaagtgctcaaccccctgatgtggatcacagcgttcattagatgggtgtacaagaaaatggtcgcccgcgtggctgataatatcaaccaggttaaccgggaaattggatggatggagggcgggcaactggtgctcggaaatcctgcccccatccctagacacgctcccattccgcgctacagcacctatctgatgcttctgctcatcgtctcctacgccagcgcctgttctgagctgatccaggcttccagccggattacgacatgctctaccgaaggcgtgaacaccaagtgtagactgtccgggacagcgcttatccgcgccggcagcgttggagctgaggcctgcctcatgctgaagggcgtgaaagaagaccagaccaagtttctgaaaattaagacagtctctagcgagctctcctgtcgggaggggcagagctattggacgggatctttctcccctaaatgcctgagctccagacgctgccatcttgtgggcgaatgtcacgttaatcggtgcctgtcttggagagataacgagaccagcgccgaattttccttcgtgggggagtctacaaccatgcgcgaaaataagtgttttgagcaatgcggaggctgggggtgtggctgcttcaacgtcaatcccagctgtctctttgtgcacacatacctgcagtccgtgcggaaggaggctctgagagtcttcaactgcatcgactgggttcataaacttaccctcgaaattacggattttgacggatctgtgagcaccatcgatctgggcgcctccagctctcggttcacaaattgggggtccgtgagcctgtctctcgacgcggagggaatctccggcagcaactctttttccttcattgaaagccccgggaagggatatgctatcgtcgatgagcctttctccgaaattccgcgccagggctttctgggggagatcagatgtaatagcgagtctagcgtgctttccgcccacgaatcttgcctgcgggcccccaacctcattagctacaaacctatgatcgaccagctggagtgtaccacaaatctgatcgatcccttcgttgtgtttgaaagaggctcccttcctcaaacccgcaacgacaagacgttcgctgcctctaaaggaaatcggggcgtccaggcgtttagcaaggggtccgtgcaggctgatctcacactgatgttcgacaactttgaggttgacttcgtgggagccgccgtctcttgcgatgctgcctttctgaacctcaccggctgctatagctgtaatgctggggccagagtgtgcctgtccattacaagcaccggaaccggcacactttctgcgcataacaaggacggctccctgcacatcgttctccccagcgaaaatgggacgaaagatcaatgtcagattctgcatttcaccgtgcctgaggtcgaggaagagtttatgtactcttgcgacggagatgaacgccccctgcttgtgaagggcacactcatcgccattgacccgttcgatgacagacgggaggctgggggagagtccaccgtggtcaaccctaaaagcggctcctggaactttttcgattggttctctgggctgatgagctggtttggaggccccctgaagacaatcctcctgatctgtctttacgttgccctgtccattggcctcttctttctgctgatctatcttgggcgcaccggactgagcaaaatgtggctcgctgccacgaagaaggcctcttga

SEQ ID NO: 14458 - RNA, 3480 nt, synthetic construct
  misc_feature 1..3480: note = derived and/or modified CDS sequence (opt5) from RVFV(2250/74)__DQ380209.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggattctggccagacgaagcgggaactgaaatcctttgacatttcccaatgccccaagatcgggggacacggcagcaagaaatgtacaggggatgctgccttctgctctgcctatgagtgtaccgctcagtacgccaatgcgtattgctcccatgctaacggaagcggcatcgtccagattcaagtgtctggcgtttggaagaaacccctctgtgtggggtacgagcgcgtcgtggttaagagagaactgagcgccaaacctatccagcgggtggagccgtgcacaacctgtattaccaagtgcgaaccccacggactggtcgtgcgctccacaggctttaagatctctagcgccgtcgcttgtgcctccggggtgtgcgttacgggaagccagtctccttccaccgagattacactcaaatatcccggcatcagccagtcttccgggggcgacatcggagtgcatatggctcacgatgaccaaagcgtctcctctaagattgtggcccattgccctccccaggacccgtgtctggttcacggctgcatcgtgtgtgcgcacgggcttattaattaccagtgccataccgccctgagcgctttcgtcgtggtgttcgtttttagctctatcgccattatctgtctcgctatcctgtatagagtccttaaatgcctgaagattgcccctcggaaagtgctcaaccccctgatgtggatcacagcgttcattagatggatctacaagaaaatggtggcccgcgtcgctgataatattaaccaggtgaaccgggaaatcggatggatggagggcgggcaactggttctcggaaatcctgcccccattcctagacacgctcccatcccgcgctacagcacctatctgatgcttctgctcatcgtgtcctacgccagcgcctgttctgagctgattcaggcttccagccggatcacgacatgctctaccgaaggcgtcaacaccaagtgtagactgtccgggacagcgcttattcgcgccggcagcgtgggagctgaggcctgcctcatgctgaagggcgttaaagaagaccagaccaagtttctgaaaatcaagacagtgtctagcgagctctcctgtcgggaggggcagagctattggacgggatctttctcccctaaatgcctgagctccagacgctgccatcttgtcggcgaatgtcacgtgaatcggtgcctgtcttggagagataacgagaccagcgccgaattttccttcgttggggagtctacaaccatgcgcgaaaataagtgttttgagcaatgcggaggctgggggtgtggctgcttcaacgtgaatcccagctgtctctttgtccacacatacctgcagtccgtgcggaaggaggctctgagagtgttcaactgcattgactgggtccataaacttaccctcgaaatcacggattttgacggatctgttagcaccatcgatctgggcgcctccagctctcggttcacaaattgggggtccgtgagcctgtctctcgacgcggagggaatttccggcagcaactctttttccttcatcgaaagccccgggaagggatatgctattgtggatgagcctttctccgaaatcccgcgccagggctttctgggggagattagatgtaatagcgagtctagcgtcctttccgcccacgaatcttgcctgcgggcccccaacctcatcagctacaaacctatgatcgaccagctggagtgtaccacaaatctgattgatcccttcgtggtttttgaaagaggctcccttcctcaaacccgcaacgacaagacgttcgctgcctctaaaggaaatcggggcgtgcaggcgtttagcaaggggtccgtccaggctgatctcacactgatgttcgacaactttgaggtggacttcgttggagccgccgtgtcttgcgatgctgcctttctgaacctcaccggctgctatagctgtaatgctggggccaaggtctgcctgtccatcacaagcaccggaaccggctctctttccgcgcataacaaagacggcagcctgcacattgtgctcccctctgaaaatgggacaaaggatcaatgtcagatcctgcatttcacggttcctgaggtggaggaagagtttatgtactcctgcgacggagatgaaagacccctgcttgtcaaaggcaccctcattgccatcgacccgttcgatgaccgcagagaggctgggggagagagcacagtggtgaaccctaagtccggctcttggaactttttcgattggttcagcgggctgatgtcctggtttggaggccccctgaaaaccatcctcctgatttgtctttacgtcgccctgagcatcggcctcttctttctgctgatttatcttgggcggacaggactgtctaagatgtggctcgctgccaccaagaaagcctcctga

SEQ ID NO: 14459 - RNA, 3480 nt, synthetic construct
  misc_feature 1..3480: note = derived and/or modified CDS sequence (opt5) from RVFV(2007000094)__EU574055.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatcagccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgatatcggagtccatatggctcacgacgatcaaagcgtgtcctctaagatcgttgcccattgccctccccaggacccgtgtctggtgcacggctgcattgtctgtgcgcacgggcttatcaactaccagtgccataccgccctgagcgctttcgtggtggttttcgtcttttcctctattgccatcatttgtctcgctatcctgtatagagtgcttaaatgcctgaagatcgcccctcggaaagtgctcaatcccctgatgtggattacagcgttcatcagatgggtctacaagaaaatggtggcccgcgttgctgacaacattaaccaggtgaatcgggaaatcggatggatggagggcgggcaactggtcctcggaaaccctgcccccattcctagacacgctcccatcccgcgctacagcacctatctgatgcttctgctcattgtgtcctacgccagcgcctgttctgagctgatccaggcttccagccggatcacgacatgctctaccgaaggcgttaataccaagtgtagactgtccgggacagcgcttattcgcgccggcagcgtgggagctgaggcctgcctcatgctgaagggcgtcaaagaagatcagaccaagtttctgaaaatcaagacagtgtctagcgagctctcctgtcgggaggggcagagctattggacgggatctttctcccctaaatgcctgagctccagacgctgccatcttgttggcgaatgtcacgtgaaccggtgcctgtcttggagagacaatgagaccagcgccgaattttccttcgtcggggagtctacaaccatgcgcgaaaacaagtgttttgagcaatgcggaggctgggggtgtggctgcttcaatgtgaaccccagctgtctctttgtgcacacatacctgcagtccgtccggaaggaggctctgagagttttcaattgcattgattgggtgcataaacttaccctcgaaatcacggactttgatggatctgtgagcaccattgacctgggcgcctccagctctcggttcacaaactgggggtccgtcagcctgtctctcgatgcggagggaatctccggcagcaattctttttccttcatcgaaagccccgggaagggatatgctattgtggacgagcctttctccgaaatcccgcgccagggctttctgggggagattagatgtaacagcgagtctagcgttctttccgcccacgaatcttgcctgcgggcccccaatctcatcagctacaaacctatgattgatcagctggagtgtaccacaaacctgatcgaccccttcgtggtctttgaaagaggctcccttcctcaaacccgcaatgataagacgttcgctgcctctaaaggaaaccggggcgtgcaggcgtttagcaaggggtccgttcaggctgacctcacactgatgttcgataactttgaggtggacttcgtcggagccgccgtgtcttgcgacgctgcctttctgaatctcaccggctgctatagctgtaacgctggggccagagtttgcctgtccatcacaagcaccggaaccggcacactttctgcgcataataaggatggctccctgcacattgtgctccccagcgaaaacgggacgaaagaccaatgtcagatcctgcatttcaccgtccctgaggtggaggaagagtttatgtactcttgcgatggagacgaacgccccctgcttgtgaagggcacactcattgccatcgatccgttcgacgatagacgggaggctgggggagagtccaccgtcgttaatcctaaaagcggctcctggaactttttcgactggttctctgggctgatgagctggtttggaggccccctgaagacaattctcctgatctgtctttacgtggccctgtccatcggcctcttctttctgctgatttatcttgggcgcaccggactgagcaaaatgtggctcgctgccacgaagaaggcctcttga

SEQ ID NO: 14460 - RNA, 3480 nt, synthetic construct
  misc_feature 1..3480: note = derived and/or modified CDS sequence (opt5) from RVFV(ZM-657)__DQ380204.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaacaatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggattctggccagacgaagcgggaactgaaatcctttgacatttcccaatgccccaagatcgggggacacggcagcaagaaatgtacaggggatgctgccttctgctctgcctatgagtgtaccgctcagtacgccaaggcgtattgctcccatgctaatggaagcggcatcgtccagattcaagtgtctggcgtttggaaaaagcccctctgtgtggggtacgagcgcgtcgtggttaaaagagaactgagcgccaagcctatccagcgggtggagccgtgcacaacctgtattaccaagtgcgaaccccacggactggtcgtgcgctccacaggctttaaaatctctagcgccgtcgcttgtgcctccggggtgtgcgttacgggaagccagtctccttccaccgagattacactcaagtatcccggcatcagccagtcttccgggggcgacatcggagtgcatatggctcacgatgaccaaagcgtctcctctaaaattgtggcccattgccctccccaggacccgtgtctggttcacggctgcatcgtgtgtgcgcacgggcttattaactaccagtgccataccgccctgagcgctttcgtcgtggtgttcgtttttagctctatcgccattatctgtctcgctatcctgtatagagtccttaagtgcctgaaaattgcccctcggaaggtgctcaatcccctgatgtggatcacagcgttcattagatggatctacaaaaagatggtggcccgcgtcgctgataacattaatcaggtgaaccgggaaatcggatggatggagggcgggcaactggttctcggaaaccctgcccccattcctagacacgctcccatcccgcgctacagcacctatctgatgcttctgctcatcgtgtcctacgccagcgcctgttctgagctgattcaggcttccagccggatcacgacatgctctaccgaaggcgtcaataccaagtgtagactgtccgggacagcgcttattcgcgccggcagcgtgggagctgaggcctgcctcatgctgaaaggcgttaaggaagaccagaccaaatttctgaagatcaaaacagtgtctagcgagctctcctgtcgggaggggcagagctattggacgggatctttctcccctaagtgcctgagctccagacgctgccatcttgtcggcgaatgtcacgtgaaccggtgcctgtcttggagagataatgagaccagcgccgaattttccttcgttggggagtctacaaccatgcgcgaaaacaagtgttttgagcaatgcggaggctgggggtgtggctgcttcaatgtgaaccccagctgtctctttgtccacacatacctgcagtccgtgcggaaagaggctctgagagtgttcaattgcattgactgggtccataaacttaccctcgaaatcacggattttgacggatctgttagcaccatcgatctgggcgcctccagctctcggttcacaaactgggggtccgtgagcctgtctctcgacgcggagggaatttccggcagcaattctttttccttcatcgaaagccccgggaagggatatgctattgtggatgagcctttctccgaaatcccgcgccagggctttctgggggagattagatgtaacagcgagtctagcgtcctttccgcccacgaatcttgcctgcgggcccccaatctcatcagctacaagcctatgatcgaccagctggagtgtaccacaaacctgattgatcccttcgtggtttttgaaagaggctcccttcctcaaacccgcaatgacaaaacgttcgctgcctctaagggaaaccggggcgtgcaggcgtttagcaaggggtccgtccaggctgatctcacactgatgttcgacaattttgaggtggacttcgttggagccgccgtgtcttgcgatgctgcctttctgaacctcaccggctgctatagctgtaacgctggggccagagtctgcctgtccatcacaagcaccggaaccggctctctttccgcgcataataaagacggcagcctgcacattgtgctcccctctgaaaacgggacaaaggatcaatgtcagatcctgcatttcacggttcctgaggtggaggaagagtttatgtactcctgcgacggagatgaacgccccctgcttgtcaaaggcaccctcattgccatcgacccgttcgatgacagacgggaggctgggggagagagcacagtggtgaatcctaagtccggctcttggaactttttcgattggttcagcgggctgatgtcctggtttggaggccccctgaaaaccatcctcctgatttgtctttacgtcgccctgagcatcggcctcttctttctgctgatttatcttgggcgcacaggactgtctaagatgtggctcgctgccaccaagaaagcctcctga

SEQ ID NO: 14461 - RNA, 3480 nt, synthetic construct
  misc_feature 1..3480: note = derived and/or modified CDS sequence (opt5) from RVFV(ZH-548M12)__M25276.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcaaaacgatggccgggattgctatgaccgtgctgcctgcccttgctgtgttcgccctggcgcccgtcgtgtttgccgaagatcctcacctcagaaaccggcccggaaagggccataattatatcgacggcatgacacaggaggatgctacctgtaaacctgttacatacgccggggcttgctcctctttcgacgtgctgctggagaagggaaaatttcccctcttccagagctatgcccaccatcgcaccctgcttgaagcggtccacgatacaattatcgccaaggctgacccgccttcctgtgatctgctcagcgcccacggcaacccctgcatgaaggagaaactggtgatgaagacccattgtcctaatgactaccagtctgctcaccatcttaacaatgatgggaaaatggcctccgttaagtgtcccccgaaatatgaactgacggaggactgcaacttttgcagacaaatgaccggagccagcctcaagaaaggctcttaccctctgcaggacctgttctgtcagtccagcgaagatgacgggtctaagctcaagacaaaaatgaagggagtgtgcgaggtcggcgtgcaggctctgaaaaagtgcgatggccaactttccaccgcgcacgaggtggtcccctttgccgttttcaaaaatagcaagaaggtgtatctggacaaactcgatctgaagacagaagagaaccttctgcctgactcctttgtgtgtttcgaacacaaagggcagtacaagggaaccatggattctggccagacgaaacgggagctcaagagctttgacatttcccagtgccccaagatcgggggacatggcagcaaaaagtgtacaggggatgctgccttctgctctgcctacgaatgtaccgctcaatatgccaatgcgtactgctcccacgctaacggaagcggcatcgtccagattcaggtgtctggcgtttggaaaaagcccctgtgtgtggggtatgagcgcgtcgtggttaaaagagagctgagcgccaagcctatccaacgggtggaaccgtgcacaacctgtattaccaagtgcgagccccatggactcgtcgtgcgctccacaggctttaaaatctctagcgccgtcgcttgtgcctccggggtgtgcgttacgggaagccagtctccttccaccgaaattacactgaagtaccccggcatcagccagtcttccgggggcgacatcggagtgcacatggctcatgatgaccagagcgtctcctctaaaattgtggcccactgccctccccaagacccgtgtcttgttcacgattgcatcgtgtgtgcgcatggcctgattaattatcagtgccacaccgccctcagcgctttcgtcgtggtgttcgtcttttcctctatcgccattatctgtctggctatcctttacagagttctgaagtgcctcaaaattgcccctcggaaggtgctgaaccccctgatgtggatcacagcgttcattagatggatctataaaaagatggtggcccgcgtcgctgacaatattaaccaggtgaaccgggagatcgggtggatggaaggaggccagctcgttctggggaatcctgcccccattcctagacatgctcccatcccgcgctacagcacctaccttatgctgctcctgatcgtgtcctatgccagcgcctgttctgagctgattcaggcttccagccggatcacgacatgctctaccgagggagtcaacaccaagtgtagactttccggcacagcgctcattcgcgccgggagcgtgggcgctgaagcctgcctgatgctgaaaggagttaaggaggatcaaaccaaatttctcaagctgaaaacagtgtctagcgaactttcctgtcgggagggccagagctactggacggggtctttctcccctaagtgcctgagctccagacgctgccacctcgtcggagagtgtcacgtgaatcggtgcctgtcttggagagacaacgaaaccagcgccgagttttccttcgttggcgaatctacaaccatgcgcgagaataagtgttttgaacagtgcgggggatggggctgtgggtgcttcaacgtgaatcccagctgtctgtttgtccatacatatcttcaatccgtgcggaaagaggctctcagagtgttcaactgcatcgattgggtccacaagctgaccctggagattacggactttgatggctctgttagcaccatcgacctcggagcctccagctctcggttcacaaattggggctccgtgagcctgtctcttgatgcggaagggatctccggaagcaactctttttccttcattgagagccccggcaaagggtacgctatcgtggacgaacctttctccgagattccgcgccagggatttctgggcgaaatcagatgtaatagcgagtctagcgtcctctccgcccatgagtcttgcctgcgggcccccaacctgattagctataagcctatgatcgatcagcttgaatgtaccacaaatctcatcgaccccttcgtggtttttgagagagggtccctgcctcagacccgcaacgataaaacgttcgctgcctctaagggcaatcggggagtgcaagcgtttagcaagggctccgtccaggctgacctgacactcatgttcgacaactttgaagtggatttcgttggggccgccgtgtcttgcgacgctgcctttctgaaccttaccggatgctacagctgtaatgctggcgccagagtctgcctgtccattacaagcaccgggaccggatctctctccgcgcacaacaaagatggcagcctgcatatcgtgctgccctctgagaatggcacaaaggaccagtgtcaaattcttcacttcacggttcctgaagtggaggaggaatttatgtattcctgcgatggggacgagcgccccctcctggtcaaaggaaccctgatcgccattgatccgttcgacgatagacgggaagctggcggggagagcacagtggtgaaccctaagtccggatcttggaactttttcgactggttcagcggcctcatgtcctggtttgggggacccctgaaaaccatccttctgatctgtctctacgtcgccctgagcattggcctgttctttcttctgatctacctcggcgggacaggactgtctaagatgtggctcgctgccaccaagaaagcctcctga

SEQ ID NO: 14462 - RNA, 3480 nt, synthetic construct
  misc_feature 1..3480: note = derived and/or modified CDS sequence (opt5) from RVFV(ZH-501-777)__DQ380202.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggatcccggccagacgaagcgggaactgaaatcttttgacattagccaatgccccaagatcgggggacacggctccaagaaatgtacaggggatgctgccttctgcagcgcctatgagtgtaccgctcagtacgccaatgcgtattgctctcatgctaacggatccggcatcgtccagattcaagtgagcggcgtttggaagaaacctctctgtgtggggtacgagcgcgtcgtggttaagagagaactgtctgccaaaccgatccagcgggtggagccctgcacaacctgtattaccaagtgcgaacctcacggactggtcgtgcgcagcacaggctttaagatctcctctgccgtcgcttgtgccagcggggtgtgcgttacgggatcccagagcccctctaccgagattacactcaaatatcctggcatctcccagagctctgggggcgacatcggagtgcatatggctcacgatgaccaatccgtcagctccaagattgtggcccattgtcccccgcaggacccttgcctggttcacggctgcatcgtgtgtgcgcacgggcttattaattaccagtgccataccgccctgtctgctttcgtcgtggtgttcgtttttagctccatcgccattatctgtctcgctgtcctgtatagagtgcttaaatgcctgaagatcgcgccccggaaagtgctcaaccctctgatgtggattacagccttcatcagatggatttacaagaaaatggtcgcccgcgtggctgataatatcaaccaggttaaccgggaaattggatggatggagggcgggcaactggtgctcggaaatcccgcccctatccccagacacgctccgattcctcgctactctacctatctgatgcttctgctcatcgtcagctacgcctccgcctgtagcgagctgatccaggcttcttcccggattacgacatgcagcaccgaaggcgtgaacaccaagtgtagactgtctgggacagcgcttatccgcgccggctccgttggagctgaggcctgcctcatgctgaagggcgtgaaagaagaccagaccaagtttctgaaaattaagacagtcagctctgagctcagctgtcgggaggggcagtcctattggacgggcagcttctctcccaaatgcctgtccagcagacgctgccatcttgtgggagaatgtcacgttaatcggtgcctgtcctggagagataacgagacctctgccgaatttagcttcgtgggggagtccacaaccatgcgcgaaaataagtgttttgagcaatgcggaggctgggggtgtggctgcttcaacgtcaatccctcttgtctctttgtgcacacatacctgcagagcgtgcggaaggaggctctgagagtcttcaactgcatcgactgggttcataaacttaccctcgaaattacggattttgacggatccgtgtctaccatcgatctgggcgccagctccagccggttcacaaattgggggtctgtgtccctgagcctcgacgcggagggaatctctggctccaacagcttttctttcattgaatcccctgggaagggatatgctatcgtcgatgagccgttcagcgaaattccccgccagggctttctgggggagatcagatgtaattccgagagctctgtgcttagcgcccacgaatcctgcctgcgggcccctaacctcatttcttacaaacccatgatcgaccagctggagtgtaccacaaatctgatcgatcctttcgttgtgtttgaaagaggcagccttccccaaacccgcaacgacaagacgttcgctgcctccaaaggaaatcggggcgtccaggcgttttctaaggggagcgtgcaggctgatctcacactgatgttcgacaactttgaggttgacttcgtgggagccgccgtctcctgcgatgctgcctttctgaacctcaccggctgctattcttgtaatgctggggccagagtgtgcctgagcattacatccaccggaaccggcagcctttctgcgcataacaaggacggctccctgcacatcgttctccctagcgaaaatgggacaaaagatcaatgtcagattctgcatttcacggtgcccgaggtcgaggaagagtttatgtactcttgcgacggagatgaacgcccgctgcttgtgaagggcaccctcatcgccattgaccctttcgatgacagacgggaggctgggggagagtccacagtggtcaaccccaaaagcggctcctggaactttttcgattggttctctgggctgatgagctggtttggaggccctctgaagaccatcctcctgatctgtctttacgttgccctgtccattggcctcttctttctgctgatctatcttgggcgcacaggactgagcaaaatgtggctcgctgccaccaagaaggcctcttga

SEQ ID NO: 14463 - RNA, 3480 nt, synthetic construct
  misc_feature 1..3480: note = derived and/or modified CDS sequence (opt5) from RVFV(T-46 (228113))__DQ380199.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccaaggattctggccagacgaaacgggaacttaagagctttgacatttcccaatgccccaagatcgggggacacggcagcaaaaagtgtacaggggatgctgccttctgctctgcctatgagtgtaccgctcagtacgccaatgcgtattgctcccatgctaacggaagcggcatcgtccagattcaagtgtctggcgtttggaaaaagcccctctgtgtggggtacgagcgcgtcgtggttaaaagagaactgagcgccaagcctatccagcgggtggagccgtgcacaacctgtattaccaagtgcgaaccccacggactggtcgtgcgctccacaggctttaaaatctctagcgccgtcgcttgtgcctccggggtgtgcgttacgggaagccagtctccttccaccgagattacactcaagtatcccggcatcagccagtcttccgggggcgacatcggagtgcatatggctcacgatgaccaaagcgtctcctctaaaattgtggcccattgccctccccaggacccgtgtctggttcacggctgcatcgtgtgtgcgcacgggcttattaattaccagtgccataccgccctgagcgctttcgtcgtggtgttcgtcttttcctctatcgccattatctgtctcgctgttctgtatagagtgcttaagtgcctgaaaatcgcccctcggaaggtgctcaaccccctgatgtggattacagcgttcatcagatggatttacaaaaagatggtcgcccgcgtggctgataatatcaaccaggttaaccgggaaattggatggatggagggcgggcaactggtgctcggaaatcctgcccccatccctagacacgctcccattccgcgctacagcacctatctgatgcttctgctcatcgtctcctacgccagcgcctgttctgagctgatccaggcttccagccggattacgacatgctctaccgaaggcgtgaacaccaagtgtagactgtccgggacagcgcttatccgcgccggcagcgttggagctgaggcctgcctcatgctgaaaggcgtgaaggaagaccagaccaaatttctgaagattaaaacagtctctagcgagctctcctgtcgggaggggcagagctattggacgggatctttctcccctaagtgcctgagctccagacgctgccatcttgtgggcgaatgtcacgttaatcggtgcctgtcttggagagataacgagaccagcgccgaattttccttcgtgggggagtctacaaccatgcgcgaaaataagtgttttgagcaatgcggaggctgggggtgtggctgcttcaacgtcaatcccagctgtctctttgtgcacacatacctgcagtccgtgcggaaagaggctctgagagtcttcaactgcatcgactgggttcataagctgaccctcgaaattacggattttgacggatctgtgagcaccatcgatctgggcgcctccagctctcggttcacaaattgggggtccgtgagcctgtctctcgacgcggagggaatctccggcagcaactctttttccttcattgaaagccccgggaaaggatatgctatcgtcgatgagcctttctccgaaattccgcgccagggctttctgggggagatcagatgtaatagcgagtctagcgtgctttccgcccacgaatcttgcctgcgggcccccaacctcattagctacaagcctatgatcgaccagctggagtgtaccacaaatctgatcgatcccttcgttgtgtttgaaagaggctcccttcctcaaacccgcaacgacaaaacgttcgctgcctctaagggaaatcggggcgtccaggcgtttagcaaggggtccgtgcaggctgatctcacactgatgttcgacaactttgaggttgacttcgtgggagccgccgtctcttgcgatgctgcctttctgaacctcaccggctgctatagctgtaatgctggggccagagtgtgcctgtccattacaagcaccggaaccggctctctttccgcgcataacaaagacggcagcctgcacatcgttctcccctctgaaaatgggacaaaggatcaatgtcagattctgcatttcacggtgcctgaggtcgaggaagagtttatgtactcctgcgacggagatgaacgccccctgcttgtgaaaggcaccctcatcgccattgacccgttcgatgacagacgggaggctgggggagagagcacagtggtcaaccctaagtccggctcttggaactttttcgattggttcagcgggctgatgtcctggtttggaggccccctgaaaaccatcctcctgatctgtctttacgttgccctgagcattggcctcttctttctgctgatctatcttgggcgcacaggactgtctaagatgtggctcgctgccaccaagaaagcctcctga

SEQ ID NO: 14464 - RNA, 3480 nt, synthetic construct
  misc_feature 1..3480: note = derived and/or modified CDS sequence (opt5) from RVFV(OS-3)__DQ380184.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggattctggccagacgaagcgggaactgaaatcctttgacattagccaatgccccaagatcgggggacacggcagcaagaaatgtacaggggatgctgccttctgctctgcctatgagtgtaccgctcagtacgccaatgcgtattgctcccatgctaacggaagcggcgtcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgacatcggagtccatatggctcacgatgaccaaagcgtgtcctctaagatcgttgcccattgccctccccaggacccgtgtctggtgcacggctgcattgtctgtgcgcacgggcttatcaattaccagtgccataccgccctgagcgctttcgtggtggttttcgtcttttcctctgtggccattatctgtctcgctattctgtataaagtgcttaagtgcctgaaaatcgcccctagaaaggtcctcaaccccctgatgtggatcacagcgttcattcggtgggtgtacaaaaagatggttgccagagtggctgataatatcaaccaggtcaaccgcgaaattggatggatggagggcgggcaactggccctcggaaatcctgctcccatccctcggcacgcccccattccgagatacagcacctatctgatgcttctgctcatcgtgtcctacgccagcgcttgttctgagctgattcaggcgtccagccgcatcacgacatgctctaccgaaggcgttaacaccaagtgtcggctgtccgggacagcccttatcagagctggcagcgtgggagccgaggcctgcctcatgctgaaaggcgtcaaggaagaccagaccaaatttctgaagattaaaacagtgtctagcgagctctcctgtcgcgaggggcagagctattggacgggatctttctcccctaagtgcctgagctcccggagatgccatcttgttggcgaatgtcacgtgaatcgctgcctgtcttggcgggataacgagaccagcgctgaattttccttcgtcggggagtctacaaccatgagagaaaataagtgttttgagcaatgcggaggctgggggtgtggctgcttcaacgtgaatcccagctgtctctttgtgcacacatacctgcagtccgtccgcaaagaggccctgcgggttttcaactgcatcgactgggtgcataaacttaccctcgaaattacggattttgacggatctgtgagcaccatcgatctgggcgcgtccagctctagattcacaaattgggggtccgtcagcctgtctctcgacgctgagggaatttccggcagcaactctttttccttcatcgaaagccccgggaaaggatatgccatcgtggatgagcctttctccgaaattccgcggcagggctttctgggggagatccgctgtaatagcgagtctagcgttctttccgcccacgaatcttgcctgagagctcccaacctcattagctacaagcctatgatcgaccagctggagtgtaccacaaatctgattgatcccttcgtggtctttgaacggggctcccttcctcaaaccagaaacgacaaaacgttcgccgcgtctaagggaaatcgcggcgtgcaggcttttagcaaggggtccgttcaggccgatctcacactgatgttcgacaactttgaggtggacttcgtcggagccgctgtgtcttgcgatgccgcttttctgaacctcaccggctgctatagctgtaatgccggggcgcgggtttgcctgtccatcacaagcaccggaaccggcacactttctgcccataacaaagacggctccctgcacatcgtgctccccagcgaaaatgggacgaaggatcaatgtcagattctgcatttcaccgtccctgaggtggaggaagagtttatgtactcttgcgacggagatgaaagacccctgcttgtgaaaggcacactcatcgctattgacccgttcgatgaccgcagagaggccgggggagagtccaccgtcgttaaccctaagagcggctcctggaactttttcgattggttctctgggctgatgagctggtttggaggccccctgaaaacaatcctcctgatttgtctttacgtggctctgtccatcggcctcttctttctgctgatctatcttgggcggaccggactgagcaagatgtggctcgccgccacgaagaaggcttcttga

SEQ ID NO: 14465 - RNA, 3480 nt, synthetic construct
  misc_feature 1..3480: note = derived and/or modified CDS sequence (opt5) from RVFV(Sudan 86-2010)__JQ820489.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatcagccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgatatcggagtccatatggctcacgacgatcaaagcgtgtcctctaagatcgttgcccattgccctccccaggacccgtgtctggtgcacggctgcattgtctgtgcgcacgggcttatcaactaccagtgccataccgccctgagcgctttcgtggtggttttcgtcttttcctctattgccatcatttgtctcgctatcctgtatagagtgcttaaatgcctgaagatcgcccctcggaaagtgctcaatcccctgatgtggattacagcgttcatcagatgggtctacaagaaaatggtggcccgcgttgctgacaacattaaccaggtgaatcgggaaatcggatggatggagggcgggcaactggtcctcggaaaccctgcccccattcctagacacgctcccatcccgcgctacagcacctatctgatgcttctgctcattgtgtcctacgccagcgcctgttctgagctgatccaggcttccagccggatcacgacatgctctaccgaaggcgttaataccaagtgtagactgtccgggacagcgcttattcgcgccggcagcgtgggagctgaggcctgcctcatgctgaagggcgtcaaagaagatcagaccaagtttctgaaaatcaagacagtgtctagcgagctctcctgtcgggaggggcagagctattggacgggatctttctcccctaaatgcctgagctccagacgctgccatcttgttggcgaatgtcacgtgaaccggtgcctgtcttggagagacaatgagaccagcgccgaattttccttcgtcggggagtctacaaccatgcgcgaaaacaagtgttttgagcaatgcggaggctgggggtgtggctgcttcaatgtgaaccccagctgtctctttgtgcacacatacctgcagtccgtccggaaggaggctctgagagttttcaattgcattgattgggtgcataaacttaccctcgaaatcacggactttgatggatctgtgagcaccattgacctgggcgcctccagctctcggttcacaaactgggggtccgtcagcctgtctctcgatgcggagggaatctccggcagcaattctttttccttcatcgaaagccccgggaagggatatgctattgtggacgagcctttctccgaaatcccgcgccagggctttctgggggagattagatgtaacagcgagtctagcgttctttccgcccacgaatcttgcctgcgggcccccaatctcatcagctacaaacctatgattgatcagctggagtgtaccacaaacctgatcgaccccttcgtgatctttgaaagaggctcccttcctcaaacccgcaatgataagacgttcgctgcctctaaaggaaaccggggcgtccaggcgtttagcaaggggtccgtgcaggctgacctcacactgatgttcgataactttgaggttgacttcgtgggagccgccgtctcttgcgacgctgcctttctgaatctcaccggctgctatagctgtaacgctggggccagagtgtgcctgtccattacaagcaccggaaccggcacactttctgcgcataataaggatggctccctgcacatcgttctccccagcgaaaacgggacgaaagaccaatgtcagattctgcatttcaccgtgcctgaggtcgaggaagagtttatgtactcttgcgatggagacgaacgccccctgcttgtgaagggcacactcatcgccattgatccgttcgacgatagacgggaggctgggggagagtccaccgtggtcaatcctaaaagcggctcctggaactttttcgactggttctctgggctgatgagctggtttggaggccccctgaagacaatcctcctgatctgtctttacgttgccctgtccattggcctcttctttctgctgatctatcttgggcgcaccggactgagcaaaatgtggctcgctgccacgaagaaggcctcttga

SEQ ID NO: 14466 - RNA, 3480 nt, synthetic construct
  misc_feature 1..3480: note = derived and/or modified CDS sequence (opt5) from RVFV(Sudan 28-2010)__JQ820491.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatcagccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgatatcggagtccatatggctcacgacgatcaaagcgtgtcctctaagatcgttgcccattgccctccccaggacccgtgtctggtgcacggctgcattgtctgtgcgcacgggcttatcaactaccagtgccataccgccctgagcgctttcgtggtggttttcgtcttttcctctattgccatcatttgtctcgctatcctgtatagagtgcttaaatgcctgaagatcgcccctcggaaagtgctcaatcccctgatgtggattacagcgttcatcagatgggtctacaagaaaatggtggcccgcgttgctgacaacattaaccaggtgaatcgggaaatcggatggatggagggcgggcaactggtcctcggaaaccctgcccccattcctagacacgctcccatcccgcgctacagcacctatctgatgcttctgctcattgtgtcctacgccagcgcctgttctgagctgatccaggcttccagccggatcacgacatgctctaccgaaggcgttaataccaagtgtagactgtccgggacagcgcttattcgcgccggcagcgtgggagctgaggcctgcctcatgctgaagggcgtcaaagaagatcagaccaagtttctgaaaatcaagacagtgtctagcgagctctcctgtcgggaggggcagagctattggacgggatctttctcccctaaatgcctgagctccagacgctgccatcttgttggcgaatgtcacgtgaaccggtgcctgtcttggagagacaatgagaccagcgccgaattttccttcgtcggggagtctacaaccatgcgcgaaaacaagtgttttgagcaatgcggaggctgggggtgtggctgcttcaatgtgaaccccagctgtctctttgtgcacacatacctgcagtccgtccggaaggaggctctgagagttttcaattgcattgattgggtgcataaacttaccctcgaaatcacggactttgatggatctgtgagcaccattgacctgggcgcctccagctctcggttcacaaactgggggtccgtcagcctgtctctcgatgcggagggaatctccggcagcaattctttttccttcatcgaaagccccgggaagggatatgctattgtggacgagcctttctccgaaatcccgcgccagggctttctgggggagattagatgtaacagcgagtctagcgttctttccgcccacgaatcttgcctgcgggcccccaatctcatcagctacaaacctatgattgatcagctggagtgtaccacaaacctgatcgaccccttcgtggtctttgaaagaggctcccttcctcaaacccgcaatgataagacgttcgctgcctctaaaggaaaccggggcgtgcaggcgtttagcaaggggtccgttcaggctgacctcacactgatgttcgataactttgaggtggacttcgtcggagccgccgtgtcttgcgacgctgcctttctgaatctcaccggctgctatagctgtaacgctggggccagagtttgcctgtccatcacaagcaccggaaccggcacactttctgcgcataataaggatggctccctgcacattgtgctccccagcgaaaacgggacgaaagaccaatgtcagatcctgcatttcaccgtccctgaggtggaggaagagtttatgtactcttgcgatggagacgaacgccccctgcttgtgaagggcacactcattgccatcgatccgttcgacgatagacgggaggctgggggagagtccaccgtcgttaatcctaaaagcggctcctggaactttttcgactggttctctgggctgatgagctggtttggaggccccctgaagacaattctcctgatctgtctttacgtggtgctgtccatcggcctcttctttctgctgatttatcttgggcgcaccggactgagcaaaatgtggctcgccgctacgaagaaggcctcttga

SEQ ID NO: 14467 - RNA, 3480 nt, synthetic construct
  misc_feature 1..3480: note = derived and/or modified CDS sequence (opt5) from RVFV(2007004194)__EU574031.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaataatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgtccaatgacgggaagatggccagcgtgaaatgcccgccgaagtacgagcttacggaagattgtaacttttgcagacagatgaccggagcctctctgaaaaagggctcctatcctctccaggacctgttctgtcagagctctgaggacgatgggtccaaactgaagacaaagatgaaaggagtctgcgaggtgggcgtgcaagctctcaagaaatgcgacggccagctgagcaccgcgcatgaagtcgttccctttgccgtgttcaagaatagcaaaaaggtgtaccttgataagctggacctcaaaacagaggaaaacctgcttcctgattcttttgtctgtttcgagcacaaggggcagtacaaaggaaccatggacagcggccagacgaagcgggaactgaaatcctttgatatcagccaatgccccaagattgggggacacggctctaagaaatgtacaggggacgctgccttctgctccgcctatgagtgtaccgctcagtacgccaatgcgtattgcagccatgctaacggatctggcatcgtgcagatccaagttagcggcgtgtggaagaaacccctctgtgtcgggtacgagcgcgtggttgtgaagagagaactgtccgccaaacctattcagcgggtcgagccgtgcacaacctgtatcaccaagtgcgaaccccacggactggtggtccgctctacaggctttaagattagctccgccgtggcttgtgccagcggggtttgcgtgacgggatctcagtcccctagcaccgagatcacactcaaatatcccggcatttctcagtccagcgggggcgatatcggagtccatatggctcacgacgatcaatccgtgtctagcaagatcgttgcccattgccctccccaggacccgtgtctggtgcacggctgcattgtctgtgcgcacgggcttatcaattaccagtgccataccgccctgtccgctttcgtggtggttttcgtcttttctagcattgccatcatttgtctcgctatcctgtatagagtgcttaaatgcctgaagatcgcccctcggaaagtgctcaaccccctgatgtggattacagcgttcatcagatgggtctacaagaaaatggtggcccgcgttgctgacaatattaaccaggtgaaccgggaaatcggatggatggagggcgggcaactggtcctcggaaatcctgcccccattcctagacacgctcccatcccgcgctactccacctatctgatgcttctgctcattgtgagctacgcctctgcctgttccgagctgatccaggctagctctcggatcacgacatgctccaccgaaggcgttaacaccaagtgtagactgagcgggacagcgcttattcgcgccggctctgtgggagctgaggcctgcctcatgctgaagggcgtcaaagaagatcagaccaagtttctgaaaatcaagacagtgagctccgagctcagctgtcgggaggggcagtcttattggacgggatccttcagccctaaatgcctgtcctctagacgctgccatcttgttggcgaatgtcacgtgaatcggtgcctgagctggagagacaacgagacctccgccgaattttctttcgtcggggagagcacaaccatgcgcgaaaataagtgttttgagcaatgcggaggctgggggtgtggctgcttcaacgtgaatccctcctgtctctttgtgcacacatacctgcagtctgtccggaaggaggctctgagagttttcaactgcattgattgggtgcataaacttaccctcgaaatcacggactttgatggaagcgtgtccaccattgacctgggcgcctcctcttcccggttcacaaattgggggagcgtctctctgtccctcgatgcggagggaatcagcggctctaactcctttagcttcatcgaatcccccgggaagggatatgctattgtggacgagcctttcagcgaaatcccgcgccagggctttctgggggagattagatgtaattctgagagctccgttctttctgcccacgaaagctgcctgcgggcccccaacctcatctcctacaaacctatgattgatcagctggagtgtaccacaaatctgatcgaccccttcgtggtctttgaaagaggctctcttcctcaaacccgcaacgataagacgttcgctgccagcaaaggaaatcggggcgtgcaggcgttttccaaggggtctgttcaggctgacctcacactgatgttcgataactttgaggtggacttcgtcggagccgccgtgagctgcgacgctgcctttctgaacctcaccggctgctattcctgtaatgctggggccagagtttgcctgagcatcacatctaccggaaccggcacactttccgcgcataacaaggatggcagcctgcacattgtgctcccctctgaaaatgggacgaaagaccaatgtcagatcctgcatttcaccgtccctgaggtggaggaagagtttatgtactcctgcgatggagacgaacgccccctgcttgtgaagggcacactcattgccatcgatccgttcgacgatagacgggaggctgggggagagagcaccgtcgttaaccctaaatccggctcttggaactttttcgactggttcagcgggctgatgtcctggtttggaggccccctgaagacaattctcctgatctgtctttacgtggccctgagcatcggcctcttctttctgctgatttatcttgggcgcaccggactgtctaaaatgtggctcgctgccacgaagaaggcctcctga

SEQ ID NO: 14468 - RNA, 3480 nt, synthetic construct
  misc_feature 1..3480: note = derived and/or modified CDS sequence (opt5) from RVFV(73HB1230)__DQ380221.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaagtgggccgcgaaacgatggccgggatcgctatgaccgtgctgcctgcccttgctgtcttcgccctggcgcccgtggtttttgccgaggatcctcacctcagaaaccggcccggaaaaggccataattatattgacggcatgacacaggaggatgctacctgtaagcctgtgacatacgccggggcttgctcctctttcgacgtcctgctggaaaaaggaaagtttcccctcttccagagctatgcccaccatcgcaccctgcttgaggcggtgcacgatacaatcattgccaaagctgacccgccttcctgtgatctgcagagcgcccacggcaacccctgcatgaaggaaaagctcgttatgaaaacccattgtcctaatgactaccaatctgctcactatctgaacaatgatgggaagatggcctccgtgaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtctgcgaggtgggcgtgcaagctctcaagaaatgcgatggccagctgtccaccgcgcatgaagtcgttccctttgccgtgttcaagaatagcaaaaaggtgtaccttgacaagctggatctcaaaacagaggaaaacctgcttcctgactcctttgtctgtttcgagcacaaggggcagtacaaaggaaccatggattctggccagacgaagaaagaacttaagagctttgacatctcccaatgccccaagattgggggacacggcagcaaaaagtgtacaggggatgctgccttctgctctgcctatgagtgtaccgctcagtacgccaatgcgtattgctcccatgctaacggaagcggcatcgtgcagatccaagtttctggcgtgtggaaaaagcccctctgtgtcgggtacgagcgggtggttgtgaaacgcgaactgagcgccaagcctattcagagagtcgagccgtgcacaacctgtatcaccaagtgcgaaccccacggactggtggtccggtccacaggctttaaaatttctagcgccgtggcttgtgcctccggggtttgcgtgacgggaagccagtctccttccaccgagatcacactcaagtatcccggcattagccagtcttccgggggcgacatcggagtccatatggctcacgatgaccaaagcgtgtcctctaaaatcgttgcccattgccctccccaggacccgtgtctggtgcacggctgcattgtctgtgcgcacgggcttatcaattaccagtgccataccgccctgagcgctttcgtggtggttttcgtcttttcctctattgccatcatttgtctcgctatcctgtatcgcgtgcttaagtgcctgaaaatcgcccctagaaaggtgctcaaccccctgatgtggattacagcgttcatccggtgggtctacaaaaagatggtggccagagttgctgataatattaaccaggtgaaccgcgaaatcggatggatggagggcgggcaactggtcctcggaaatcctgcccccattcctcggcacgctcccatcccgagatacagcacctatctgatgcttctgctcattgtgtcctacgccagcgcctgttctgagctgatccaggcttccagccgcatcacgacatgctctaccgaaggcgttaacaccaagtgtcggctgtccgggacagcgcttattagagccggcagcgtgggagctgaggcctgcctcatgctgaaaggcgtcaaggaagaccagaccaaatttctgaagatcaaaacagtgtctagcgagctctcctgtcgcgaggggcagagctattggacgggatctttctcccctaagtgcctgagctcccggagatgccatcttgttggcgaatgtcacgtgaatcgctgcctgtcttggcgggataacgagaccagcgccgaattttccttcgtcggggagtctacaattatgagagaaaataagtgttttgagcaatgcggaggctgggggtgtggctgcttcaacgtgaatcccagctgtctctttgtgcacacctacctgcagtccgtccgcaaagaggctctgcgggttttcaactgcatcgactgggtgcataagctgacactcgaaattaccgattttgacggatctgtgagcacgatcgatctgggcgcctccagctctagattcaccaattgggggtccgtcagcctgtctctcgacgcggagggaatctccggcagcaactctttttccttcattgaaagccccgggaaaggatatgctatcgtggatgagcctttctccgaaattccgcggcagggctttctgggggagatccgctgtaatagcgagtctagcgttctttccgcccacgaatcttgcctgagagcccccaacctcattagctacaagcctatgatcgaccagctggagtgtacaaccaatctgatcgatcccttcgtggtctttgaacggggctcccttcctcaaacaagaaacgacaaaaccttcgctgcctctaagggaaatcgcggcgtgcaggcgtttagcaaggggtccgttcaggctgatctcacgctgatgttcgacaactttgaggtggacttcgtcggagccgccgtgtcttgcgatgctgcctttctgaacctcacaggctgctatagctgtaatgctggggcccgggtttgcctgtccattaccagcacaggaaccggcaccctttctgcgcataacaaagacggctccctgcacatcgtgctccccagcgaaaatgggacaaaggatcaatgtcagattctgcatttcacggtccctgaggtggaggaagagtttatgtactcttgcgacggagatgaaagacccctgcttgtgaaaggcaccctcatcgccattgacccgttcgatgaccgcagagaggctgggggagagtccacagtcgttaaccctaagagcggctcctggaactttttcgattggttctctgggctgatgagctggtttggaggccccctgaaaaccatcctcctgatctgtctttacgtggccctgtccattggcctcttctttctgctgatctatcttgggcggacaggactgagcaagatgtggctcgctgccaccaagaaagcctcttga

SEQ ID NO: 14469 - RNA, 3480 nt, synthetic construct
  misc_feature 1..3480: note = derived and/or modified CDS sequence (opt5) from RVFV(1260/78)__DQ380214.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggattctggccagacgaagcgggaactgaaatcctttgacatttcccaatgccccaagatcgggggacacggcagcaagaaatgtacaggggatgctgccttctgctctgcctatgagtgtaccgctcagtacgccaatgcgtattgctcccatgctaacggaagcggcatcgtccagattcaagtgtctggcgtttggaagaaacccctctgtgtggggtacgagcgcgtcgtggttaagagagaactgagcgccaaacctatccagcgggtggagccgtgcacaacctgtattaccaagtgcgaaccccacggactggtcgtgcgctccacaggctttaagatctctagcgccgtcgcttgtgcctccggggtgtgcgttacgggaagccagtctccttccaccgagattacactcaaatatcccggcatcagccagtcttccgggggcgacatcggagtgcatatggctcacgatgaccaaagcgtctcctctaagattgtggcccattgccctccccaggacccgtgtctggttcacggctgcatcgtgtgtgcgcacgggcttattaattaccagtgccataccgccctgagcgctttcgtcgtggtgttcgtttttagctctatcgccattatctgtctcgctatcctgcacagagtccttaaatgcctgaagattgcccctcggaaagtgctcaaccccctgatgtggatcacagcgttcattagatgggtgtataagaaaatggtcgcccgcgtggctgataatatcaaccaggttaaccgggaaattggatggatggagggcgggcaactggtgctcggaaatcctgcccccatccctagacatgctcccattccgcgctacagcacctacctgatgcttctgctcatcgtctcctatgccagcgcctgttctgagctgatccaggcttccagccggattacgacatgctctaccgaaggcgtgaacaccaagtgtagactgtccgggacagcgcttatccgcgccggcagcgttggagctgaggcctgcctcatgctgaagggcgtgaaagacgatcagaccaagtttctgaaaattaagacagtctctagcgaactctcctgtcgggaggggcagagctactggacgggatctttctcccctaaatgcctgagctccagacgctgccaccttgtgggcgagtgtcacgttaatcggtgcctgtcttggagagacaacgaaaccagcgccgagttttccttcgtgggggaatctacaaccatgcgcgagaataagtgttttgaacaatgcggaggctgggggtgtggctgcttcaacgtcaatcccagctgtctctttgtgcatacatatctgcagtccgtgcggaaggaggctctgagagtcttcaactgcatcgattgggttcacaaacttaccctcgagattacggactttgatggatctgtgagcaccatcgacctgggcgcctccagctctcggttcacaaattgggggtccgtgagcctgtctctcgatgcggaaggaatctccggcagcaactctttttccttcattgagagccccgggaagggatacgctatcgtcgacgaacctttctccgagattccgcgccagggctttctgggggaaatcagatgtaatagcgagtctagcgtgctttccgcccatgagtcttgcctgcgggcccccaacctcattagctataaacctatgatcgatcagctggaatgtaccacaaatctgatcgaccccttcgttgtgtttgagagaggctcccttcctcaaacccgcaacgataagacgttcgctgcctctaaaggaaatcggggcgtccaggcgtttagcaaggggtccgtgcaggctgacctcacactgatgttcgacaactttgaagttgatttcgtgggagccgccgtctcttgcgacgctgcctttctgaacctcaccggctgctacagctgtaatgctggggccagagtgtgcctgtccattacaagcaccggaaccggcacactttctgcgcacaacaaggatggctccctgcatatcgttctccccagcgagaatgggacgaaagaccaatgtcagattctgcacttcaccgtgcctgaagtcgaggaggaatttatgtattcttgcgatggagacgagcgccccctgcttgtgaagggcacactcatcgccattgatccgttcgacgatagacgggaagctgggggagagtccaccgtggtcaaccctaaaagcggctcctggaactttttcgactggttctctgggctgatgagctggtttggaggccccctgaagacaatcctcctgatctgtctttacgttgccctgtccattggcctcttctttctgctgatctaccttgggcgcaccggactgagcaaaatgtggctcgctgccacgaagaaggcctcttga

SEQ ID NO: 14470 - RNA, 3480 nt, synthetic construct
  misc_feature 1..3480: note = derived and/or modified CDS sequence (opt5) from RVFV(ZC-3349)__DQ380207.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggattctggccagacgaagcgggaactgaaatcttttgacatttcccaatgccccaagatcgggggacacggcagcaagaaatgtacaggggatgctgccttctgctctgcctatgagtgtaccgctcagtacgccaatgcgtattgctcccatgctaacggaagcggcatcgtccagattcaagtgtctggcgtttggaagaaacccctctgtgtggggtacgagcgcgtcgtggttaagagagaactgagcgccaaacctatccagcgggtggagccgtgcacaacctgtattaccaagtgcgaaccccacggactggtcgtgcgctccacaggctttaagatctctagcgccgtcgcttgtgcctccggggtgtgcgttacgggaagccagtctccttccaccgagattacactcaaatatcccggcatcagccagtcttccgggggcgacatcggagtgcatatggctcacgatgaccaagccgtcagctccaagattgtggcgcattgccctccccaggacccgtgtctggttcacggctgcatcgtgtgtgcccacgggcttattaattaccagtgccataccgctctgtctgccttcgtcgtggtgttcgtttttagctccatcgctattatctgtctcgccatcctgtatagagtccttaaatgcctgaagattgcgcctcggaaagtgctcaaccccctgatgtggatcacagccttcattagatggatctacaagaaaatggtggctcgcgtcgccgataatattaaccacgtgaaccgggaaatcggatggatggagggcgggcagctggttctcggaaatcctgctcccattcctagacatgcccccatcccgcgctactctacctatctgatgcttctgctcatcgtgagctacgcctccgcttgtagcgagctgattcaagcgtcttcccggatcacgacatgcagcaccgaaggcgtcaacaccaagtgtagactgtctgggacagcccttattcgcgctggctccgtgggagccgaggcctgcctcatgctgaagggcgttaaagaagaccagaccaagtttctgaaaatcaagacagtgagctctgagctcagctgtcgggaggggcagtcctattggacgggcagcttctctcctaaatgcctgtccagcagacgctgccaccttgtcggagaatgtcacgtgaatcggtgcctgtcctggagagataacgagacctctgctgaatttagcttcgttggggagtccacaaccatgcgcgaaaataagtgttttgagcagtgcggaggctgggggtgtggctgcttcaacgtgaatccctcttgtctctttgtccatacatacctgcaaagcgtgcggaaggaggccctgagagtgttcaactgcattgactgggtccacaaacttaccctcgaaatcacggattttgacggatccgtttctaccatcgatctgggcgcgagctccagccggttcacaaattgggggtctgtgtccctgagcctcgacgctgagggaatttctggctccaacagcttttctttcatcgaatcccccgggaagggatatgccattgtggatgagcctttcagcgaaatcccgcgccagggctttctgggggagattagatgtaattccgagagctctgtccttagcgcccatgaatcctgcctgaaagctcccaacctcatctcttacaagcctatgatcgaccagctggagtgtaccacaaatctgattgatcccttcgtggtttttgaacggggcagccttcctcagaccagaaacgacaaaacgttcgccgcgtccaagggaaatcgcggcgtgcaggctttttctaaggggagcgtccaagccgatctcacactgatgttcgacaactttgaggtggacttcgttggagccgctgtgtcctgcgatgccgcttttctgaacctcaccggctgctattcttgtaatgccggggcgcgggtctgcctgagcatcacatccaccggaaccggcagcctttctgcccacaacaaagacggctccctgcatattgtgctccccagcgaaaatgggacaaaggatcagtgtcaaatcctgcacttcacggttcctgaggtggaggaagagtttatgtactcttgcgacggagatgaaagacccctgcttgtcaaaggcaccctcattgctatcgacccgttcgatgaccgcagagaggccgggggagagtccacagtggtgaaccctaagagcggctcctggaactttttcgattggttctctgggctgatgagctggtttggaggccccctgaaaaccatcctcctgatttgtctttacgtcgctctgtccatcggcctcttctttctgctgatttatcttgggcggacaggactgagcaagatgtggctcgccgccaccaagaaagctagctga

SEQ ID NO: 14471 - RNA, 3480 nt, synthetic construct
  misc_feature 1..3480: note = derived and/or modified CDS sequence (opt5) from RVFV(Sudan 85-2010)__JQ820488.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatcagccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgatatcggagtccatatggctcacgacgatcaaagcgtgtcctctaagatcgttgcccattgccctccccaggacccgtgtctggtgcacggctgcattgtctgtgcgcacgggcttatcaactaccagtgccataccgccctgagcgctttcgtggtggttttcgtcttttcctctattgccatcatttgtctcgctatcctgtatagagtgcttaaatgcctgaagatcgcccctcggaaagtgctcaatcccctgatgtggattacagcgttcatcagatgggtctacaagaaaatggtggcccgcgttgctgacaacattaaccaggtgaatcgggaaatcggatggatggagggcgggcaactggtcctcggaaaccctgcccccattcctagacacgctcccatcccgcgctacagcacctatctgatgcttctgctcattgtgtcctacgccagcgcctgttctgagctgatccaggcttccagccggatcacgacatgctctaccgaaggcgttaataccaagtgtagactgtccgggacagcgcttattcgcgccggcagcgtgggagctgaggcctgcctcatgctgaagggcgtcaaagaagatcagaccaagtttctgaaaatcaagacagtgtctagcgagctctcctgtcgggaggggcagagctattggacgggatctttctcccctaaatgcctgagctccagacgctgccatcttgttggcgaatgtcacgtgaaccggtgcctgtcttggagagacaatgagaccagcgccgaattttccttcgtcggggagtctacaaccatgcgcgaaaacaagtgttttgagcaatgcggaggctgggggtgtggctgcttcaatgtgaaccccagctgtctctttgtgcacacatacctgcagtccgtccggaaggaggctctgagagttttcaattgcattgattgggtgcataaacttaccctcgaaatcacggactttgatggatctgtgagcaccattgacctgggcgcctccagctctcggttcacaaactgggggtccgtcagcctgtctctcgatgcggagggaatctccggcagcaattctttttccttcatcgaaagccccgggaagggatatgctattgtggacgagcctttctccgaaatcccgcgccagggctttctgggggagattagatgtaacagcgagtctagcgttctttccgcccacgaatcttgcctgcgggcccccaatctcatcagctacaaacctatgattgatcagctggagtgtaccacaaacctgatcgaccccttcgtggtctttgaaagaggctcccttcctcaaacccgcaatgagaagacgttcgctgcctctaaaggaaaccggggcgtgcaggcgtttagcaaggggtccgttcaggctgatctcacactgatgttcgacaactttgaagtggatttcgtcggagccgccgtgtcttgcgacgctgcctttctgaatctcaccggctgctatagctgtaacgctggggccagagtttgcctgtccatcacaagcaccggaaccggcacactttctgcgcataataaggacggctccctgcacattgtgctccccagcgagaacgggacgaaagatcaatgtcagatcctgcatttcaccgtccctgaggtggaagaggaatttatgtactcttgcgacggagatgagcgccccctgcttgtgaagggcacactcattgccatcgacccgttcgatgacagacgggaggctgggggagaatccaccgtcgttaatcctaaaagcggctcctggaactttttcgattggttctctgggctgatgagctggtttggaggccccctgaagacaattctcctgatctgtctttacgtggccctgtccatcggcctcttctttctgctgatttatcttgggcgcaccggactgagcaaaatgtggctcgctgccacgaagaaggcctcttga

SEQ ID NO: 14472 - RNA, 3480 nt, synthetic construct
  misc_feature 1..3480: note = derived and/or modified CDS sequence (opt5) from RVFV(2007000324)__JF326195.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatctcccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgatatcggagtccatatggctcacgacgatcaaagcgtgtcctctaagatcgttgcccattgccctccccaggacccgtgtctggtgcacggctgcattgtctgtgcgcacgggcttatcaactaccagtgccataccgccctgagcgctttcgtggtgattttcgtttttagctctacagccatcatttgtctcgctgtcctgtatagagtgcttaaatgcctgaagatcgcccctcggaaagtgctcaatcccctgatgtggatcaccgcgttcattagatgggtctacaagaaaatggtggcccgcgttgctgacaacatcaaccaggtgaatcgggaaattggatggatggagggcgggcaactggccctcggaaaccctgctcccatccctagacacgcccccattccgcgctacagcacgtatctgatgcttctgctcatcgtctcctacgccagcgcttgttctgagctgattcaggcgtccagccggatcacaacctgctctaccgaaggcgtgaatacaaagtgtagactgtccgggaccgcccttatccgcgctggcagcgttggagccgaggcctgcctcatgctgaagggcgtgaaagaagatcagacaaagtttctgaaaattaagacggtctctagcgagctctcctgtcgggaggggcagagctattggaccggatctttctcccctaaatgcctgagctccagacgctgccatcttgtgggcgaatgtcacgttaaccggtgcctgtcttggagagacaatgagacaagcgctgaattttccttcgtgggggagtctaccacaatgcgcgaaaacaagtgttttgagcaatgcggaggctgggggtgtggctgcttcaatgtcaaccccagctgtctctttgtgcacacctacctgcagtccgtgcggaaggaggccctgagagtcttcaattgcatcgattgggttcataaacttacgctcgaaattaccgactttgatggatctgtgagcacaatcgacctgggcgcgtccagctctcggttcaccaactgggggtccgtgagcctgtctctcgatgctgagggaatttccggcagcaattctttttccttcatcgaaagccccgggaagggatatgccatcgtcgacgagcctttctccgaaattccgcgccagggctttctgggggagatcagatgtaacagcgagtctagcgtgctttccgcccacgaatcttgcctgcgggctcccaatctcgttagctacaaacctatgattgatcagctggagtgtacaaccaacctgatcgaccccttcgtggtctttgaaagaggctcccttcctcaaacgcgcaatgataagacattcgccgcgtctaaaggaaaccggggcgtgcaggcttttagcaaggggtccgttcaggccgacctcaccctgatgttcgataactttgaggtggacttcgtcggagccgctgtgtcttgcgacgccgcttttctgaatctcacaggctgctatagctgtaacgccggggcgagagtttgcctgtccattaccagcaccggaacaggcacgctttctgcccataataaggatggctccctgcacatcgtgctccccagcgaaaacgggaccaaagaccaatgtcagatcctgcatttcacagtccctgaggtggaggaagagtttatgtactcttgcgatggagacgaacgccccctgcttgtgaagggcaccctcattgctatcgatccgttcgacgatagacgggaggccgggggagagtccacagtcgttaatcctaaaagcggctcctggaactttttcgactggttctctgggctgatgagctggtttggaggccccctgaagaccattctcctgatctgtctttacgtggctctgtccattggcctcttctttctgctgatctatcttgggcgcacgggactgagcaaaatgtggctcgccgccacaaagaaggcttcttga

SEQ ID NO: 14473 - RNA, 3480 nt, synthetic construct
  misc_feature 1..3480: note = derived and/or modified CDS sequence (opt5) from RVFV(OS-8)__DQ380185.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggattctggccagacgaagcgggaactgaaatcctttgacattagccaatgccccaagatcgggggacacggcagcaagaaatgtacaggggatgctgccttctgctctgcctatgagtgtaccgctcagtacgccaatgcgtattgctcccatgctaacggaagcggcgtcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgacatcggagtccatatggctcacgatgaccaaagcgtgtcctctaagatcgttgcccattgccctccccaggacccgtgtctggtgcacggctgcattgtctgtgcgcacgggcttatcaattaccagtgccataccgccctgagcgctttcgtggtggttttcgtcttttcctctgtggccattatctgtctcgctattctgtataaagtgcttaagtgcctgaaaatcgcccctagaaaggtcctcaaccccctgatgtggatcacagcgttcattcggtgggtgtacaaaaagatggttgccagagtggctgataatatcaaccaggtcaaccgcgaaattggatggatggagggcgggcaactggccctcggaaatcctgctcccatccctcggcacgcccccattccgagatacagcacctatctgatgcttctgctcatcgtgtcctacgccagcgcttgttctgagctgattcaggcgtccagccgcatcacgacatgctctaccgaaggcgttaacaccaagtgtcggctgtccgggacagcccttatcagagctggcagcgtgggagccgaggcctgcctcatgctgaaaggcgtcaaggaagaccagaccaaatttctgcgcattaagacagtgtctagcgagctctcctgtcgggaggggcagagctattggacgggatctttctcccctaaatgcctgagctccagacgctgccatcttgttggcgaatgtcacgtgaatcggtgcctgtcttggagagataacgagaccagcgctgaattttccttcgtcggggagtctacaaccatgcgcgaaaataagtgttttgagcaatgcggaggctgggggtgtggctgcttcaacgtgaatcccagctgtctctttgtgcacacatacctgcagtccgtccggaaggaggccctgagagttttcaactgcatcgactgggtgcataaacttaccctcgaaattacggattttgacggatctgtgagcaccatcgatctgggcgcgtccagctctcggttcacaaattgggggtccgtcagcctgtctctcgacgctgagggaatttccggcagcaactctttttccttcatcgaaagccccgggaagggatatgccatcgtggatgagcctttctccgaaattccgcgccagggctttctgggggagatcagatgtaatagcgagtctagcgttctttccgcccacgaatcttgcctgcgggctcccaacctcattagctacaaacctatgatcgaccagctggagtgtaccacaaatctgattgatcccttcgtggtctttgaaagaggctcccttcctcaaacccgcaacgacaagacgttcgccgcgtctaaaggaaatcggggcgtgcaggcttttagcaaggggtccgttcaggccgatctcacactgatgttcgacaactttgaggtggacttcgtcggagccgctgtgtcttgcgatgccgcttttctgaacctcagcggctgctattcctgtaatgccggggcgagagtttgcctgagcatcacctctacaggaaccggcaccctttccgcccataacaaggacggcagcctgcacatcgtgctcccctctgaaaatgggacaaaagatcaatgtcagattctgcatttcacggtccctgaggtggaggaagagtttatgtactcctgcgacggagatgaacgccccctgcttgtgaagggcaccctcatcgctattgacccgttcgatgacagacgggaggccgggggagagagcacagtcgttaaccctaaatccggctcttggaactttttcgattggttcagcgggctgatgtcctggtttggaggccccctgaagaccatcctcctgatttgtctttacgtggctctgagcatcggcctcttctttctgctgatctatcttgggcgcacaggactgtctaaaatgtggctcgccgccaccaagaaggcttcctga

SEQ ID NO: 14474 - RNA, 3480 nt, synthetic construct
  misc_feature 1..3480: note = derived and/or modified CDS sequence (opt5) from RVFV(ZINGA J83 R1)__KU978776.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagactgatgaccggagccagcctcaaaaagggctcttatcctctgcaggacctgttctgtcagtccagcgaggatgacgggtctaaactcaagacaaagatgaaaggagtgtgcgaggtcggcgtgcaggctctgaagaaatgcgatggccaactttccaccgcgcatgaagtggtcccctttgccgttttcaagaatagcaaaaaggtgtacctggacaagctcgatctgaaaacagaggaaaaccttctgcctgactcctttgtgtgtttcgagcacaaggggcagtacaaaggaaccatggattctggccagacgaagcgggaactcaaatcctttgacatttcccagtgccccaagatcgggggacacggcagcaagaaatgtacaggggatgctgccttctgctctgcctatgagtgtaccgctcaatacgccaatgcgtattgctcccatgctaacggaagcggcatcgtccagattcaggtgtctggcgtttggaagaaacccctgtgtgtggggtacgagcgcgtcgtggttaagagagaactgagcgccaaacctatccaacgggtggagccgtgcacaacctgtattaccaagtgcgaaccccacggactcgtcgtgcgctccacaggctttaagatctctagcgccgtcgcttgtgcctccggggtgtgcgttacgggaagccagtctccttccaccgagattacactgaaatatcccggcatcagccagtcttccgggggcgacatcggagtgcatatggctcacgatgaccagagcgtctcctctaagattgtggcccattgccctccccaagacccgtgtcttgttcacggctgcatcgtgtgtgcgcacgggctgattaattaccagtgccataccgccctcagcgctttcgtcgtggtgttcgtttttagctctatcgccattatctgtctggctatcctttatagagtcctgaaatgcctcaagattgcccctcggaaagtgctgaaccccctgatgtggatcacagcgttcattagatgggtgtaccgcaagatggtcgcccgggtggctgataatatcaaccaggttaacagagaaattggatggatggagggcgggcagctcgtgctgggaaatcctgcccccatccctcgccacgtccccattccgcggtacagcacctatcttatgctgctcctgatcgtgtcctacgctagcgcctgttctgagctgatccaagcctccagcagaattacgacatgctctaccgaaggcgttaacaccaaatgtcgcctttccgggacagctctcatccgggcgggcagcgtgggagccgaggcttgcctgatgctgaagggcgtcaaggaagaccagaccaaatttctcaagattaaaacagtgtctagcgagctgtcctgtagagaggggcagagctattggacgggatctttctcccctaagtgccttagctcccgccggtgccatctggttggcgaatgtcacgtgaatagatgcctctcttggcgcgataacgagaccagcgccgaattttccttcgtcggggagtctacaaccatgcgggaaaataaatgttttgagcagtgcggaggctgggggtgtggctgcttcaacgtgaatcccagctgtctgtttgtgcacacatacctgcaatccgtcagaaaggaggcccttcgggttttcaactgcatcgactgggtgcataagctcaccctggaaattacggattttgacggatctgtgagcaccatcgatctgggcgcttccagctctcgcttcacaaattgggggtccgtcagcctctctctggacgccgagggaatctccggcagcaactctttttccttcattgaaagccccgggaaaggatatgcgatcgtggatgagcctttctccgaaattccgagacagggctttcttggggagatccggtgtaatagcgagtctagcgttctgtccgctcacgaatcttgcctcagagcccccaacctgattagctacaagcctatgatcgaccagctggagtgtaccacaaatcttatcgatcccttcgtggtctttgaacgcggctccctccctcagacccggaacgacaaaacgttcgccgcttctaagggaaatagaggcgtgcaagcctttagcaaagggtccgttcaggcggatctgacactgatgttcgacaactttgaggtggacttcgtcggagctgccgtgtcttgcgatgccgcttttctcaacctgaccggctgctatagctgtaatgccggggctcgcgtttgcctttccattacaagcaccggaaccggcacactgtctgcccataacaaggacggctccctccacatcgtgctgcccagcgaaaatgggacgaaggatcagtgtcaaattctgcatttcaccgtccctgaggtggaggaagagtttatgtactcttgcgacggagatgaaagaccccttctcgtgcggggcacactgatcgcgattgacccgttcgatgaccgcagagaggccgggggagagtccaccgtcgttaaccctaaaagcggctcctggaactttttcgattggttctctgggctgatgagctggtttggaggccccctcaagacaatcctgcttatctgtctgtacgtggctctctccattggcctgttctttctgcttatctatctggggcggaccggactcagcaaaatgtggctggccgctacgaagaaagcctcttga

SEQ ID NO: 14475 - RNA, 3480 nt, synthetic construct
  misc_feature 1..3480: note = derived and/or modified CDS sequence (opt5) from RVFV(2007000253)__JF326192.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatctcccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgatatcggagtccatatggctcacgacgatcaaagcgtgtcctctaagatcgttgcccattgccctccccaggacccgtgtctggtgcacggctgcattgtctgtgcgcacgggcttatcaactaccagtgccataccgccctgagcgctttcgtggtgattttcgtttttagctctacagccatcatttgtctcgctgtcctgtatagagtgcttaaatgcctgaagatcgcccctcggaaagtgctcaatcccctgatgtggatcaccgcgttcattagatgggtctacaagaaaatggtggcccgcgttgctgacaacatcaaccaggtgaatcgggaaattggatggatggagggcgggcaactggccctcggaaaccctgctcccatccctagacacgcccccattccgcgctacagcacgtatctgatgcttctgctcatcgtctcctacgccagcgcttgttctgagctgattcaggcgtccagccggatcacaacctgctctaccgaaggcgtgaatacaaagtgtagactgtccgggaccgcccttatccgcgctggcagcgccggagccgaggcttgcctcatgctgaagggcgttaaagaagatcagacaaagtttctgaaaattaagacggtgtctagcgagctctcctgtcgggaggggcagagctattggaccggatctttctcccctaaatgcctgagctccagacgctgccatcttgtcggcgaatgtcacgtgaaccggtgcctgtcttggagagacaatgagacaagcgccgaattttccttcgttggggagtctaccacaatgcgcgaaaacaagtgttttgagcaatgcggaggctgggggtgtggctgcttcaatgtgaaccccagctgtctctttgtccacacctacctgcagtccgtgcggaaggaggcgctgagagtgttcaattgcatcgattgggtccataaacttacgctcgaaattaccgactttgatggatctgttagcacaatcgacctgggcgcttccagctctcggttcaccaactgggggtccgtgagcctgtctctcgatgccgagggaatttccggcagcaattctttttccttcatcgaaagccccgggaagggatatgccatcgtggacgagcctttctccgaaattccgcgccagggctttctgggggagatcagatgtaacagcgagtctagcgtcctttccgctcacgaatcttgcctgcgggcccccaatctcgtgagctacaaacctatgattgatcagctggagtgtacaaccaacctgatcgaccccttcgttgtgtttgaaagaggctcccttcctcaaacgcgcaatgataagacattcgcggcttctaaaggaaaccggggcgtccaggcctttagcaaggggtccgtgcaggccgacctcaccctgatgttcgataactttgaggttgacttcgtgggagctgccgtctcttgcgacgctgcctttctgaatctcacaggctgctatagctgtaacgcgggggccagagtgtgcctgtccattaccagcaccggaacaggcacgctttctgctcataataaggatggctccctgcacatcgttctccccagcgaaaacgggaccaaagaccaatgtcagatcctgcatttcacagtgcctgaggtcgaggaagagtttatgtactcttgcgatggagacgaacgccccctgcttgtgaagggcaccctcattgccatcgatccgttcgacgatagacgggaggctgggggagagtccacagtggtcaatcctaaaagcggctcctggaactttttcgactggttctctgggctgatgagctggtttggaggccccctgaagaccattctcctgatctgtctttacgttgccctgtccattggcctcttctttctgctgatctatcttgggcgcacgggactgagcaaaatgtggctcgccgctacaaagaaggcgtcttga

SEQ ID NO: 14476 - RNA, 3480 nt, synthetic construct
  misc_feature 1..3480: note = derived and/or modified CDS sequence (opt5) from RVFV(MP12)__Z30318.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcaaaacgatggccgggattgctatgaccgtgctgcctgcccttgctgtgttcgccctggcgcccgtcgtgtttgccgaagatcctcacctcagaaaccggcccggaaagggccataattatatcgacggcatgacacaggaggatgctacctgtaaacctgttacatacgccggggcttgctcctctttcgacgtgctgctggagaagggaaaatttcccctcttccagagctatgcccaccatcgcaccctgcttgaagcggtccacgatacaattatcgccaaggctgacccgccttcctgtgatctgctcagcgcccacggcaacccctgcatgaaggagaaactggtgatgaagacccattgtcctaatgactaccagtctgctcaccatcttaacaatgatgggaaaatggcctccgttaagtgtcccccgaaatatgaactgacggaggactgcaacttttgcagacaaatgaccggagccagcctcaagaaaggctcttaccctctgcaggacctgttctgtcagtccagcgaagatgacgggtctaagctcaagacaaaaatgaagggagtgtgcgaggtcggcgtgcaggctctgaaaaagtgcgatggccaactttccaccgcgcacgaggtggtcccctttgccgttttcaaaaatagcaagaaggtgtatctggacaaactcgatctgaagacagaagagaaccttctgcctgactcctttgtgtgtttcgaacacaaagggcagtacaagggaaccatggattctggccagacgaaacgggagctcaagagctttgacatttcccagtgccccaagatcgggggacatggcagcaaaaagtgtacaggggatgctgccttctgctctgcctacgaatgtaccgctcaatatgccaatgcgtactgctcccacgctaacggaagcggcatcgtccagattcaggtgtctggcgtttggaaaaagcccctgtgtgtggggtatgagcgcgtcgtggttaaaagagagctgagcgccaagcctatccaacgggtggaaccgtgcacaacctgtattaccaagtgcgagccccatggactcgtcgtgcgctccacaggctttaaaatctctagcgccgtcgcttgtgcctccggggtgtgcgttacgggaagccagtctccttccaccgaaattacactgaagtaccccggcatcagccagtcttccgggggcgacatcggagtgcacatggctcatgatgaccagagcgtctcctctaaaattgtggcccactgccctccccaagacccgtgtcttgttcacgattgcatcgtgtgtgcgcatggcctgattaattatcagtgccacaccgccctcagcgctttcgtcgtggtgttcgtcttttcctctatcgccattatctgtctggctatcctttacagagttctgaagtgcctcaaaattgcccctcggaaggtgctgaaccccctgatgtggatcacagcgttcattagatggatctataaaaagatggtggcccgcgtcgctcataatattaaccaggtgaaccgggagatcgggtggatggaaggaggccagctcgttctggggaatcctgcccccattcctagacacgctcccatcccgcgctacagcacctaccttatgctgctcctgatcgtgtcctatgccagcgcctgttctgagctgattcaggcttccagccggatcacgacatgctctaccgagggagtcaacaccaagtgtagactttccggcacagcgctcattcgcgccgggagcgtgggcgctgaagcctgcctgatgctgaaaggagttaaggaggaccaaaccaaatttctcaagctgaaaacagtgtctagcgaactttcctgtcgggagggccagagctactggacggggtctttctcccctaagtgcctgagctccagacgctgccacctcgtcggagagtgtcatgtgaatcggtgcctgtcttggagagataacgaaaccagcgccgagttttccttcgttggcgaatctacaaccatgcgcgagaataagtgttttgaacagtgcgggggatggggctgtgggtgcttcaacgtgaatcccagctgtctgtttgtccacacatatcttcaatccgtgcggaaagaggctctcagagtgttcaactgcatcgactgggtccataagctgaccctggagattacggattttgacggctctgttagcaccatcgatctcggagcctccagctctcggttcacaaattggggctccgtgagcctgtctcttgacgcggaagggatctccggaagcaactctttttccttcattgagagccccggcaaagggtacgctatcgtggatgaacctttctccgagattccgcgccagggatttctgggcgaaatcagatgtaatagcgagtctagcgtcctctccgcccacgagtcttgcctgcgggcccccaacctgattagctataagcctatgatcgaccagcttgaatgtaccacaaatctcatcgatcccttcgtggtttttgagagagggtccctgcctcagacccgcaacgacaaaacgttcgctgcctctaagggcaatcggggagtgcaagcgtttagcaagggctccgtccaggctgatctgacactcatgttcgacaactttgaagtggacttcgttggggccgccgtgtcttgcgatgctgcctttctgaaccttaccggatgctacagctgtaatgctggcgccagagtctgcctgtccattacaagcaccgggaccggatctctctccgcgcataacaaagacggcagcctgcacatcgtgctgccctctgagaatggcacaaaggatcagtgtcaaattcttcacttcacggttcctgaagtggaggaggaatttatgtattcctgcgacggggatgagcgccccctcctggtcaaaggaaccctgatcgccattgacccgttcgatgacagacgggaagctggcggggagagcacagtggtgaaccctaagtccggatcttggaactttttcgattggttcagcggcctcatgtcctggtttgggggacccctgaaaaccatccttctgatctgtctctacgtcgccctgagcattggcctgttctttcttctgatctacctcggcgggacaggactgtctaagatgtggctcgctgccaccaagaaagcctcctga

SEQ ID NO: 14477 - RNA, 3480 nt, synthetic construct
  misc_feature 1..3480: note = derived and/or modified CDS sequence (opt5) from RVFV(BIME-01)__KX609032.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggattctggccagacgaagcgggaactgaaatcctttgacatttcccaatgccccaagatcgggggacacggcagcaagaaatgtacaggggatgctgccttctgctctgcctatgagtgtaccgctcagtacgccaatgcgtattgctcccatgctaacggaagcggcatcgtccagattcaagtgtctggcgtttggaagaaacccctctgtgtggggtacgagcgcgtcgtggttaagagagaactgagcgccaaacctatccagcgggtggagccgtgcacaacctgtattaccaagtgcgaaccccacggactggtcgtgcgctccacaggctttaagatctctagcgccgtcgcttgtgcctccggggtgtgcgttacgggaagccagtctccttccaccgagattacactcaaatatcccggcatcagccagtcttccgggggcgacatcggagtgcatatggctcacgatgaccaaagcgtctcctctaagattgtggcccattgccctccccaggacccgtgtctggttcacggctgcatcgtgtgtgcgcacgggcttattaattaccagtgccataccgccctgagcgctttcgtcgtggtgttcgtttttagctctgtcgccatcatttgtctcgctatcctgtataaagtgcttagatgcctgaagatcgcccctaaaaaggtgctcaaccccctgatgtggattacagcgttcatccggtgggtctacaaaaagatggtggccagagttgctgataatattaaccaggtgaaccgcgaaatcggatggatggagggcgggcaactggccctcggaaatcctgctcccattcctcggcacgcccccatcccgagatacagcacctatctgatgcttctgctcattatctcctacgccagcgcttgttctgagctgatccaggcgtccagccgcattacgacatgctctaccgaaggcgtcaacaccaagtgtcggctgtccgggacagcccttatcagagctggcagcgtgggagccgaggcctgcctcatgctgaaaggcgttaaggaagaccagaccaaatttctgaagattaaaacagtgtctagcgagctctcctgtcgcgaggggcagagctattggacgggatctttctcccctaagtgcctgagctcccggagatgccatcttgtcggcgaatgtcacgtgaatcgctgcctgtcttggcgggataacgagaccagcgctgaattttccttcgttggggagtctacaaccatgagagaaaataagtgttttgagcaatgcggaggctgggggtgtggctgcttcaacgtgaatcccagctgtctctttgtccacacatacctgcagtccgtgcgcaaagaggccctgcgggtgttcaactgcatcgactgggtccataaacttaccctcgaaattacggattttgacggatctgttagcaccatcgatctgggcgcgtccagctctagattcacaaattgggggtccgtgagcctgtctctcgacgctgagggaatctccggcagcaactctttttccttcattgaaagccccgggaaaggatatgccatcgtggatgagcctttctccgaaattccgcggcagggctttctgggggagatccgctgtaatagcgagtctagcgtcctttccgcccacgaatcttgcctgagagctcccaacctcattagctacaagcctatgatcgaccagctggagtgtaccacaaatctgatcgatcccttcgtggtttttgaacggggctcccttcctcaaaccagaaacgacaaaacgttcgccgcgtctaagggaaatcgcggcgtgcaggcttttagcaaggggtccgtccaggccgatctcacactgatgttcgacaactttgaggtggacttcgttggagccgctgtgtcttgcgatgccgcttttctgaacctcaccggctgctatagctgtaatgccggggcgcgggtctgcctgtccattacaagcaccggaaccggcacactttctgcccataacaaagacggctccctgcacatcgtgctccccagcgaaaatgggacgaaggatcaatgtcagattctgcatttcaccgttcctgaggtggaggaagagtttatgtactcttgcgacggagatgaaagacccctgcttgtcaaaggcacactcatcgctattgacccgttcgatgaccgcagagaggccgggggagagtccaccgtggtgaaccctaagagcggctcctggaactttttcgattggttctctgggctgatgagctggtttggaggccccctgaaaacaatcctcctgatctgtctttacgtcgctctgtccattggcctcttctttctgctgatctatcttgggcggaccggactgagcaagatgtggctcgccgccacgaagaaggcttcttga

SEQ ID NO: 14478 - RNA, 3480 nt, synthetic construct
  misc_feature 1..3480: note = derived and/or modified CDS sequence (opt5) from RVFV(200803166)__JF311381.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctgaaaaagggaaaatttcccctcttccagagctatgcccaccatcgcaccctgcttgaagcggtgcacgacacaatcattgccaaggctgatcccccttcctgtgacctgcagagcgcccacggcaatccctgcatgaaggagaaactcgttatgaagacccattgtcctaacgattaccaatctgctcactatctgaataacgacgggaaaatggcctccgtgaagtgcccgccgaaatacgaacttacggaggattgtaatttttgcagacagatgaccggagccagcctgaagaaaggctcttatcctctccaggacctgttctgtcagtccagcgaagacgatgggtctaagctgaagacaaaaatgaagggagtctgcgaggtgggcgtgcaagctctcaaaaagtgcgacggccagctgtccaccgcgcatgaggtcgttccctttgccgtgttcaaaaacagcaagaaggtgtaccttgataaactggacctcaagacagaagagaatctgcttcctgattcctttgtctgtttcgaacacaaagggcagtacaagggaaccatggactctggccagacgaaacgggagcttaagagctttgatatctcccaatgccccaagattgggggacacggcagcaaaaagtgtacaggggacgctgccttctgctctgcctatgaatgtaccgctcagtacgccaacgcgtattgctcccatgctaatggaagcggcatcgtgcagatccaagtttctggcgtgtggaaaaagcccctctgtgtcgggtacgagcgcgtggttgtgaaaagagagctgagcgccaagcctattcagcgggtcgaaccgtgcacaacctgtatcaccaagtgcgagccccacggactggtggtccgctccacaggctttaaaatttctagcgccgtggcttgtgcctccggggtttgcgtgacgggaagccagtctccttccaccgaaatcacactcaagtatcccggcattagccagtcttccgggggcgatatcggagtccatatggctcacgacgatcaaagcgtgtcctctaaaatcgttgcccattgccctccccaggacccgtgtctggtgcacggctgcattgtctgtgcgcacgggcttatcaactaccagtgccataccgccctgagcgctttcgtggtggttttcgtcttttcctctattgccatcatttgtctcgctatcctgtatagagtgcttaagtgcctgaaaatcgcccctcggaaggtgctcaatcccctgatgtggattacagcgttcatcagatgggtctacaaaaagatggtggcccgcgttgctgacaacattaaccaggtgaatcgggagatcggatggatggaaggcgggcaactggtcctcggaaaccctgcccccattcctagacacgctcccatcccgcgctacagcacctatctgatgcttctgctcattgtgtcctacgccacggcctgtagcgagctgatccaggcttcttcccggatcacaacctgcagcaccgagggcgttaatacaaagtgtagactgtctgggaccgcgcttattcgcgccggctccgtgggagctgaagcctgcctcatgctgaaaggcgtcaaggaggatcagacaaaatttctgaagatcaaaacggtgagctctgaactcagctgtcgggaggggcagtcctattggaccggcagcttctctcctaagtgcctgtccagcagacgctgccatcttgttggagagtgtcacgtgaaccggtgcctgtcctggagagacaatgaaacatctgccgagtttagcttcgtcggggaatccaccacaatgcgcgagaacaagtgttttgaacaatgcggaggctgggggtgtggctgcttcaatgtgaacccctcttgtctctttgtgcacacctacctgcagagcgtccggaaagaggctctgagagttttcaattgcattgattgggtgcataagctgacgctcgagatcaccgactttgatggatccgtgtctacaattgacctgggcgccagctccagccggttcaccaactgggggtctgtctccctgagcctcgatgcggaaggaatctctggctccaatagcttttctttcatcgagtcccccgggaaaggatatgctattgtggacgaacctttcagcgagatcccgcgccagggctttctgggggaaattagatgtaactccgagagctctgttcttagcgcccacgagtcctgcctgcgggcccccaatctcatctcttacaagcctatgattgatcagctggaatgtacaaccaacctgatcgaccccttcgtggtctttgagagaggcagccttcctcaaacgcgcaatgataaaacattcgctgcctccaagggaaaccggggcgtgcaggcgttttctaaggggagcgttcaggctgacctcaccctgatgttcgataactttgaagtggacttcgtcggagccgccgtgtcctgcgacgctgcctttctgaatctcacaggctgctattcttgtaacgctggggccagagtttgcctgagcatcacctccaccggaacaggcacgcttagcgcgcataataaagatggctctctgcacgtggtcctcccctccgagaacgggaccaaggaccaatgtcagattctgcatttcacagtgcctgaagtggaggaggaatttatgtacagctgcgatggagacgagcgccccctgcttgtcaaaggcaccctcatcgccattgatccgttcgacgatagacgggaagctgggggagagtctacagttgtgaatcctaagtccggcagctggaactttttcgactggttctccgggctgatgtcttggtttggaggccccctgaaaaccatcctcctgatttgtctttacgtggccctgagcatcggcctcttctttctgctgatctatcttgggcgcacgggactgtccaagatgtggctcgctgccacaaagaaagccagctga

SEQ ID NO: 14479 - RNA, 3480 nt, synthetic construct
  misc_feature 1..3480: note = derived and/or modified CDS sequence (opt5) from RVFV(Kenya 83 (21445))__DQ380198.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaagaaccctgaaaataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggatctgttctgtcagtccagcgaggacgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggattctggccagacgaagcgggaactgaaatcctttgacatttcccaatgccccaagatcgggggacacggcagcaagaaatgtacaggggatgctgccttctgctctgcctatgagtgtaccgctcagtacgccaatgcgtattgctcccatgctaacggaagcggcatcgtccagattcaagtgtctggcgtttggaagaaacccctctgtgtggggtacgagcgcgtcgtggttaagagagaactgagcgccaaacctatccagcgggtggagccgtgcacaacctgtattaccaagtgcgaaccccacggactggtcgtgcgctccacaggctttaagatctctagcgccgtcgcttgtgcctccggggtgtgcgttacgggaagccagtctccttccaccgagattacactcaaatatcccggcatcagccagtcttccgggggcgacatcggagtgcatatggctcacgatgaccaaagcgtctcctctaagattgtggcccattgccctccccaggatccgtgtctggttcacggctgcatcgtgtgtgcgcacgggcttattaattaccagtgccataccgccctgagcgctttcgtcgtggtgttcgtttttagctctatcgccattatctgtctcgctatcctgtatagagtccttaaatgcctgaagattgcccctcggaaagtgctcaaccccctgatgtggatcacagcgttcattagatgggtgtacaagaaaatggtcgcccgcgtggctgacaacatcaatcaggttaaccgggaaattggatggatggagggcgggcaactggccctcggaaatcctgctcccatccctagacacgcccccattccgcgctacagcacctatctgatgcttctgctcatcgtgtcctacgccagcgcttgttctgagctgatccaggcgtccagccggattacgacatgctctaccgaaggcgtcaacaccaagtgtagactgtccgggacagcccttatccgcgctggcagcgtgggagccgaggcctgcctcatgctgaagggcgttaaagaagaccagaccaagtttctgaaaattaagacagtgtctagcgagctctcctgtcgggaggggcagagctattggacgggatctttctcccctaaatgcctgagctccagacgctgccatcttgtcggcgaatgtcacgtgaatcggtgcctgtcttggagagataacgagaccagcgctgaattttccttcgttggggagtctacaaccatgcgcgaaaataagtgttttgagcaatgcggaggctgggggtgtggctgcttcaacgtgaatcccagctgtctctttgtccacacatacctgcagtccgtgcggaaggaggccctgagagtgttcaactgcatcgactgggtccataaacttaccctcgaaattacggattttgacggatctgttagcaccatcgatctgggcgcgtccagctctcggttcacaaattgggggtccgtgagcctgtctctcgacgctgagggaatctccggcagcaactctttttccttcattgaaagccccgggaagggatatgccatcgtggatgagcctttctccgaaattccgcgccagggctttctgggggagatcagatgtaatagcgagtctagcgtcctttccgcccacgaatcttgcctgcgggctcccaacctcattagctacaaacctatgatcgaccagctggagtgtaccacaaatctgatcgatcccttcgtggtttttgaaagaggctcccttcctcaaacccgcaacgacaagacgttcgccgcgtctaaaggaaaccggggcgtgcaggcttttagcaaggggtccgtccaggccgatctcacactgatgttcgacaattttgaggtggatttcgttggagccgctgtgtcttgcgacgccgcttttctgaacctcaccggctgctatagctgtaatgccggggcgagagtctgcctgtccattacaagcaccggaaccggcacactttctgcccataacaaggacggctccctgcacatcgtgctccccagcgaaaatgggacgaaagatcaatgtcagattctgcatttcaccgttcctgaggtggaggaagagtttatgtactcttgcgacggagatgaacgccccctgcttgtcaagggcacactcatcgctattgacccgttcgatgacagacgggaggccgggggagagtccaccgtggtgaaccctaaaagcggctcctggaactttttcgattggttctctgggctgatgagctggtttggaggccccctgaagacaatcctcctgatctgtctttacgtcgctctgtccattggcctcttctttctgctgatctatcttgggcgcaccggactgagcaaaatgtggctcgccgccacgaagaaggcttcttga

SEQ ID NO: 14480 - RNA, 3480 nt, synthetic construct
  misc_feature 1..3480: note = derived and/or modified CDS sequence (opt5) from RVFV(Entebbe)__DQ380191.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgcaccgcgctcttaaagccattatcgcggctgatggactgaataatattacatgtcatggcaaggaccctgaagataaaatcagcctcatcaaggggccgccccacaaaaagagagtcggagttgtgcggtgcgagcgcagacgggacgccaagcaaattggccgcgaaacgatggccgggatcgctatgaccgtgctgcctgcccttgctgtcttcgccctggcgcccgtggtttttgccgaggatcctcatctcagaaaccggcccggaaaaggccacaattacattgacggcatgacacaggaggatgctacctgtaagcctgtgacatatgccggggcttgctcctctttcgacgtcctgctggaaaaaggaaagtttcccctcttccagagctacgcccatcaccgcaccctgcttgaggcggtgcacgatacaatcattgccaaagctgacccgccttcctgtgatctgcagagcgcccatggcaacccctgcatgaaggaaaagctcgttatgaaaacccactgtcctaatgactatcaatctgctcattacctgaacaatgatgggaagatggcctccgtgaaatgtcccccgaagtatgagcttacggaagactgcaacttttgcagacagatgaccggagccagcctgaaaaagggctcttaccctctccaggacctgttctgtcagtccagcgaggatgacgggtctaaactgaagacaaagatgaaaggagtctgcgaggtgggcgtgcaagctctcaagaaatgcgatggccagctgtccaccgcgcacgaagtcgttccctttgccgtgttcaagaatagcaaaaaggtgtatcttgacaagctggatctcaaaacagaggaaaacctgcttcctgactcctttgtctgtttcgagcacaaggggcagtacaaaggaaccatggattctggccagatcaagcgggaactgaaatcctttgacattagccaatgccccaagatcgggggacatggcagcaagaaatgtacgggggatgctgccttctgctctgcctacgagtgtacagctcagtatgccaatgcgtactgctcccacgctaacggaagcggcatcgtgcagattcaagtttctggcgtgtggaagaaacccctctgtgtcgggtatgagcgcgtggttgtgaagagagaactgagcgccaaacctatccagcgggtcgagccgtgcaccacatgtattaccaagtgcgaaccccatggactggtggtccgctccaccggctttaagatctctagcgccgtggcttgtgcctccggggtttgcgtgacaggaagccagtctccttccacggagattaccctcaaataccccggcatcagccagtcttccgggggcgacatcggagtccacatggctcatgatgaccaaagcgtgtcctctaagattgttgcccactgccctccccaggacccgtgtctggtgcacggctgcatcgtctgtgcgcatgggcttattaattatcagtgccacacagccctgagcgctttcgtggtggttttcgtcttttcctctgtggccatcatttgtctcgctatcctgtacaaagtgcttaagtgcctgaaaatcgcccctagaaaggtcctcaaccccctgatgtggattaccgcgttcatccggtgggtgtataaaaagatggttgccagagtggctgataatattaaccaggtcaaccgcgaaatcggatggatggagggcgggcaactggtgctcggaaatcctgcccccattcctcggcatgctcccatcccgagatacagcacatacctgatgcttctgctcattgtttcctatgccagcgcctgttctgagctgatccaggcttccagccgcatcaccacgtgctctacagaaggcgtgaacaccaagtgtcggctgtccgggaccgcgcttattagagccggcagcgtcggagctgaggcctgcctcatgctgaaaggcgtgaaggaagaccagacaaaatttctgaagatcaaaaccgtttctagcgagctctcctgtcgcgaggggcagagctactggacaggatctttctcccctaagtgcctgagctcccggagatgccaccttgtgggcgaatgtcacgtcaatcgctgcctgtcttggcgggataacgagacgagcgccgaattttccttcgtgggggagtctaccacaatgagagaaaataagtgttttgagcaatgcggaggctgggggtgtggctgcttcaacgtgaatcccagctgtctctttgtccatacctatctgcagtccgttcgcaaagaggctctgcgggtgttcaactgcattgactgggtgcacaaacttacactcgaaatcaccgattttgacggatctgtcagcacggtggatctgggcgcctccagctctagattcaccaattgggggtccgttagcctgtctctcgacgcggagggaatttccggcagcaactctttttccttcatcgaaagccccgggaagggatacgctatcgtggatgagcctttctccgaaattccgcggcagggctttctgggggagatccgctgtaatagcgagtctagcgtcctttccgcccatgaatcttgcctgagagcccccaacctcattagctataagcctatgatcgaccagctggagtgtacaaccaatctgattgatcccttcgtggtttttgaacggggctcccttcctcaaacaagaaacgacaaaaccttcgctgcctctaagggaaatcgcggcgtgcaggcgtttagcaaggggtccgtccaggctgatctcacgctgatgttcgacaactttgaggtggacttcgttggagccgccgtgtcttgcgatgctgcctttctgaacctcacaggctgctacagctgtaatgctggggcccgggtctgcctgtccatcaccagcacaggaaccggcaccctttctgcgcacaacaaagacggctccctgcatatcgtgctccccagcgaaaatgggacaaaggatcaatgtcagattctgcacttcacggtgcctgaggtcgaggaagagtttatgtattcttgcgacggagatgaaagacccctgcttgttaaaggcaccctcatcgccattgacccgttcgatgaccgcagagaggctgggggagagtccacagtggtgaaccctaagagcggctcctggaactttttcgattggttctctgggctgatgagctggtttggaggccccctgaaaaccatcctcctgatttgtctttacgtcgccctgtccatcggcctcttctttctgctgatctaccttgggcggacaggactgagcaagatgtggctcgctgccaccaagaaagcctcttga

SEQ ID NO: 14481 - RNA, 3480 nt, synthetic construct
  misc_feature 1..3480: note = derived and/or modified CDS sequence (opt5) from RVFV(763/70)__DQ380188.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcgtcaaggggccgccccataaaaagagagttggaatcgtgcggtgcgagcgcagacgggacgccaagcaaattggccgcgaaacgatggccgggatcgctatgaccgtgctgcctgcccttgctgtcttcgccctggcgcccgtggtttttgccgaggatcctcacctcagaaaccggcccggaaaaggccataattatattgacggcatgacacaggaggatgctacctgtaagcctgtgacatacgccggggcttgctcctctttcgacgtcctgctggaaaaaggaaagtttcccctcttccagagctatgcccaccatcgcaccctgcttgaggcggtgcacgatacaatcattgccaaagctgacccgccttcctgtgatctgcagagcgcccacggcaacccctgcatgaaggaaaagctcgttatgaaaacccattgtcctaatgactaccaatctgctcactatctgaacaatgatgggaagatggcctccgtgaaatgtcccccgaagtacggacttacggaggactgcaacttttgcagacagatgaccggcgccagcctgaaaaaggggtcttatcctctccaggacctgttctgtcagtccagcgaagatgacggatctaaactgaagacaaagatgaaaggcgtctgcgaggtgggcgtgcaagctctcaagaaatgcgatgggcagctgtccaccgcgcatgaggtcgttccctttgccgtgttcaagaatagcaaaaaggtgtaccttgacaagctggatctcaaaacagaagagaacctgcttcctgactcctttgtctgtttcgaacacaagggacagtacaaaggcaccatggattctgggcagacgaagcgggagctgaaatcttttgacatctcccaatgccccaagattggaggccacgggagcaagaaatgtacaggagatgctgccttctgctctgcctatgaatgtaccgctcagtacgccaatgcgtattgctcccatgctaacggcagcggcatcgtgcagatccaagtttctggggtgtggaagaaacccctctgtgtcggatacgagcgcgtggttgtgaagagagagctgagcgccaaacctattcagcgggtcgaaccgtgcacaacctgtatcaccaagtgcgagccccacggcctggtggtccgctccacagggtttaagatttctagcgccgtggcttgtgcctccggagtttgcgtgacgggcagccagtctccttccaccgaaatcacactcaaatatcccgggattagccagtcttccggcggagacatcggcgtccatatggctcacgatgaccaaagcgtgtcctctaagatcgttgcccattgccctccccaggacccgtgtctggtgcacgggtgcattgtctgtgcgcacggacttatcaattaccagtgccataccgccctgagcgctttcgtggtggttttcgtcttttcctctgtggccattatctgtctcgctattctgtataaagtgcttaagtgcctgaaaatcgcccctagaaaggtcctcaaccccctgatgtggatcacagcgttcattcggtgggtgtacaaaaagatggttgccagagtggctgataatatcaaccaggtcaaccgcgagattggctggatggaagggggacaactggccctcggcaatcctgctcccatccctcggcacgcccccattccgagatacagcacctatctgatgcttctgctcatcgtgtcctacgccagcgcttgttctgagctgattcaggcgtccagccgcatcacgacatgctctaccgagggggttaacaccaagtgtcggctgtccggcacagcccttatcagagctggaagcgtgggcgccgaagcctgcctcatgctgaaaggggtcaaggaggaccagaccaaatttctgaagattaaaacagtgtctagcgaactctcctgtcgcgagggacagagctattggacgggctctttctcccctaagtgcctgagctcccggagatgccatcttgttggggagtgtcacgtgaatcgctgcctgtcttggcgggataacgaaaccagcgctgagttttccttcgtcggagaatctacaaccatgagagagaataagtgttttgaacaatgcggcgggtggggctgtggatgcttcaacgtgaatcccagctgtctctttgtgcacacatacctgcagtccgtccgcaaagaggccctgcgggttttcaactgcatcgactgggtgcataagctcaccctcgagattacggattttgacggctctgtgagcaccatcgatctgggggcgtccagctctagattcacaaattggggatccgtcagcctgtctctcgacgctgaaggcatttccgggagcaactctttttccttcatcgagagccccggaaaaggctatgccatcgtggatgaacctttctccgagattccgcggcaggggtttctgggcgaaatccgctgtaatagcgagtctagcgttctttccgcccacgagtcttgcctgagagctcccaacctcattagctacaagcctatgatcgaccagctggaatgtaccacaaatctgattgatcccttcgtggtctttgagcggggatcccttcctcaaaccagaaacgacaaaacgttcgccgcgtctaagggcaatcgcggggtgcaggcttttagcaagggatccgttcaggccgatctcacactgatgttcgacaactttgaagtggacttcgtcggcgccgctgtgtcttgcgatgccgcttttctgaacctcaccgggtgctatagctgtaatgccggagcgcgggtttgcctgtccatcacaagcaccggcaccggcacactttctgcccataacaaagacgggtccctgcacatcgtgctccccagcgagaatggaacgaaggatcaatgtcagattctgcatttcaccgtccctgaagtggaggaggaatttatgtactcttgcgacggcgatgagagacccctgcttgtgaaagggacactcatcgctattgacccgttcgatgaccgcagagaagccggaggcgagtccaccgtcgttaaccctaagagcgggtcctggaactttttcgattggttctctggactgatgagctggtttggcggccccctgaaaacaatcctcctgatttgtctttacgtggctctgtccatcgggcttttctttctgctgatctatcttggacggaccggcctgagcaagatgtggctcgccgccacgaagaaagctagctga

SEQ ID NO: 14482 - RNA, 3480 nt, synthetic construct
  misc_feature 1..3480: note = derived and/or modified CDS sequence (opt5) from RVFV(OS-1)__DQ380186.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgccaaagagacgccaagcagatcggccgggaaacgatggccgggattgctatgaccgtgctgcctgcccttgctgtgttcgccctggcgcccgtcgtgtttgccgaggatcctcacctccgcaacagacccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcggaccctgcttgaggcggtccacgatacaattatcgccaaagctgacccgccttcctgtgatctgcaaagcgcccacggcaacccctgcatgaaggaaaagctcgtgatgaaaacccattgtcctaatgactaccagtctgctcactatctgaacaatgatgggaagatggcctccgttaaatgtcccccgaagtacgagcttacggaagactgcaacttttgccgccagatgaccggagccagcctgaaaaagggctcttatcctctccaggacctgttctgtcaatccagcgaggatgacgggtctaaactgaagacaaagatgaaaggagtgtgcgaggtcggcgtgcaggctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggattctggccaaacgaagagagaactgaaatcctttgacattagccagtgccccaagatcgggggacacggcagcaagaaatgtacaggggatgctgccttctgctctgcctatgagtgtaccgctcagtacgccaatgcgtattgctcccatgctaacggaagcggcgtcgtgcaaatccaggtttctggcgtgtggaagaaacccctctgtgtcgggtacgagcgggtggttgtgaagcgcgaactgagcgccaaacctattcagagagtcgagccgtgcacaacctgtatcaccaagtgcgaaccccacggactggtggtccggtccacaggctttaagatttctagcgccgtggcttgtgcctccggggtttgcgtgacgggaagccagtctccttccaccgagatcacactcaaatatcccggcattagccaatcttccgggggcgacatcggagtccatatggctcacgatgaccagagcgtgtcctctaagatcgttgcccattgccctccccaggacccgtgtctggtgcacggctgcattgtctgtgcgcacgggcttatcaattaccagtgccataccgccctgagcgctttcgtggtggttttcgtcttttcctctgtggccattatctgtctcgctattctgtataaagtgcttaagtgcctgaaaatcgcccctcgcaaggtcctcaaccccctgatgtggatcacagcgttcattagatgggtgtacaaaaagatggttgcccgggtggctgataatatcaaccaagtcaacagagaaattggatggatggagggcgggcagctggccctcggaaatcctgctcccatccctcgccacgcccccattccgcggtacagcacctatctgatgcttctgctcatcgtgtcctacgccagcgcttgttctgagctgattcaggcgtccagcagaatcacgacatgctctaccgaaggcgttaacaccaagtgtcgcctgtccgggacagcccttatccgggctggcagcgtgggagccgaggcctgcctcatgctgaaaggcgtcaaggaagaccagaccaaatttctgaagattaaaacagtgtctagcgagctctcctgtagagaggggcaaagctattggacgggatctttctcccctaagtgcctgagctcccgccggtgccatcttgttggcgaatgtcacgtgaatagatgcctgtcttggcgcgataacgagaccagcgctgaattttccttcgtcggggagtctacaaccatgcgggaaaataagtgttttgagcagtgcggaggctgggggtgtggctgcttcaacgtgaatcccagctgtctctttgtgcacacatacctgcagtccgtcagaaaagaggccctgaaggttttcaactgcatcgactgggtgcataaacttaccctcgaaattacggattttgacggatctgtgagcaccatcgatctgggcgcgtccagctctcgcttcacaaattgggggtccgtcagcctgtctctcgacgctgagggaatttccggcagcaactctttttccttcatcgaaagccccgggaagggatatgccatcgtggatgagcctttctccgaaattccgcggcagggctttctgggggagatcagatgtaatagcgagtctagcgttctttccgcccacgaatcttgcctgcgggctcccaacctcattagctacaaacctatgatcgaccaactggagtgtaccacaaatctgattgatcccttcgtggtctttgaacgcggctcccttcctcagaccagaaacgacaagacgttcgccgcgtctaagggaaatcggggcgtgcaggcttttagcaaagggtccgttcaagccgatctcacactgatgttcgacaactttgaggtggacttcgtcggagccgctgtgtcttgcgatgccgcttttctgaacctcaccggctgctatagctgtaatgccggggcgagagtttgcctgtccatcacaagcaccggaaccggcacactttctgcccataacaaggacggctccctgcacatcgtgctccccagcgaaaatgggacgaaagatcagtgtcagattctgcatttcaccgtccctgaggtggaggaagagtttatgtactcttgcgacggagatgaacgccccctgcttgtgaagggcacactcatcgctattgacccgttcgatgaccggagagaggccgggggagagtccaccgtcgttaaccctaaaagcggctcctggaactttttcgattggttctctgggctgatgagctggtttggaggccccctgaagacaatcctcctgatttgtctttacgtggctctgtccatcggcctcttctttctgctgatctatcttgggcgcaccggactgagcaagatgtggctcgccgccacgaaaaaggcttcttga

SEQ ID NO: 14483 - RNA, 3480 nt, synthetic construct
  misc_feature 1..3480: note = derived and/or modified CDS sequence (opt5) from RVFV(2008/00101)__HE687306.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatctcccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgatatcggagtccatatggctcacgacgatcaaagcgtgtcctctaagatcgttgcccattgccctccccaggacccgtgtctggtgcacggctgcattgtctgtgcgcacgggcttatcaactaccagtgccataccgccctgagcgctttcgtggtgattttcgtttttagctctacagccatcatttgtctcgctgtcctgtatagagtgcttaaatgcctgaagatcgcccctcggaaagtgctcaatcccctgatgtggatcaccgcgttcattagatgggtctacaagaaaatggtggcccgcgttgctgacaacatcaaccaggtgaatcgggaaattggatggatggagggcgggcaactggccctcggaaaccctgctcccatccctagacacgcccccattccgcgctacagcacgtatctgatgcttctgctcatcgtctcctacgccagcgcttgttctgagctgattcaggcgtccagccggatcacaacctgctctaccgaaggcgtgaatacaaagtgtagactgtccgggaccgcccttatccgcgctggcagcgttggagccgaggcctgcctcatgctgaagggcgtgaaagaagatcagacaaagtttctgaaaattaagacggtctctagcgagctctcctgtcgggaggggcagagctattggaccggatctttctcccctaaatgcctgagctccagacgctgccatcttgtgggcgaatgtcacgttaaccggtgcctgtcttggagagacaatgagacaagcgctgaattttccttcgtgggggagtctaccacaatgcgcgaaaacaagtgttttgagcaatgcggaggctgggggtgtggctgcttcaatgtcaaccccagctgtctctttgtgcacacctacctgcagtccgtgcggaaggaggccctgagagtcttcaattgcatcgattgggttcataaacttacgctcgaaattaccgactttgatggatctgtgagcacaatcgacctgggcgcgtccagctctcggttcaccaactgggggtccgtgagcctgtctctcgatgctgagggaatttccggcagcaattctttttccttcatcgaaagccccgggaagggatatgccatcgtcgacgagcctttctccgaaattccgcgccagggctttctgggggagatcagatgtaacagcgagtctagcgtgctttccgcccacgaatcttgcctgcgggctcccaatctcgttagctacaaacctatgattgatcagctggagtgtacaaccaacctgatcgaccccttcgtggtctttgaaagaggctcccttcctcaaacgcgcaatgataagacattcgccgcgtctaaaggaaaccggggcgtgcaggcttttagcaaggggtccgttcaggccgacctcaccctgatgttcgataactttgaggtggacttcgtcggagccgctgtgtcttgcgacgccgcttttctgaatctcacaggctgctatagctgtaacgccggggcgagagtttgcctgtccattaccagcaccggaacaggcacgctttctgcccataataaggatggctccctgcacatcgtgctccccagcgaaaacgggaccaaagaccaatgtcagatcctgcatttcacagtccctgaggtggaggaagagtttatgtactcttgcgatggagacgaacgccccctgcttgtgaagggcaccctcattgctatcgatccgttcgacgatagacgggaggccgggggagagtccacagtcgttaatcctaaaagcggctcctggaactttttcgactggttctctgggctgatgagctggtttggaggccccctgaagaccacgctcctgatttgtctttacgtggctctgtccatcggcctcttctttctgctgatttatcttgggcgcacaggactgagcaaaatgtggctcgccgccaccaagaaggcttcttga

SEQ ID NO: 14484 - RNA, 3480 nt, synthetic construct
  misc_feature 1..3480: note = derived and/or modified CDS sequence (opt5) from RVFV(200803162)__JF311377.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatctcccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctctgtgtcgggtacgagcgcgtggttgtgaagagagaactgagcgccaaacctattcagcgggtcgagccgtgcacaacctgtatcgccaagtgcgaaccccacggactggtggtccgctccaccggctttaagatttctagcgctgtggcctgtgcttccggggtttgcgtgacaggaagccagtctccttccacggagatcaccctcaaatatcccggcattagccagtcttccgggggcgatatcggagtccatatggcccacgacgatcaaagcgtgtcctctaagatcgttgcgcattgccctccccaggacccgtgtctggtgcacgactgcattgtctgtgcccacggccttatcaactaccagtgccatacagctctgagcgccttcgtggtgattttcgtttttagctctaccgctatcatttgtctcgccgtcctgtatagagtgcttaaatgcctgaagatcgcgcctcggaaagtgctcaatcccctgatgtggatcacagccttcattagatgggtctacaagaaaatggtggctcgcgttgccgataacatcaaccaggtgaatcgggaaattgggtggatggagggaggccaactggctctcagaaaccctgcccccatccctcgccacgcccccattccgcggtacagcacctatctgatgcttctgctcatcgtctcctacgctagcgcgtgttctgagctgattcaggcctccagcagaatcacgacatgctctaccgaaggggtgaataccaagtgtcgcctgtccggaacagctcttatccgggccggcagcgttggggccgaggcttgcctcatgctgaagggcgtgaaagaagaccagaccaagtttctgaaaattaagacagtctctagcgagctctcctgtagagagggacagagctattggacgggctctttctcccctaaatgcctgagctcccgccggtgccatcttgtgggggaatgtcacgttaacagatgcctgtcttggcgcgataatgagaccagcgccgaattttccttcgtgggagagtctacaaccatgcgggaaaacaagtgttttgagcaatgcggcgggtggggatgtggctgcttcaatgtcaaccccagctgtctctttgtgcacacatacctgcagtccgtgagaaaggaggcgctgcgggtcttcaattgcatcgactgggttcataaacttaccctcgaaattacggattttgacgggtctgtgagcaccatcgatctgggcgcttccagctctcgcttcacaaactggggatccgtgagcctgtctctcgacgccgagggcatttccgggagcaattctttttccttcatcgaaagccccggaaagggctatgccatcgtcgatgagcctttctccgaaattccgagacaggggtttctgggagagatccggtgtaacagcgagtctagcgtgctttccgctcacgaatcttgcctgagagcccccaatctcgttagctacaaacctatgattgaccagctggagtgtaccacaaacctgatcgatcccttcgtggtctttgaacgcggctcccttcctcaaacccggaatgacaagacgttcgcggcttctaaagggaacagaggcgtgcaggcctttagcaagggatccgttcaggccgatctcacactgatgttcgacaactttgaggtggacttcgtcggcgctgccgtgtcttgcgatgctgcctttctgaatctcaccgggtgctatagctgtaacgcgggagcccgcgtttgcctgtccattacaagcaccggcaccgggacactttctgctcataataaggacggatccctgcacatcgtgctccccagcgaaaacggcacgaaagatcaatgtcagatcctgcatttcaccgtccctgaggtggaggaagagtttatgtactcttgcgacggcgatgaaagacccctgcttgtgaaggggacactcattgccatcgacccgttcgatgaccggcgcgaggctggaggcgagtccaccgtcgttaatcctaaaagcgggtcctggaactttttcgattggttctctggactgatgagctggtttggcgggcccctgaagacaattctcctgatctgtctttacgtggccctgtccattggactcttctttctgctgatctatcttggcagaaccggcctgagcaaaatgtggctcgccgctacgaagaaggcgtcttga

SEQ ID NO: 14485 - RNA, 3480 nt, synthetic construct
  misc_feature 1..3480: note = derived and/or modified CDS sequence (opt5) from RVFV(2007002060)__EU574039.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagaaaggatgccaaacaaattggccgggaaacgatggccgggatcgctatgaccgtgctgcctgcccttgctgtcttcgccctggcgcccgtggtttttgccgaggaccctcacctccgcaatagacccggaaagggccataactatattgatggcatgacacaggaggacgctacctgtaaacctgtgacatacgccggggcttgctcctctttcgatgtcctgctggaaaagggaaaatttcccctcttccagagctatgcccaccatcggaccctgcttgaggcggtgcacgacacaatcattgccaaggctgatcccccttcctgtgacctgcagagcgcccacggcaatccctgcatgaaggaaaaactcgttatgaagacccattgtcctaacgattaccaatctgctcactatctgaataacgacgggaaaatggcctccgtgaagtgcccgccgaaatacgagcttacggaagattgtaatttttgccgccagatgaccggagccagcctgaagaaaggctcttatcctctccaggacctgttctgtcagtccagcgaggacgatgggtctaagctgaagacaaaaatgaagggagtctgcgaggtgggcgtgcaagctctcaaaaagtgcgacggccagctgtccaccgcgcatgaagtcgttccctttgccgtgttcaaaaacagcaagaaggtgtaccttgataaactggacctcaagacagaggaaaatctgcttcctgattcctttgtctgtttcgagcacaaagggcagtacaagggaaccatggactctggccagacgaaaagagaactgaagtcctttgatatctcccaatgccccaagattgggggacacggcagcaaaaagtgtacaggggacgctgccttctgctctgcctatgagtgtaccgctcagtacgccaacgcgtattgctcccatgctaatggaagcggcatcgtgcagatccaagtttctggcgtgtggaaaaagcccctctgtgtcgggtacgagcgggtggttgtgaaacgcgaactgagcgccaagcctattcagagagtcgagccgtgcacaacctgtatcaccaagtgcgaaccccacggactggtggtccggtccacaggctttaaaatttctagcgccgtggcttgtgcctccggggtttgcgtgacgggaagccagtctccttccaccgagatcacactcaagtatcccggcattagccagtcttccgggggcgatatcggagtccatatggctcacgacgatcaaagcgtgtcctctaaaatcgttgcccattgccctccccaggacccgtgtctggtgcacggctgcattgtctgtgcgcacgggcttatcaactaccagtgccataccgccctgagcgctttcgtggtgattttcgtttttagctctacagccatcatttgtctcgctgtcctgtatcgcgtgcttaagtgcctgaaaatcgcccctagaaaggtgctcaatcccctgatgtggatcaccgcgttcattcggtgggtctacaaaaagatggtggccagagttgctgacaacatcaaccaggtgaatcgcgaaattggatggatggagggcgggcaactggccctcggaaaccctgctcccatccctcggcacgcccccattccgagatacagcacgtatctgatgcttctgctcatcgtctcctacgccagcgcttgttctgagctgattcaggcgtccagccgcatcacaacctgctctaccgaaggcgtgaatacaaagtgtcggctgtccgggaccgcccttatcagagctggcagcgttggagccgaggcctgcctcatgctgaaaggcgtgaaggaagatcagacaaaatttctgaagattaaaacggtctctagcgagctctcctgtcgcgaggggcagagctattggaccggatctttctcccctaagtgcctgagctcccggagatgccatcttgtgggcgaatgtcacgttaaccgctgcctgtcttggcgggacaatgagacaagcgctgaattttccttcgtgggggagtctaccacaatgagagaaaacaagtgttttgagcaatgcggaggctgggggtgtggctgcttcaatgtcaaccccagctgtctctttgtgcacacctacctgcagtccgtgcgcaaagaggccctgcgggtcttcaattgcatcgattgggttcataaacttacgctcgaaattaccgactttgatggatctgtgagcacaatcgacctgggcgcgtccagctctagattcaccaactgggggtccgtgagcctgtctctcgatgctgagggaatttccggcagcaattctttttccttcatcgaaagccccgggaaaggatatgccatcgtcgacgagcctttctccgaaattccgcggcagggctttctgggggagatccgctgtaacagcgagtctagcgtgctttccgcccacgaatcttgcctgagagctcccaatctcgttagctacaagcctatgattgatcagctggagtgtacaaccaacctgatcgaccccttcgtggtctttgaacggggctcccttcctcaaacgagaaatgataaaacattcgccgcgtctaagggaaaccgcggcgtgcaggcttttagcaaggggtccgttcaggccgacctcaccctgatgttcgataactttgaggtggacttcgtcggagccgctgtgtcttgcgacgccgcttttctgaatctcacaggctgctatagctgtaacgccggggcgcgggtttgcctgtccattaccagcaccggaacaggcacgctttctgcccataataaagatggctccctgcacatcgtgctccccagcgaaaacgggaccaaggaccaatgtcagatcctgcatttcacagtccctgaggtggaggaagagtttatgtactcttgcgatggagacgaaagacccctgcttgtgaaaggcaccctcattgctatcgatccgttcgacgatcgcagagaggccgggggagagtccacagtcgttaatcctaagagcggctcctggaactttttcgactggttctctgggctgatgagctggtttggaggccccctgaaaaccattctcctgatctgtctttacgtggctctgtccattggcctcttctttctgctgatctatcttgggcggacgggactgagcaagatgtggctcgccgccacaaagaaggcttcttga

SEQ ID NO: 14486 - RNA, 3480 nt, synthetic construct
  misc_feature 1..3480: note = derived and/or modified CDS sequence (opt5) from RVFV(2007002476)__EU574036.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatctcccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgatatcggagtccatatggctcacgacgatcaaagcgtgtcctctaagatcgttgcccattgccctccccaggacccgtgtctggtgcacggctgcattgtctgtgcgcacgggcttatcaactaccagtgccataccgccctgagcgctttcgtggtgattttcgtttttagctctacagccatcatttgtctcgctgtcctgtatagagtgcttaaatgcctgaagatcgcccctcggaaagtgctcaatcccctgatgtggatcaccgcgttcattaagtgggtctacaaaaagatggtggccagagttgctgacaacatcaaccaggtgaatcgcgaaattggatggatggagggcgggcaactggccctcggaaaccctgctcccatccctcggcacgcccccattccgagatacagcacgtatctgatgcttctgctcatcgtctcctacgccagcgcttgttctgagctgattcaggcgtccagccgcatcacaacctgctctaccgaaggcgtgaatacaaagtgtcggctgtccgggaccgcccttatcagagctggcagcgttggagccgaggcctgcctcatgctgaaaggcgtgaaggaagatcagacaaaatttctgaagattaaaacggtctctagcgagctctcctgtcgcgaggggcagagctattggaccggatctttctcccctaagtgcctgagctcccggagatgccatcttgtgggcgaatgtcacgttaaccgctgcctgtcttggcgggacaatgagacaagcgctgaattttccttcgtgggggagtctaccacaatgagagaaaacaagtgttttgagcaatgcggaggctgggggtgtggctgcttcaatgtcaaccccagctgtctctttgtgcacacctacctgcagtccgtgcgcaaagaggccctgcgggtcttcaattgcatcgattgggttcataaacttacgctcgaaattaccgactttgatggatctgtgagcacaatcgacctgggcgcgtccagctctagattcaccaactgggggtccgtgagcctgtctctcgatgctgagggaatttccggcagcaattctttttccttcatcgaaagccccgggaaaggatatgccatcgtcgacgagcctttctccgaaattccgcggcagggctttctgggggagatccgctgtaacagcgagtctagcgtgctttccgcccacgaatcttgcctgagagctcccaatctcgttagctacaagcctatgattgatcagctggagtgtacaaccaacctgatcgaccccttcgtggtctttgaacggggctcccttcctcaaacgagaaatgataaaacattcgccgcgtctaagggaaaccgcggcgtgcaggcttttagcaaggggtccgttcaggccgacctcaccctgatgttcgataactttgaggtggacttcgtcggagccgctgtgtcttgcgacgccgcttttctgaatctcacaggctgctatagctgtaacgccggggcgcgggtttgcctgtccattaccagcaccggaacaggcacgctttctgcccataataaagatggctccctgcacatcgtgctccccagcgaaaacgggaccaaggaccaatgtcagatcctgcatttcacagtccctgaggtggaggaagagtttatgtactcttgcgatggagacgaaagacccctgcttgtgaaaggcaccctcattgctatcgatccgttcgacgatcgcagagaggccgggggagagtccacagtcgttaatcctaagagcggctcctggaactttttcgactggttctctgggctgatgagctggtttggaggccccctgaaaaccattctcctgatctgtctttacgtggctctgtccattggcctcttctttctgctgatctatcttgggcggacgggactgagcaagatgtggctcgccgccacaaagaaggcttcttga

SEQ ID NO: 14487 - RNA, 3480 nt, synthetic construct
  misc_feature 1..3480: note = derived and/or modified CDS sequence (opt5) from RVFV(2269/74)__DQ380222.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagcacaaaggaaccatggattctggccagacgaagcgggaactgaaatcctttgacatttcccaatgccccaagatcgggggacatggcagcaagaaatgtacaggggatgctgccttctgctctgcctacgagtgtaccgctcagtatgccaatgcgtactgctcccacgctaacggaagcggcatcgtccagattcaagtgtctggcgtttggaagaaacccctctgtgtggggtatgagcgcgtcgtggttaagagagaactgagcgccaaacctatccagcgggtggagccgtgcacaacctgtattaccaagtgcgaaccccatggactggtcgtgcgctccacaggctttaagatctctagcgccgtcgcttgtgcctccggggtgtgcgttacgggaagccagtctccttccaccgagattacactcaaataccccggcatcagccagtcttccgggggcgacatcggagtgcacatggctcatgatgaccaaagcgtctcctctaagattgtggcccactgccctccccaggacccgtgtctggttcacggctgcatcgtgtgtgcgcatgggcttattaattatcagtgccacaccgccctgagcgctttcgtcgtggtgttcgtttttagctctgtcgccatcatttgtctcgctatcctgtacaaagtgcttaagtgcctgaaaatcgcccctaagaaagtgctcaaccccctgatgtggattacagcgttcatcagatgggtctataagaagatggtggcccgggttgctgataatattaaccaggtgaacagagaaatcggatggatggagggcgggcaactggccctcggaaatcctgctcccattcctcgccatgcccccatcccgcggtacagcacctacctgatgcttctgctcattgtctcctatgccagcgcttgttctgagctgatccaggcgtccagcagaatcacgacatgctctaccgaaggcgtgaacaccaaatgtcgcctgtccgggacagcccttattcgggctggcagcgttggagccgaggcctgcctcatgctgaagggcgtgaaagaagaccagaccaagtttctgaaaatcaagacagtctctagcgagctctcctgtagagaggggcagagctactggacgggatctttctcccctaagtgcctgagctcccgccggtgccaccttgtgggcgaatgtcacgttaatagatgcctgtcttggcgcgataacgagaccagcgctgaattttccttcgtgggggagtctacaaccatgcgggaaaataaatgttttgagcaatgcggaggctgggggtgtggctgcttcaacgtcaatcccagctgtctctttgtgcatacatatctgcagtccgtgagaaaggaggccctgcgcgtcttcaactgcattgactgggttcacaaacttaccctcgaaatcacggattttgacggatctgtgagcaccattgatctgggcgcgtccagctctcggttcacaaattgggggtccgtgagcctgtctctcgacgctgagggaatctccggcagcaactctttttccttcatcgaaagccccgggaagggatacgccattgtcgatgagcctttctccgaaatcccgagacagggctttctgggggagattcggtgtaatagcgagtctagcgtgctttccgcccatgaatcttgcctgcgcgctcccaacctcatcagctataaacctatgattgaccagctggagtgtaccacaaatctgatcgatcccttcgttgtgtttgaaagaggctcccttcctcaaacccggaacgacaagacgttcgccgcgtctaagggaaatagaggcgtccaggcttttagcaaagggtccgtgcaggccgatctcacactgatgttcgacaactttgaggttgacttcgtgggagccgctgtctcttgcgatgccgcttttctgaacctcaccggctgctacagctgtaatgccggggcgcgcgtgtgcctgtccatcacaagcaccggaaccggcacactttctgcccacaacaaggacggctccctgcatattgttctccccagcgaaaatgggacgaaagatcaatgtcagatcctgcacttcaccgtgcctgaggtcgaggaagagtttatgtattcttgcgacggagatgaacggcccctgcttgtgaagggcacactcattgctatcgacccgttcgatgacagacgcgaggccgggggagagtccaccgtggtcaaccctaaaagcggctcctggaactttttcgattggttctctgggctgatgagctggtttggaggccccctgaagacaattctcctgatctgtctttacgttgctctgtccatcggcctcttctttctgctgatttaccttgggagaaccggactgagcaagatgtggctcgccgccacgaaaaaggcttcttga

SEQ ID NO: 14488 - RNA, 3480 nt, synthetic construct
  misc_feature 1..3480: note = derived and/or modified CDS sequence (opt5) from RVFV(73HB1449)__DQ380211.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaacaatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggattctggccagacgaagcgggaactgaaatcctttgacattagccaatgccccaagatcgggggacacggcagcaagaaatgtacaggggatgctgccttctgctctgcctatgagtgtaccgctcagtacgccaatgcgtattgctcccatgctaacggaagcggcatcgtccagattcaagtgtctggcgtttggaagaaacccctctgtgtggggtacgagcgcgtcgtggttaagagagaactgagcgccaaacctatccagcgggtggagccgtgcacaacctgtattaccaagtgcgaaccccacggactggtcgtgcgctccacaggctttaagatctctagcgccgtcgcttgtgcctccggggtgtgcgttacgggaagccagaatccttctaccgagattacactcaaatatcccggcatctcccagagctctgggggcgacatcggagtgcatatggctcacgatgaccaatccgtcagctccaagattgtggcccattgccctccccaggacccgtgtctggttcacggctgcatcgtgtgtgcgcacgggcttattaactaccagtgccataccgccctgtctgctttcgtcgtggtgttcgtttttagctccatcgccattatctgtctcgctatcctgtatagagtccttaaatgcctgaagattgcccctcggaaagtgctcaatcccctgatgtggatcacagcgttcattagatgggtgtacaagaaaatggtcgcccgcgtggctgataacatcaaccaggttaatcgggaaattggatggatggagggcgggcaactggtgctcggaaaccctgcccccatccctagacacgctcccattccgcgctactctacctatctgatgcttctgctcatcgtcagctacgcctccgcctgtagcgagctgatccaggcttcttcccggattacgacatgcagcaccgaaggcgtgaataccaagtgtagactgtctgggacagcgcttatccgcgccggctccgttggagctgaggcctgcctcatgctgaagggcgtgaaagacgatcagaccaagtttctgaaaattaagacagtcagctctgaactcagctgtcgggaggggcagtcctattggacgggcagcttctctcctaaatgcctgtccagcagacgctgccatcttgtgggagagtgtcacgttaaccggtgcctgtcctggagagacaatgaaacctctgccgagtttagcttcgtgggggaatccacaaccatgcgcgagaacaagtgttttgaacaatgcggaggctgggggtgtggctgcttcaatgtcaacccctcttgtctctttgtgcacacatacctgcagagcgtgcggaaggaggctctgagagtcttcaattgcatcgattgggttcataaacttaccctcgagattacggactttgatggatccgtgtctaccatcgacctgggcgccagctccagccggttcacaaactgggggtctgtgtccctgagcctcgatgcggaaggaatctctggctccaatagcttttctttcattgagtcccccgggaagggatatgctatcgtcgacgaacctttcagcgagattccgcgccagggctttctgggggaaatcagatgtaactccgagagctctgtgcttagcgcccacgagtcctgcctgcgggcccccaatctcatttcttacaaacctatgatcgatcagctggaatgtaccacaaacctgatcgaccccttcgttgtgtttgagagaggcagccttcctcaaacccgcaatgaaaagacgttcgctgcctccaaaggaaaccggggcgtccaggcgttttctaaggggagcgtgcaggctgatctcacactgatgttcgacaactttgaggttgacttcgtgggagccgccgtctcctgcgatgctgcctttctgaatctcaccggctgctattcttgtaacgctggggccagagtgtgcctgagcattacatccaccggaaccggcacacttagcgcgcataataaggacggctctctgcacatcgttctcccctccgaaaacgggacgaaagatcaatgtcagattctgcatttcaccgtgcctgaggtcgaggaagagtttatgtacagctgcgacggagatgaacgccccctgcttgtgaagggcacactcatcgccattgacccgttcgatgacagacgggaggctgggggagagtctaccgtggtcaatcctaaatccggcagctggaactttttcgattggttctccgggctgatgtcttggtttggaggccccctgaagacaatcctcctgatctgtctttacgttgccctgagcattggcctcttctttctgctgatctatcttgggcgcaccggactgtccaaaatgtggctcgctgccacgaagaaggccagctga

SEQ ID NO: 14489 - RNA, 3480 nt, synthetic construct
  misc_feature 1..3480: note = derived and/or modified CDS sequence (opt5) from RVFV(SA-51 (Van Wyck))__DQ380195.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggattctggccagacgaagcgggaactgaaatcctttgacatttcccaatgccccaagatcgggggacgcggcagcaagaaatgtacaggggatgctgccttctgctctgcctatgagtgtaccgctcagtacgccaatgcgtattgctcccacgctaacggaagcggcatcgtccagattcaagtgtctggcgtttggaagaaacccctctgtgtggggtacgagagagtcgtggttaagcgggaactgagcgccaaacctatccagcgcgtggagccgtgcacaacctgtattaccaagtgcgaaccccatggactggtcgtgagatccacaggctttaagatctctagcgccgtcgcttgtgcctccggggtgtgcgttacgggaagccagtctccttccaccgagattacactcaaatatcccggcatcagccagtcttccgggggcgacatcggagtgcacatggctcatgatgaccaaagcgtctcctctaagattgtggcccactgccctccccaggacccgtgtctggttcatggctgcatcgtgtgtgcgcacgggcttattaattaccagtgccacaccgccctgagcgctttcgtcgtggtgttcgtttttagctctgtcgccatcatttgtctcgctatcctgtataaagtgcttaagtgcctgaaaatcgcccctcggaaggtgctcaaccccctgatgtggattacagcgttcatcagatgggtctacaaaaagatggtggcccgcgttgctgataatattaaccaggtgaaccgggaaatcggatggatggagggcgggcaactggccctcggaaatcctgctcccattcctagacatgcccccatcccgcgctacagcacctatctgatgcttctgctcattgtctcctacgccagcgcttgttctgagctgatccaggcgtccagccggatcacgacatgctctaccgaaggcgtgaacaccaagtgtagactgtccgggacagcccttattcgcgctggcagcgttggagccgaggcctgcctcatgctgaaaggcgtgaaggaagaccagaccaaatttctgaagatcaaaacagtctctagcgagctctcctgtcgggaggggcagagctattggacgggatctttctcccctaagtgcctgagctccagacgctgccaccttgtgggcgaatgtcatgttaatcggtgcctgtcttggagagataacgagaccagcgctgaattttccttcgtgggggagtctacaaccatgcgcgaaaataagtgttttgagcaatgcggaggctgggggtgtggctgcttcaacgtcaatcccagctgtctctttgtgcacacatacctgcagtccgtgcggaaagaggccctgagagtcttcaactgcattgactgggttcacaaacttaccctcgaagtgacggattttgacggatctgtgagcaccatcgatctgggcgcgtccagctctcggttcacaaattgggggtccgtcagcctgtctctcgacgctgagggaatttccggcagcaactctttttccttcatcgaaagccccgggaaaggatatgccatcgtggatgagcctttctccgaaattccgcgccagggctttctgggggagatcagatgtaatagcgagtctagcgttctttccgcccatgaatcttgcctgcgggctcccaacctcattagctacaagcctatgatcgaccagctggagtgtaccacaaatctgattgatcccttcgtggtctttgaaagaggctcccttcctcaaacccgcaacgacaaaacgttcgccgcgtctaagggaaatcggggcgtgcaggcttttagcaaggggtccgttcaggccgatctcacactgatgttcgacaactttgaggtggacttcgtcggagccgctgtgtcttgcgatgccgcttttctgaacctcaccggctgctatagctgtaatgccggggcgagagtttgcctgtccatcacaagcaccggaaccggcacactttctgcccacaacaaagacggctccctgcatatcgtgctccccagcgaaaatgggacgaaggatcaatgtcagattctgcacttcaccgtccctgaggtggaggaagagtttatgtactcttgcgacggagatgaacgccccctgcttgtgaaaggcacactcatcgctattgacccgttcgatgacagacgggaggccgggggagagtccaccgtcgttaaccctaagagcggctcctggaactttttcgattggttctctgggctgatgagctggtttggaggccccctgaaaacaatcctcctgatttgtctttacgtggctctgtccatcggcctcttctttctgctgatctatcttgggcgcaccggactgagcaagatgtggctcgccgccacgaagaaggcttcttga

SEQ ID NO: 14490 - RNA, 3480 nt, synthetic construct
  misc_feature 1..3480: note = derived and/or modified CDS sequence (opt5) from RVFV(KEN/Gar-Msq/131B-04/06)__HM586972.1__NSm-Gn-Gc
  source 1..3480: mol_type = other RNA
atgatcgagggcgcctgggacagcttcagagaagaggaaatgcccgaggaactgtcctgctctgtgagcgggattcgggaggtcaagacctcctctcaggagctctaccgcgctctgaaagccatcattgcggctgatggacttaacaatatcacatgtcacggcaagaaccctgaagacaaaattagcctgatcaaggggccgccccataaaaagagagttggaatcgtgcggtgcgagcgcagacgggatgccaagcaaattggccgcgaaacgatggccgggatcgctatgaccgtgctccctgccctggctgtctttgcccttgcgcccgtggttttcgccgaggaccctcacctgagaaatcggcccggaaaaggccataactatattgatggcatgacacaggaggacgctacctgtaagcctgtgacatacgccggggcttgctcctcttttgatgtcctcctggaaaaaggaaagttcccgctgtttcagagctatgcccaccatcgcaccctcctggaggcggtgcacgacacaatcattgccaaagctgatcccccttcctgtgaccttcagagcgcccacggcaatccctgcatgaaggaaaagctggttatgaaaacccattgtcctaacgattaccaatctgctcactatctcaataacgacgggaagatggcctccgtgaaatgtcccccgaagtacgagctgacggaagattgcaatttctgcagacagatgaccggagccagccttaaaaagggctcttatcctctgcaggacctcttttgtcagtccagcgaggacgatgggtctaaactgaagacaaagatgaaaggagtctgcgaggtgggcgtgcaagctctgaagaaatgcgacggccagctctccaccgcgcatgaagtcgttcccttcgccgtgtttaagaacagcaaaaaggtgtacctggataaacttgacctgaaaacagaggaaaatctcctgcctgattccttcgtctgttttgagcacaaggggcagtacaaaggaaccatggactctggccagacgaagcgggaacttaagagcttcgatatctcccaatgccccaagattgggggacacggcagcaagaaatgtacaggggacgctgccttttgctctgcctatgagtgtaccgctcagtacgccaacgcgtattgctcccatgctaatggaagcggcatcgtgcagatccaagtttctggcgtgtggaagaaacccctgtgtgtcgggtacgagcgcgtggttgtgaagagagaactcagcgccaaacctattcagcgggtcgagccgtgcacaacctgtatcaccaagtgcgaaccccacggactggtggtccgctccacaggcttcaagatttctagcgccgtggcttgtgcctccggggtttgcgtgacgggaagccagtctccttccaccgagatcacactgaaatatcccggcattagccagtcttccgggggcgatatcggagtccatatggctcacgacgatcaaagcgtgtcctctaagatcgttgcccattgccctccccaggacccgtgtctcgtgcacggctgcattgtctgtgcgcacgggctgatcaactaccagtgccataccgcccttagcgctttcgtggtgatttttgttttctcctctacagccatcatttgtctggctgtcctctatagagtgctgaaatgccttaagatcgcccctcggaaagtgctgaatcccctcatgtggatcaccgcgtttattagatgggtctacaagaaaatggtggcccgcgttgctgacaacatcaaccaggtgaatcgggaaattggatggatggagggcgggcaactggccctgggaaaccctgctcccatccctagacacgcccccattccgcgctacagcacgtatctcatgctgcttctgatcgtctcctacgccagcgcttgttctgagctcattcaggcgtccagccggatcacaacctgctctaccgaaggcgtgaatacaaagtgtagactgtccgggaccgccctgatccgcgctggcagcgttggagccgaggcctgccttatgctcaagggcgtgaaagaagatcagacaaagttcctgaaaattaagacggtctctagcgagctgtcctgtcgggaggggcagagctattggaccggatctttttcccctaaatgcctcagctccagacgctgccatctggtgggcgaatgtcacgttaaccggtgcctttcttggagagacaatgagacaagcgctgagttctcctttgtgggggaatctaccacaatgcgcgaaaacaagtgtttcgagcaatgcggaggctgggggtgtggctgctttaatgtcaaccccagctgtctgttcgtgcacacctacctccagtccgtgcggaaggaggccctgagagtctttaattgcatcgattgggttcataaactgacgcttgaaattaccgacttcgatggatctgtgagcacaatcgacctcggcgcgtccagctctcggtttaccaactgggggtccgtgagcctgtctctggatgctgagggaatttccggcagcaattctttctccttcatcgaaagccccgggaagggatatgccatcgtcgacgagcctttttccgaaattccgcgccagggcttcctcggggagatcagatgtaacagcgagtctagcgtgctgtccgcccacgaatcttgccttcgggctcccaatctggttagctacaaacctatgattgatcagctcgagtgtacaaccaacctgatcgacccctttgtggtcttcgaaagaggctccctgcctcaaacgcgcaatgataagacatttgccgcgtctaaaggaaaccggggcgtgcaggctttcagcaaggggtccgttcaggccgaccttaccctcatgtttgataacttcgaggtggactttgtcggagccgctgtgtcttgcgacgccgctttcctgaatctgacaggctgctatagctgtaacgccggggcgagagtttgcctctccattaccagcaccggaacaggcacgctgtctgcccataataaggatggctcccttcacatcgtgctgcccagcgaaaacgggaccaaagaccaatgtcagatcctccattttacagtccctgaggtggaggaagagttcatgtactcttgcgatggagacgaacgccccctgctggtgaagggcacccttattgctatcgatccgtttgacgatagacgggaggccgggggagagtccacagtcgttaatcctaaaagcggctcctggaacttcttcgactggttttctgggctcatgagctggttcggaggccccctgaagaccattctgctcatctgtctgtacgtggctctttccattggcctgtttttcctcctgatctatctggggcgcacgggacttagcaaaatgtggctggccgccacaaagaaggcttcttga

SEQ ID NO: 14491 - RNA, 3480 nt, synthetic construct
  misc_feature 1..3480: note = derived and/or modified CDS sequence (opt5) from RVFV(2007001107)__EU574047.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctccaatcaggagctgtaccgcgctcttaaagccatcattgcggctgatggactgaataacatcacatgtcacggcaagaatcctgaagacaaaatttctctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaaccggcccggaaaaggccataattatattgatggcatgacacaggaggacgctacctgtaagcctgtgacatacgccggggcttgcagctccttcgatgtcctgctggaaaaaggaaagtttcccctcttccagtcttatgcccaccatcgcaccctgcttgaggcggtgcacgacacaatcattgccaaagctgatccccctagctgtgacctgcagtccgcccacggcaacccctgcatgaaggaaaagctcgttatgaaaacccattgtcctaatgattaccaaagcgctcactatctgaacaatgacgggaagatggcctctgtgaaatgcccgccgaagtacgagcttacggaagattgtaacttttgcagacagatgaccggagcctccctgaaaaagggcagctatcctctccaggacctgttctgtcagtcttccgaggacgatgggagcaaactgaagacaaagatgaaaggagtctgcgaggtgggcgtgcaagctctcaagaaatgcgacggccagctgtctaccgcgcatgaagtcgttccctttgccgtgttcaagaatagcaaaaaggtgtaccttgataagctggacctcaaaacagaggaaaacctgcttcctgatagctttgtctgtttcgagcacaaggggcagtacaaaggaaccatggactccggccagacgaagcgggaactgaaatcttttgatatcagccaatgccccaagattgggggacacggctccaagaaatgtacaggggacgctgccttctgcagcgcctatgagtgtaccgctcagtacgccaatgcgtattgctctcatgctaacggatccggcatcgtgcagatccaagttagcggcgtgtggaagaaacccctctgtgtcgggtacgagcgcgtggttgtgaagagagaactgtctgccaaacctattcagcgggtcgagccgtgcacaacctgtatcaccaagtgcgaaccccacggactggtggtccgcagcacaggctttaagatttcctctgccgtggcttgtgccagcggggtttgcgtgacgggatcccagagcccttctaccgagatcacactcaaatatcccggcatttcccagagctctgggggcgatatcggagtccatatggctcacgacgatcaatccgtgagctccaagatcgttgcccattgccctccccaggacccgtgtctggtgcacggctgcattgtctgtgcgcacgggcttatcaattaccagtgccataccgccctgtctgctttcgtggtgattttcgtttttagctccacagccatcatttgtctcgctgtcctgtatagagtgcttaaatgcctgaagatcgcccctcggaaagtgctcaaccccctgatgtggatcaccgcgttcattagatgggtctacaagaaaatggtggcccgcgttgctgacaacatcaatcaggtgaaccgggaaattggatggatggagggcgggcaactggccctcggaaatcctgctcccatccctagacacgcccccattccgcgctactctacgtatctgatgcttctgctcatcgtcagctacgcctccgcttgtagcgagctgattcaggcgtcttcccggatcacaacctgcagcaccgaaggcgtgaacacaaagtgtagactgtctgggaccgcccttatccgcgctggctccgttggagccgaggcctgcctcatgctgaagggcgtgaaagaagatcagacaaagtttctgaaaattaagacggtcagctctgagctcagctgtcgggaggggcagtcctattggaccggatccttctctcctaaatgcctgtccagcagacgctgccatcttgtgggcgaatgtcacgttaatcggtgcctgtcctggagagacaacgagacatctgctgaatttagcttcgtgggggagtccaccacaatgcgcgaaaataagtgttttgagcaatgcggaggctgggggtgtggctgcttcaacgtcaatccctcttgtctctttgtgcacacctacctgcagagcgtgcggaaggaggccctgagagtcttcaactgcatcgattgggttcataaacttacgctcgaaattaccgactttgatggatccgtgtctacaatcgacctgggcgcgagctccagccggttcaccaattgggggtctgtgtccctgagcctcgatgctgagggaatttctggctccaacagcttttctttcatcgaatcccccgggaagggatatgccatcgtcgacgagcctttcagcgaaattccgcgccagggctttctgggggagatcagatgtaattccgagagctctgtgcttagcgcccacgaatcctgcctgcgggctcccaacctcgtttcttacaaacctatgattgatcagctggagtgtacaaccaatctgatcgaccccttcgtggtctttgaaagaggcagccttcctcaaacgcgcaacgataagacattcgccgcgtccaaaggaaaccggggcgtgcaggctttttctaaggggagcgttcaggccgacctcaccctgatgttcgataattttgaggtggacttcgtcggagccgctgtgtcctgcgacgccgcttttctgaacctcacaggctgctattcttgtaatgccggggcgagagtttgcctgagcattacctccaccggaacaggcacgcttagcgcccataacaaggatggctctctgcacatcgtgctcccctccgaaaatgggaccaaagaccaatgtcagatcctgcatttcacagtccctgaggtggaggaagagtttatgtacagctgcgatggagacgaacgccccctgcttgtgaagggcaccctcattgctatcgatccgttcgacgatagacgggaggccgggggagagtctacagtcgttaaccctaaatccggcagctggaactttttcgactggttctccgggctgatgtcttggtttggaggccccctgaagaccattctcctgatctgtctttacgtggctctgagcattggcctcttctttctgctgatctatcttgggcgcacgggactgtccaaaatgtggctcgccgccacaaagaaggctagctga

SEQ ID NO: 14492 - RNA, 3480 nt, synthetic construct
  misc_feature 1..3480: note = derived and/or modified CDS sequence (opt5) from RVFV(ANK-3837)__DQ380215.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaagctggattctggccagaccaaacgggaactcaagagctttgacatttcccaatgccccaagatcgggggacacggcagcaaaaagtgtacgggggatgctgccttctgctctgcctatgagtgtacagctcagtacgccaatgcgtattgctcccatgctaacggaagcggcatcgtccagattcaagtgtctggcgtttggaaaaagcccctgtgtgtggggtacgagcgcgtcgtggttaaaagagaactgagcgccaagcctatccagcgggtggagccgtgcaccacatgtattaccaagtgcgaaccccacggactcgtcgtgcgctccaccggctttaaaatctctagcgccgtcgcttgtgcctccggggtgtgcgttacaggaagccagtctccttccacggagattaccctgaagtatcccggcatcagccagtcttccgggggcgacatcggagtgcatatggctcacgatgaccaaagcgtctcctctaaaattgtggcccattgccctccccaggacccgtgtcttgttcacggctgcatcgtgtgtgcgcacgggctgattaattaccagtgccatacagccctcagcgctttcgtcgtggtgttcgtcttttcctctatcgccattatctgtctggctatcctttatagagttctgaagtgcctcaaaattgcccctcggaaggtgctgaaccccctgatgtggatcaccgcgttcattagatgggtgtaccgcaaaatggtcgcccgggtggctgataatatcaaccaggttaacagagaaattggatggatggagggcgggcaactcgtgctgggaaatcctgcccccatccctcgccacgtccccattccgcggtacagcacatatcttatgctgctcctgatcgtgtcctacgctagcgcctgttctgagctgatccaggcctccagcagaattaccacgtgctctacagaaggcgttaacaccaagtgtcgcctttccgggaccgctctcatccgggcgggcagcgtgggagccgaggcttgcctgatgctgaagggcgtcaaagaagaccagacaaagtttctcaaaattaagaccgtgtctagcgagctgtcctgtagagaggggcagagctattggacaggatctttctcccctaaatgccttagctcccgccggtgccatctggttggcgaatgtcacgtgaatagatgcctctcttggcgcgataacgagacgagcgccgaattttccttcgtcggggagtctaccacaatgcgggaaaataagtgttttgagcaatgcggaggctgggggtgtggctgcttcaacgtgaatcccagctgtctgtttgtgcacacctacctgcagtccgtcagaaaggaggcccttcgggttttcaactgcatcgactgggtgcataaactcacactggaaattaccgattttgacggatctgtgagcacgatcgatctgggcgcttccagctctcgcttcaccaattgggggtccgtcagcctctctctggacgccgagggaatctccggcagcaactctttttccttcattgaaagccccgggaagggatatgcgatcgtggatgagcctttctccgaaattccgagacagggctttcttggggagatccggtgtaatagcgagtctagcgttctgtccgctcacgaatcttgcctcagagcccccaacctgattagctacaaacctatgatcgaccagctggagtgtacaaccaatcttatcgatcccttcgtggtctttgaacgcggctccctccctcaaacacggaacgacaagaccttcgccgcttctaaaggaaatagaggcgtgcaggcctttagcaaggggtccgttcaggcggatctgacgctgatgttcgacaactttgaggtggacttcgtcggagctgccgtgtcttgcgatgccgcttttctcaacctgacaggctgctatagctgtaatgccggggctcgcgtttgcctttccattaccagcacaggaaccggcaccctgtctgcccataacaaggacggctccctccacatcgtgctgcccagcgaaaatgggacaaaagatcaatgtcagattctgcatttcacggtccctgaggtggaggaagagtttatgtactcttgcgacggagatgaaagaccccttctcgtgcggggcaccctgatcgcgattgacccgttcgatgaccgcagagaggccgggggagagtccacagtcgttaaccctaagagcggctcctggaactttttcgattggttctctgggctgatgagctggtttggaggccccctcaaaaccatcctgcttatctgtctgtacgtggctctctccattggcctgttctttctgcttatctatctggggcggacaggactcagcaagatgtggctggccgctaccaaaaaggcctcttga

SEQ ID NO: 14493 - RNA, 3480 nt, synthetic construct
  misc_feature 1..3480: note = derived and/or modified CDS sequence (opt5) from RVFV(Lunyo)__KU167026.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccatggtctctggccagacgaagcgggaactgaaatcctttgatattagccaatgccccaagatcgggggacacggcagcaagaaatgtacaggggacgctgccttctgctctgcctatgagtgtaccgctcagtacgccaatgcgtattgctcccatgctaacggaagcggcatcgtgcagattcaagtttctggcgtgtggaagaaacccctctgtgtcgggtacgagcgcgtggttgtgaagagagaactgagcgccaaacctatccagcgggtcgagccgtgcacaacctgtattaccaagtgcgaaccccacggactggtggtccgctccacaggctttaagatctctagcgccgtggcttgtgcctccggggtttgcgtgacgggaagccagtctccttccaccgagattacactcaaatatcccggcatcagccagtcttccgggggcgatatcggagtccatatggctcacgacgatcaaagcgtgtcctctaagattgttgcccattgccctccccaggacccgtgtctggtgcacggctgcatcgtctgtgcgcacgggcttattaattaccagtgccataccgccctgagcgctttcgtggtggttttcgtcttttcctctgtggccatcatttgtctcgctatcctgtataaagtgcttaagtgcctgaaaatcgcccctagaaaggtcctcaaccccctgatgtggattacagcgttcatccggtgggtgtacaaaaagatggttgccagagtggctgacaatattaaccaggtcaaccgcgaaatcggatggatggagggcgggcaactggccctcggaaatcctgctcccattcctcggcacgcccccatcccgagatacagcacctatctgatgcttctgctcattgtgtcctacgccagcgcttgttctgagctgatccaggcgtccagccgcatcacgacatgctctaccgaaggcgttaacacccggtgtagactgtccgggacagcccttattcgcgctggcagcgtgggagccgaggcctgcctcatgctgaagggcgtcaaagaagatcagaccaagtttctgaaaatcaagacagtgtctagcgagctctcctgtcgggaggggcagagctattggacgggatctttctcccctaaatgcctgagctccagacgctgccatcttgttggcgaatgtcacgtgaatcggtgcctgtcttggagagacaacgagaccagcgctgaattttccttcgtcggggagtctacaaccatgcgcgaaaataagtgttttgagcaatgcggaggctgggggtgtggctgcttcaacgtgaatcccagctgtctctttgtgcacacatacctgcagtccgtccggaaggaggccctgagagttttcaactgcattgattgggtgcataaacttaccctcgaaatcacggactttgatggatctgtgagcaccattgacctgggcgcgtccagctctcggttcacaaattgggggtccgtcagcctgtctctcgatgctgagggaatctccggcagcaactctttttccttcatcgaaagccccgggaagggatatgccattgtggacgagcctttctccgaaatcccgcgccagggctttctgggggagattagatgtaatagcgagtctagcgttctttccgcccacgaatcttgcctgcgggctcccaacctcatcagctacaaacctatgattgatcagctggagtgtaccacaaatctgatcgaccccttcgtggtctttgaaagaggctcccttcctcaaacccgcaacgataagacgttcgccgcgtctaaaggaaatcggggcgtgcaggcttttagcaaggggtccgttcaggccgacctcacactgatgttcgataactttgaggtggacttcgtcggagccgctgtgtcttgcgacgccgcttttctgaacctcaccggctgctatagctgtaatgccggggcgagagtttgcctgtccatcacaagcaccggaaccggcacactttctgcccataacaaggatggctccctgcacattgtgctccccagcgaaaatgggacgaaagaccaatgtcagatcctgcatttcaccgtccctgaggtggaggaagagtttatgtactcttgcgatggagacgaacgccccctgcttgtgaagggcacactcattgctatcgatccgttcgacgatagacgggaggccgggggagagtccaccgtcgttaaccctaaaagcggctcctggaactttttcgactggttctctgggctgatgagctggtttggaggccccctgaagacaattctcctgatctgtctttacgtggctctgtccatcggcctcttctttctgctgatttatcttgggcgcaccggactgagcaaaatgtggctcgccgccacgaagaaggcttcttga

SEQ ID NO: 14494 - RNA, 3480 nt, synthetic construct
  misc_feature 1..3480: note = derived and/or modified CDS sequence (opt5) from RVFV(RVFBJ01/2016)__KX785331.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagcatgagcttacggaagactgcaacttttgcagacagatgaccggagccagcctgaaaaagggctcttaccctctccaggacctgttctgtcagtccagcgaggatgacgggtctaaactgaagacaaagatgaaaggagtgtgcgaggtcggcgtgcaagctctcaagaaatgcgatggccagctgtccaccgcgcacgaagtggtcccctttgccgttttcaagaatagcaaaaaggtgtatcttgacaagctggatctcaaaacagaggaaaacctgcttcctgactcctttgtgtgtttcgagcacaaggggcagtacaaaggaaccatggattctggccagacgaagcgggaactgaaatcctttgacatttcccaatgccccaagatcgggggacatggcagcaagaaatgtacaggggatgctgccttctgctctgcctacgagtgtaccgctcagtatgccaatgcgtactgctcccacgctaacggaagcggcatcgtccagattcaagtgtctggcgtttggaagaaacccctctgtgtggggtatgagcgcgtcgtggttaagagagaactgagcgccaaacctatccagcgggtggagccgtgcacaacctgtattaccaagtgcgaaccccatggactggtcgtgcgctccacaggctttaagatctctagcgccgtcgcttgtgcctccggggtgtgcgttacgggaagccagtctccttccaccgagattacactcaaataccccggcatcagccagtcttccgggggcgacatcggagtgcacatggctcatgatgaccaaagcgtctcctctaagattgtggcccactgccctccccaggacccgtgtctggttcacggctgcatcgtgtgtgcgcatgggcttattaattatcagtgccacaccgccctgagcgctttcgtcgtggtgttcgtttttagctctgtcgccatcatttgtctcgctatcctgtacaaagtgcttagatgcctgaagatcgcccctaaaaaggtgctcaaccccctgatgtggattacagcgttcatccggtgggtctataaaaagatggtggccagagttgctgataatattaaccaggtgaaccgcgaaatcggatggatggagggcgggcaactggccctcggaaatcctgctcccattcctcggcatgcccccatcccgagatacagcacctacctgatgcttctgctcattatctcctatgccagcgcttgttctgagctgatccaggcgtccagccgcattacgacatgctctaccgaaggcgtcaacaccaagtgtcggctgtccgggacagcccttatcagagctggcagcgtgggagccgaggcctgcctcatgctgaaaggcgttaaggaagaccagaccaaatttctgaagattaaaacagtgtctagcgagctctcctgtcgcgaggggcagagctactggacgggatctttctcccctaagtgcctgagctcccggagatgccaccttgtcggcgaatgtcacgtgaatcgctgcctgtcttggcgggataacgagaccagcgctgaattttccttcgttggggagtctacaaccatgagagaaaataagtgttttgagcaatgcggaggctgggggtgtggctgcttcaacgtgaatcccagctgtctctttgtccatacatatctgcagtccgtgcgcaaagaggccctgcgggtgttcaactgcatcgactgggtccacaaacttaccctcgaaattacggattttgacggatctgttagcaccatcgatctgggcgcgtccagctctagattcacaaattgggggtccgtgagcctgtctctcgacgctgagggaatctccggcagcaactctttttccttcattgaaagccccgggaaaggatacgccatcgtggatgagcctttctccgaaattccgcggcagggctttctgggggagatccgctgtaatagcgagtctagcgtcctttccgcccatgaatcttgcctgagagctcccaacctcattagctataagcctatgatcgaccagctggagtgtaccacaaatctgatcgatcccttcgtggtttttgaacggggctcccttcctcaaaccagaaacgacaaaacgttcgccgcgtctaagggaaatcgcggcgtgcaggcttttagcaaggggtccgtccaggccgatctcacactgatgttcgacaactttgaggtggacttcgttggagccgctgtgtcttgcgatgccgcttttctgaacctcaccggctgctacagctgtaatgccggggcgcgggtctgcctgtccattacaagcaccggaaccggcacactttctgcccacaacaaagacggctccctgcatatcgtgctccccagcgaaaatgggacgaaggatcaatgtcagattctgcacttcaccgttcctgaggtggaggaagagtttatgtattcttgcgacggagatgaaagacccctgcttgtcaaaggcacactcatcgctattgacccgttcgatgaccgcagagaggccgggggagagtccaccgtggtgaaccctaagagcggctcctggaactttttcgattggttctctgggctgatgagctggtttggaggccccctgaaaacaatcctcctgatctgtctttacgtcgctctgtccattggcctcttctttctgctgatctaccttgggcggaccggactgagcaagatgtggctcgccgccacgaagaaggcttcttga

SEQ ID NO: 14495 - RNA, 3480 nt, synthetic construct
  misc_feature 1..3480: note = derived and/or modified CDS sequence (opt5) from RVFV(Ken 199800523)__KU978777.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatacgaagcaaattggccgcgaaaccatggccgggatcgccatgacagtgctgcctgctcttgccgtcttcgctctggcccccgtggtttttgcggaggaccctcacctcagaaatcggcccggaaaaggccataactatattgatggcatgacccaggaggacgccacatgtaagcctgtgacctacgctggggcctgctcctctttcgatgtcctgctggaaaaaggaaagtttcccctcttccagagctatgctcaccatcgcacactgcttgaggccgtgcacgacaccatcattgcgaaagccgatcccccttcctgtgacctgcagagcgctcacggcaatccctgcatgaaggaaaagctcgttatgaaaacgcattgtcctaacgattaccaatctgcccactatctgaataacgacgggaagatggcttccgtgaaatgcccgccgaagtacgagcttaccgaagattgtaatttttgcagacagatgacaggagccagcctgaaaaagggctcttatcctctccaggacctgttctgtcagtccagcgaggacgatgggtctaaactgaagaccaagatgaaaggagtctgcgaggtgggcgtgcaagccctcaagaaatgcgacggccagctgtccacagctcatgaagtcgttccctttgcggtgttcaagaacagcaaaaaggtgtaccttgataagctggacctcaaaaccgaggaaaatctgcttcctgattcctttgtctgtttcgagcacaaggggcagtacaaaggaacgatggactctggccagacaaagcgggaactgaaatcctttgatatcagccaatgccccaagattgggggacacggcagcaagaaatgtaccggggacgccgctttctgctctgcctatgagtgtacagcccagtacgctaacgccttttgctcccatgcgaatggaagcggcatcgtgcagatccaagtttctggcgtgtggaagaaacccctctgtgtcgggtatgagcgcgtggttgtgaagagagaactgagcgctaaacctattcagcgggtcgagccgtgcaccacctgtatcacaaagtgcgaaccccacggactggtggtccgctccacgggcttcaagatttctagcgccgtggcctgtgcttccggggtttgcgtgaccggaagccagtctccttccacagagatcaccctcaaataccccggcattagccagtcttccgggggcgatatcggagtccatatggcccacgacgatcaaagcgtgtcctctaagatcgttgctcattgccctccccaggacccgtgtctggtgcacggctgcattgtctgtgcccacgggcttatcaactatcagtgccatacagcgctgagcgccttcgtggtggtttttgtcttctcctctattgctatcatttgtctcgccatcctgtacagagtgcttaaatgcctgaagatcgctcctcggaaagtgctcaatcccctgatgtggattaccgcctttatcagatgggtctataagaaaatggtggcgcgcgttgccgacaacattaaccaggtgaatcgggaaatcggatggatggagggcgggcaactggtcctcggaaaccctgctcccattcctagacacgcccccatcccgcgctacagcacgtacctgatgcttctgctcattgtgtcctatgctagcgcctgttctgagctgatccaggcctccagccggatcacaacctgctctaccgaaggcgttaatacaaagtgtagactgtccgggaccgctcttattcgcgcgggcagcgtgggagccgaggcttgcctcatgctgaagggcgtcaaagaagatcagacaaagttcctgaaaatcaagacggtgtctagcgagctctcctgtcgggaggggcagagctactggaccggatctttttcccctaaatgcctgagctccagacgctgccatcttgttggcgaatgtcacgtgaaccggtgcctgtcttggagagacaatgagacaagcgccgagttctcctttgtcggggaatctaccacaatgcgcgaaaacaagtgtttcgagcaatgcggaggctgggggtgtggctgctttaatgtgaaccccagctgtctcttcgtgcacacctatctgcagtccgtccggaaggaggccctgagagtttttaattgcattgattgggtgcataaacttacgctcgaaatcaccgacttcgatggatctgtgagcacaattgacctgggcgcttccagctctcggtttaccaactgggggtccgtcagcctgtctctcgatgccgagggaatctccggcagcaattctttctccttcatcgaaagccccgggaagggatacgcgattgtggacgagcctttttccgaaatcccgcgccagggcttcctgggggagattagatgtaacagcgagtctagcgttcttaatgctcacgaatcctgcctgcgggcccccaacctcatctcttataaacctatgattgatcagctggagtgtacaaccaatctgatcgacccctttgtggtcttcgaaagaggcagccttcctcaaacgcgcaacgataagacatttgccgcttccaaaggaaaccggggcgtgcaggccttctctaaggggagcgttcaggcggacctcaccctgatgtttgataatttcgaggtggactttgtcggagctgccgtgtcctgcgacgccgctttcctgaacctcacaggctgctactcttgtaatgccggggctagagtttgcctgagcatcacctccaccggaacaggcacgcttagcgcccataacaaggaaggctctctgcacattgtgctcccctccgagaatgggaccaaagatcaatgtcagatcctgcattttacagtccctgaggtggaagaggagttcatgtatagctgcgacggagatgaacgccccctgcttgtgaagggcaccctcattgcgatcgacccgtttgatgacagacgggaggccgggggagaatctacagtcgttaaccctaaatccggcagctggaatttcttcgattggttttccgggctgatgtcttggttcggaggccccctgaagaccattctcctgatctgtctttacgtggctctgagcatcggcctctttttcctgctgatttaccttgggcgcacgggactgtccaaaatgtggctcgccgctacaaagaaggccagctga

SEQ ID NO: 14496 - RNA, 3480 nt, synthetic construct
  misc_feature 1..3480: note = derived and/or modified CDS sequence (opt5) from RVFV__JQ068143.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaccattgattctggccagacgaagcgggaactgaaatcctttgacatctcccaatgccccaagatcgggggacacggcagcaagaaatgtacaggggatgctgccttctgctctgcctatgagtgtaccgctcagtacgccaatgcgtattgctcccatgctaacggaagcggcattgtccagatccaagtgtctggcgtttggaagaaacccctctgtgtggggtacgagcgcgtcgtggttaagagagaactgagcgccaaacctattcagcgggtggagccgtgcacaacctgtatcaccaagtgcgaaccccacggactggtcgtgcgctccacaggctttaagatttctagcgccgtcgcttgtgcctccggggtgtgcgttacgggaagccagtctccttccaccgagatcacactcaaatatcccggcatcagccagtcttccgggggcgacattggagtgcatatggctcacgatgaccaaagcgtctcctctaagatcgtggcccattgccctccccaggacccgtgtctggttcacggctgcattgtgtgtgcgcacgggcttatcaattaccagtgccataccgccctgagcgctttcgtcgtggtgttcgtttttagctctgtcgccattatctgtctcgctatcctgtataaagtgcttagatgcctgaagattgcccctaaaaaggtgctcaaccccctgatgtggatcacagcgttcattcggtgggtctacaaaaagatggtggccagagttgctgataatatcaaccaggtgaaccgcgaaattggatggatggagggcgggcaactggccctcggaaatcctgctcccatccctcggcacgcccccattccgagatacagcacctatctgatgcttctgctcatcatctcctacgccagcgcttgttctgagctgattcaggcgtccagccgcatcacgacatgctctaccgaaggcgtcaacaccaagtgtcggctgtccgggacagcccttattagagctggcagcgtgggagccgaggcctgcctcatgctgaaaggcgttaaggaagaccagaccaaatttctgaagatcaaaacagtgtctagcgagctctcctgtcgcgaggggcagagctattggacgggatctttctcccctaagtgcctgagctcccggagatgccatcttgtcggcgaatgtcacgtgaatcgctgcctgtcttggcgggataacgagaccagcgctgaattttccttcgttggggagtctacaaccatgagagaaaataagtgttttgagcaatgcggaggctgggggtgtggctgcttcaacgtgaatcccagctgtctctttgtccacacatacctgcagtccgtgcgcaaagaggccctgcgggtgttcaactgcattgactgggtccataaacttaccctcgaaatcacggattttgacggatctgttagcaccatcgatctgggcgcgtccagctctagattcacaaattgggggtccgtgagcctgtctctcgacgctgagggaatttccggcagcaactctttttccttcatcgaaagccccgggaaaggatatgccattgtggatgagcctttctccgaaatcccgcggcagggctttctgggggagattcgctgtaatagcgagtctagcgtcctttccgcccacgaatcttgcctgagagctcccaacctcatcagctacaagcctatgatcgaccagctggagtgtaccacaaatctgattgatcccttcgtggtttttgaacggggctcccttcctcaaaccagaaacgacaaaacgttcgccgcgtctaagggaaatcgcggcgtgcaggcttttagcaaggggtccgtccaggccgatctcacactgatgttcgacaactttgaggtggacttcgttggagccgctgtgtcttgcgatgccgcttttctgaacctcaccggctgctatagctgtaatgccggggcgcgggtctgcctgtccatcacaagcaccggaaccggcacactttctgcccataacaaagacggctccctgcacattgtgctccccagcgaaaatgggacgaaggatcaatgtcagatcctgcatttcaccgttcctgaggtggaggaagagtttatgtactcttgcgacggagatgaaagacccctgcttgtcaaaggcacactcattgctatcgacccgttcgatgaccgcagagaggccgggggagagtccaccgtggtgaaccctaagagcggctcctggaactttttcgattggttctctgggctgatgagctggtttggaggccccctgaaaacaatcctcctgatttgtctttacgtcgctctgtccatcggcctcttctttctgctgatttatcttgggcggaccggactgagcaagatgtggctcgccgccacgaagaaggcttcttga

SEQ ID NO: 14497 - RNA, 3480 nt, synthetic construct
  misc_feature 1..3480: note = derived and/or modified CDS sequence (opt5) from RVFV(200803169)__JF311384.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatctcccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgatatcggagtccatatggctcacgacgatcaaagcgtgtcctctaagatcgttgcccattgccctccccaggacccgtgtctggtgcacggctgcattgtctgtgcgcacgggcttatcaactaccagtgccataccgccctgagcgctttcgtggtgattttcgtttttagctctacagccatcatttgtctcgctgtcctgtatagagtgcttaaatgcctgaagatcgcccctcggaaagtgctcaatcccctgatgtggatcaccgcgttcattagatgggtctacaagaaaatggtggcccgcgttgctgacaacatcaaccaggtgaatcgggaaattggatggatggagggcgggcaactggccctcggaaaccctgctcccatccctagacacgcccccattccgcgctacagcacgtatctgatgcttctgctcatcgtctcctacgccagcgcttgttctgagctgattcaggcgtccagccggatcacaacctgctctaccgaaggcgtgaatacaaagtgtagactgtccgggaccgcccttatccgcgctggcagcgttggagccgaggcctgcctcatgctgaagggcgtgaaagtcgatcagacaaagtttctgaaaattaagacggtgtctagcgaactctcctgtcgggaggggcagagctattggaccggatctttctcccctaaatgcctgagctccagacgctgccatcttgttggcgagtgtcacgtgaaccggtgcctgtcttggagagacaatgaaacaagcgctgagttttccttcgtcggggaatctaccacaatgcgcgagaacaagtgttttgaacaatgcggaggctgggggtgtggctgcttcaatgtgaaccccagctgtctctttgtgcacacctacctgcagtccgtccggaaggaggccctgagagttttcaattgcatcgattgggtgcataaacttacgctcgagattaccgactttgatggatctgtgagcacaatcgacctgggcgcgtccagctctcggttcaccaactgggggtccgtcagcctgtctctcgatgctgaaggaatttccggcagcaattctttttccttcatcgagagccccgggaagggatatgccatcgtggacgaacctttctccgagattccgcgccagggctttctgggggaagttagatgtaacagcgagtctagcgtgctttccgcccacgagtcttgcctgcgggctcccaatctcgtcagctacaaacctatgatcgatcagctggaatgtacaaccaacctgattgaccccttcgtggtttttgagagaggctcccttcctcaaacgcgcaatgataagacattcgccgcgtctaaaggaaaccggggcgtgcaggcttttagcaaggggtccgtccaggccgacctcaccctgatgttcgataactttgaagtggacttcgttggagccgctgtgtcttgcgacgccgcttttctgaatctcacaggctgctatagctgtaacgccggggcgagagtctgcctgtccatcaccagcaccggaacaggcacgctttctgcccataataaggatggctccctgcacattgtgctccccagcgagaacgggaccaaagaccaatgtcagatcctgcatttcacagtgcctgaagtcgaggaggaatttatgtactcttgcgatggagacgagcgccccctgcttgttaagggcaccctcatcgctattgatccgttcgacgatagacgggaagccgggggagagtccacagtggtgaatcctaaaagcggctcctggaactttttcgactggttctctgggctgatgagctggtttggaggccccctgaagaccatcctcctgatttgtctttacgtcgctctgtccatcggcctcttctttctgctgatttatcttgggcgcacgggactgagcaaaatgtggctcgccgccacaaagaaggcttcttga

SEQ ID NO: 14498 - RNA, 3480 nt, synthetic construct
  misc_feature 1..3480: note = derived and/or modified CDS sequence (opt5) from RVFV(2007002445)__EU574037.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatctcccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgatatcggagtccatatggctcacgacgatcaaagcgtgtcctctaagatcgttgcccattgccctccccaggacccgtgtctggtgcacggctgcattgtctgtgcgcacgggcttatcaactaccagtgccataccgccctgagcgctttcgtggtgattttcgtttttagctctacagccatcatttgtctcgctgtcctgtatagagtgcttaaatgcctgaagatcgcccctcggaaagtgctcaatcccctgatgtggatcaccgcgttcattagatgggtctacaagaaaatggtggcccgcgttgctgacaacatcaaccaggtgaatcgggaaattggatggatggagggcgggcaactggccctcggaaaccctgctcccatccctagacacgcccccattccgcgctacagcacgtatctgatgcttctgctcatcgtctcctacgccagcgcttgttctgagctgattcaggcgtccagccggatcacaacctgctctaccgaaggcgtgaatacaaagtgtagactgtccgggaccgcccttatccgcgctggcagcgttggagccgaggcctgcctcatgctgaagggcgtgaaagaagatcagacaaagtttctgaaaattaagacggtctctagcgagctctcctgtcgggaggggcagagctattggaccggatctttctcccctaaatgcctgagctccagacgctgccatcttgtgggcgaatgtcacgttaaccggtgcctgtcttggagagacaatgagacaagcgctgaattttccttcgtgggggagtctaccacaatgcgcgaaaacaagtgttttgagcaatgcggaggctgggggtgtggctgcttcaatgtcaaccccagctgtctctttgtgcacacctacctgcagtccgtgcggaaggaggccctgagagtcttcaattgcatcgattgggttcataaacttacgctcgaaattaccgactttgatggatctgtgagcacaatcgacctgggcgcgtccagctctcggttcaccaactgggggtccgtgagcctgtctctcgatgctgagggaatttccggcagcaattctttttccttcatcgaaagccccgggaagggatatgccatcgtcgacgagcctttctccgaaattccgcgccagggctttctgggggagatcagatgtaacagcgagtctagcgtgctttccgcccacgaatcttgcctgcgggctcccaatctcgttagctacaaacctatgattgatcagctggagtgtacaaccaacctgatcgaccccttcgtggtctttgaaagaggctcccttcctcaaacgcgcaatgagaagacattcgccgcgtctaaaggaaaccggggcgtgcaggcttttagcaaggggtccattcaggccgatctcaccctgatgttcgacaactttgaagttgatttcgtgggagccgctgtctcttgcgacgccgcttttctgaatctcacaggctgctatagctgtaacgccggggcgagagtgtgcctgtccatcaccagcaccggaacaggcacgctttctgcccataataaggacggctccctgcacatcgttctccccagcgagaacgggaccaaagatcaatgtcagattctgcatttcacagtgcctgaggtcgaagaggaatttatgtactcttgcgacggagatgagcgccccctgcttgtgaagggcaccctcatcgctattgacccgttcgatgacagacgggaggccgggggagaatccacagtggtcaatcctaaaagcggctcctggaactttttcgattggttctctgggctgatgagctggtttggaggccccctgaagaccatcctcctgatttgtctttacgttgctctgtccatcggcctcttctttctgctgatctatcttgggcgcacgggactgagcaaaatgtggctcgccgccacaaagaaggcttcttga

SEQ ID NO: 14499 - RNA, 3480 nt, synthetic construct
  misc_feature 1..3480: note = derived and/or modified CDS sequence (opt5) from RVFV(Hv-B375)__DQ380218.1__NSm-Gn-Gc
  source 1..3480: mol_type = other RNA
atgatcgagggcgcctgggacagcctgagagaaggggagatgcccgaggaactctcctgctctattagcggaatccgggaagtgaagacctcctctcaggagctgtaccgcgctcttaaagccattatcgcggctgatggcctgaacaatattacatgtcacgggaaggaccctgaggataaaatcagcctcatcaagggaccgccccataaaaagagagtcggcattgttcggtgcgaacgcagacgggacgccaagcaaatcgggcgcgagacgatggccggaattgctatgaccgtgctgcctgcccttgctgtgttcgccctggcgcccgtcgtgtttgccgaagatcctcacctcagaaaccggcccggcaaaggccataattatatcgacgggatgacacaggaggatgctacctgtaagcctgttacatacgccggagcttgctcctctttcgacgtgctgctggagaaaggcaagtttcccctcttccagagctatgcccaccatcgcaccctgcttgaagcggtccacgatacaattatcgccaaagctgacccgccttcctgtgatctgcagagcgcccacgggaacccctgcatgaaggagaagctcgtgatgaaaacccattgtcctaatgactaccaatctgctcactatctgaacaatgatggaaagatggcctccgttaaatgtcccccgaagaacgaacttacggaggactgcaatttttgcagacagatgaccggcgccagcctgaaaaaggggtcttaccctctccaggacctgttctgtcagtccagcgaagatgacggatctaaactgaagacaaagatgaaaggcgtgtgcgaggtcggcgtgcaagctctcaagaaatgcgatgggcagctgtccaccgcgcatgaggtggtcccctttgccgttttcaagaacagcaaaaaggtgtatcttgacaagctggatctcaaaacagaagagaatctgcttcctgactcctttgtgtgtttcgaacacaagggacagtacaaaggcaccatggattctgggcagacgaagcgggagctgaaatcctttgacatttcccaatgccccaagatcggaggccacgggagcaagaaatgtacaggagatgctgccttctgctctgcctacgaatgtaccgctcagtatgccaacgcgtactgctcccatgctaatggcagcggcatcgtccagattcaagtgtctggggtttggaagaaacccctctgtgtgggatatgagcgcgtcgtggttaagagagagctgagcgccaaacctatccagcgggtggaaccgtgcacaacctgtattaccaagtgcgagccccacggcctggtcgtgcgctccacagggtttaagatctctagcgccgtcgcttgtgcctccggagtgtgcgttacgggcagccagtctccttccaccgaaattacactcaaataccccgggatcagccagtcttccggcggagacatcggcgtgcatatggctcacgatgaccaaagcgtctcctctaagattgtggcccattgccctccccaggacccgtgtctggttcacgggtgcatcgtgtgtgcgcacggacttattaactatcagtgccataccgccctgagcgctttcgtcgtggtgttcgtttttagctctatcgccattatctgtctcgctatcctgtacagagtccttaaatgcctgaagattgcccctcggaaagtgctcaatcccctgatgtggatcacagcgttcattagatgggtgtataagaaaatggtcgcccgcgtggctgataacatcaaccaggttaatcgggagattggctggatggaagggggacaactggtgctcggcaaccctgcccccatccctagacacgctcccattccgcgctacagcacctacctgatgcttctgctcatcgtctcctatgccagcgcctgttctgagctgatccaggcttccagccggattacgacatgctctaccgagggggtgaataccaagtgtagactgtccggcacagcgcttatccgcgccggaagcgttggcgctgaagcctgcctcatgctgaagggggtgaaagaggaccagaccaagtttctgaaaattaagacagtctctagcgaactctcctgtcgggagggacagagctactggacgggctctttctcccctaaatgcctgagctccagacgctgccatcttgtgggggagtgtcacgttaaccggtgcctgtcttggagagataatgaaaccagcgccgagttttccttcgtgggagaatctacaaccatgcgcgagaacaagtgttttgaacaatgcggcgggtggggctgtggatgcttcaatgtcaaccccagctgtctctttgtgcacacatatctgcagtccgtgcggaaggaggctctgagagtcttcaattgcatcgactgggttcataaacttaccctcgagattacggattttgacggctctgtgagcaccatcgatctgggggcctccagctctcggttcacaaactggggatccgtgagcctgtctctcgacgcggaaggcatctccgggagcaattctttttccttcattgagagccccggaaagggctacgctatcgtcgatgaacctttctccgagattccgcgccaggggtttctgggcgaaatcagatgtaacagcgagtctagcgtgctttccgcccacgagtcttgcctgcgggcccccaatctcattagctataaacctatgatcgaccagctggaatgtaccacaaacctgatcgatcccttcgttgtgtttgagagaggatcccttcctcaaacccgcaatgacaagacgttcgctgcctctaaaggcaacagaggggtccaggcgtttagcaagggatccgtgcaggctgatctcacactgatgttcgacaactttgaagttgacttcgtgggcgccgccgtctcttgcgatgctgcctttctgaatctcaccgggtgctacagctgtaacgctggagcccgggtgtgcctgtccattacaagcaccggcaccggcacactttctgcgcataataaggacgggtccctgcacatcgttctccccagcgagaacggaacgaaagatcaatgtcagattctgcatttcaccgtgcctgaagtcgaggaggaatttatgtattcttgcgacggcgatgagcgccccctgcttgtgaaggggacactcatcgccattgacccgttcgatgacagacgggaagctggaggcgagtccaccgtggtcaatcctaaaagcgggtcctggaactttttcgattggttctctggactgatgagctggtttggcggccccctgaagacaatcctcctgatctgtctttacgttgccctgtccattggactcttctttctgctgatctaccttgggcgcaccggcctgagcaaaatgtggctcgctgccacgaagaaggcctcttga

SEQ ID NO: 14500 - RNA, 3480 nt, synthetic construct
  misc_feature 1..3480: note = derived and/or modified CDS sequence (opt5) from RVFV(clone 13)__DQ380213.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaacaatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagcatgagcttacggaagactgcaacttttgcagacagatgaccggagccagcctgaaaaagggctcttaccctctccaggacctgttctgtcagtccagcgaggatgacgggtctaaactgaagacaaagatgaaaggagtgtgcgaggtcggcgtgcaagctctcaagaaatgcgatggccagctgtccaccgcgcacgaagtggtcccctttgccgttttcaagaatagcaaaaaggtgtatcttgacaagctggatctcaaaacagaggaaaacctgcttcctgactcctttgtgtgtttcgagcacaaggggcagtacaaaggaaccatggattctggccagacgaagcgggaactgaaatcctttgacattagccaatgccccaagatcgggggacatggcagcaagaaatgtacaggggatgctgccttctgctctgcctacgagtgtaccgctcagtatgccaatgcgtactgctcccacgctaacggaagcggcatcgtccagattcaagtgtctggcgtttggaagaaacccctctgtgtggggtatgagcgcgtcgtggttaagagagaactgagcgccaaacctatccagcgggtggagccgtgcacaacctgtattaccaagtgcgaaccccatggactggtcgtgcgctccacaggctttaagatctctagcgccgtcgcttgtgcctccggggtgtgcgttacgggaagccagaatccttctaccgagattacactcaaataccccggcatctcccagagctctgggggcgacatcggagtgcacatggctcatgatgaccaatccgtcagctccaagattgtggcccactgccctccccaggacccgtgtctggttcacggctgcatcgtgtgtgcgcatgggcttattaactatcagtgccacaccgccctgtctgctttcgtcgtggtgttcgtttttagctccatcgccattatctgtctcgctatcctgtacagagtccttaaatgcctgaagattgcccctcggaaagtgctcaatcccctgatgtggatcacagcgttcattagatgggtgtataagaaaatggtcgcccgcgtggctgataacatcaaccaggttaatcgggaaattggatggatggagggcgggcaactggtgctcggaaaccctgcccccatccctagacatgctcccattccgcgctactctacctacctgatgcttctgctcatcgtcagctatgcctccgcctgtagcgagctgatccaggcttcttcccggattacgacatgcagcaccgaaggcgtgaataccaagtgtagactgtctgggacagcgcttatccgcgccggctccgttggagctgaggcctgcctcatgctgaagggcgtgaaagacgatcagaccaagtttctgaaaattaagacagtcagctctgaactcagctgtcgggaggggcagtcctactggacgggcagcttctctcctaaatgcctgtccagcagacgctgccaccttgtgggagagtgtcacgttaaccggtgcctgtcctggagagacaatgaaacctctgccgagtttagcttcgtgggggaatccacaaccatgcgcgagaacaagtgttttgaacaatgcggaggctgggggtgtggctgcttcaatgtcaacccctcttgtctctttgtgcatacatatctgcagagcgtgcggaaggaggctctgagagtcttcaattgcatcgattgggttcacaaacttaccctcgagattacggactttgatggatccgtgtctaccatcgacctgggcgccagctccagccggttcacaaactgggggtctgtgtccctgagcctcgatgcggaaggaatctctggctccaatagcttttctttcattgagtcccccgggaagggatacgctatcgtcgacgaacctttcagcgagattccgcgccagggctttctgggggaaatcagatgtaactccgagagctctgtgcttagcgcccatgagtcctgcctgcgggcccccaatctcatttcttataaacctatgatcgatcagctggaatgtaccacaaacctgatcgaccccttcgttgtgtttgagagaggcagccttcctcaaacccgcaatgaaaagacgttcgctgcctccaaaggaaaccggggcgtccaggcgttttctaaggggagcgtgcaggctgatctcacactgatgttcgacaactttgaggttgacttcgtgggagccgccgtctcctgcgatgctgcctttctgaatctcaccggctgctactcttgtaacgctggggccagagtgtgcctgagcattacatccaccggaaccggcacacttagcgcgcacaataaggacggctctctgcatatcgttctcccctccgaaaacgggacgaaagatcaatgtcagattctgcacttcaccgtgcctgaggtcgaggaagagtttatgtatagctgcgacggagatgaacgccccctgcttgtgaagggcacactcatcgccattgacccgttcgatgacagacgggaggctgggggagagtctaccgtggtcaatcctaaatccggcagctggaactttttcgattggttctccgggctgatgtcttggtttggaggccccctgaagacaatcctcctgatctgtctttacgttgccctgagcattggcctcttctttctgctgatctaccttgggcgcaccggactgtccaaaatgtggctcgctgccacgaagaaggccagctga

SEQ ID NO: 14501 - RNA, 3480 nt, synthetic construct
  misc_feature 1..3480: note = derived and/or modified CDS sequence (opt5) from RVFV(Kenya 57 (Rintoul))__DQ380192.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgcaccgcgctcttaaagccattatcgcggctgatggactgaataatattacatgtcatggcaaggaccctgaagataaaatcagcctcatcaaggggccgccccacaaaaagagagtcggagttgtgcggtgcgagcgcagacgggacgccaagcaaattggccgcgaaacgatggccgggatcgctatgaccgtgctgcctgcccttgctgtcttcgccctggcgcccgtggtttttgccgaggatcctcatctcagaaaccggcccggaaaaggccacaattacattgacggcatgacacaggaggatgctacctgtaagcctgtgacatatgccggggcttgctcctctttcgacgtcctgctggaaaaaggaaagtttcccctcttccagagctacgcccatcaccgcaccctgcttgaggcggtgcacgatacaatcattgccaaagctgacccgccttcctgtgatctgcagagcgcccatggcaacccctgcatgaaggaaaagctcgttatgaaaacccactgtcctaatgactatcaatctgctcattacctgaacaatgatgggaagatggcctccgtgaaatgtcccccgaagtatgagcttacggaagactgcaacttttgcagacagatgaccggagccagcctgaaaaagggctcttaccctctccaggacctgttctgtcagtccagcgaggatgacgggtctaaactgaagacaaagatgaaaggagtctgcgaggtgggcgtgcaagctctcaagaaatgcgatggccagctgtccaccgcgcacgaagtcgttccctttgccgtgttcaagaatagcaaaaaggtgtatcttgacaagctggatctcaaaacagaggaaaacctgcttcctgactcctttgtctgtttcgagcacaaggggcagtacaaaggaaccatggattctggccagatcaagcgggaactgaaatcctttgacattagccaatgccccaagatcgggggacatggcagcaagaaatgtacgggggatgctgccttctgctctgcctacgagtgtacagctcagtatgccaatgcgtactgctcccacgctaacggaagcggcatcgtgcagattcaagtttctggcgtgtggaagaaacccctctgtgtcgggtatgagcgcgtggttgtgaagagagaactgagcgccaaacctatccagcgggtcgagccgtgcaccacatgtattaccaagtgcgaaccccatggactggtggtccgctccaccggctttaagatctctagcgccgtggcttgtgcctccggggtttgcgtgacaggaagccagtctccttccacggagattaccctcaaataccccggcatcagccagtcttccgggggcgacatcggagtccacatggctcatgatgaccaaagcgtgtcctctaagattgttgcccactgccctccccaggacccgtgtctggtgcacggctgcatcgtctgtgcgcatgggcttattaattatcagtgccacacagccctgagcgctttcgtggtggttttcgtcttttcctctgtggccatcatttgtctcgctatcctgtacaaagtgcttaagtgcctgaaaatcgcccctagaaaggtcctcaaccccctgatgtggattaccgcgttcatccggtgggtgtataaaaagatggttgccagagtggctgataatattaaccaggtcaaccgcgaaatcggatggatggagggcgggcaactggtgctcggaaatcctgcccccattcctcggcatgctcccatcccgagatacagcacatacctgatgcttctgctcattgtttcctatgccagcgcctgttctgagctgatccaggcttccagccgcatcaccacgtgctctacagaaggcgtgaacaccaagtgtcggctgtccgggaccgcgcttattagagccggcagcgtcggagctgaggcctgcctcatgctgaaaggcgtgaaggaagaccagacaaaatttctgaagatcaaaaccgtttctagcgagctctcctgtcgcgaggggcagagctactggacaggatctttctcccctaagtgcctgagctcccggagatgccaccttgtgggcgaatgtcacgtcaatcgctgcctgtcttggcgggataacgagacgagcgccgaattttccttcgtgggggagtctaccacaatgagagaaaataagtgttttgagcaatgcggaggctgggggtgtggctgcttcaacgtgaatcccagctgtctctttgtccatacctatctgcagtccgttcgcaaagaggctctgcgggtgttcaactgcattgactgggtgcacaaacttacactcgaaatcaccgattttgacggatctgtcagcacggtggatctgggcgcctccagctctagattcaccaattgggggtccgttagcctgtctctcgacgcggagggaatttccggcagcaactctttttccttcatcgaaagccccgggaagggatacgctatcgtggatgagcctttctccgaaattagccggcagggctttctgggggagatccgctgtaattctgagagctccgtcctttctgcccatgaaagctgcctgagagccccgaacctcatttcctataagcccatgatcgaccagctggagtgtacaaccaatctgattgatcctttcgtggtttttgaacggggctctcttccccaaacaagaaacgacaaaaccttcgctgccagcaagggaaatcgcggcgtgcaggcgttttccaaggggtctgtccaggctgatctcacgctgatgttcgacaactttgaggtggacttcgttggagccgccgtgagctgcgatgctgcctttctgaacctcacaggctgctactcctgtaatgctggggcccgggtctgcctgagcatcacctctacaggaaccggcaccctttccgcgcacaacaaagacggcagcctgcatatcgtgctcccttctgaaaatgggacaaaggatcaatgtcagattctgcacttcacggtgcccgaggtcgaggaagagtttatgtattcctgcgacggagatgaaagacctctgcttgttaaaggcaccctcatcgccattgaccccttcgatgaccgcagagaggctgggggagagagcacagtggtgaacccgaagtccggctcttggaactttttcgattggttcagcgggctgatgtcctggtttggaggccctctgaaaaccatcctcctgatttgtctttacgtcgccctgagcatcggcctcttctttctgctgatctaccttgggcggacaggactgtctaagatgtggctcgctgccaccaagaaagcctcctga

SEQ ID NO: 14502 - RNA, 3480 nt, synthetic construct
  misc_feature 1..3480: note = derived and/or modified CDS sequence (opt5) from RVFV(2007001292)__EU574046.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatctcccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgatatcggagtccatatggctcacgacgatcaaagcgtgtcctctaagatcgttgcccattgccctccccaggacccgtgtctggtgcacggctgcattgtctgtgcgcacgggcttatcaactaccagtgccataccgccctgagcgctttcgtggtgattttcgtttttagctctacagccatcatttgtctcgctgtcctgtatagagtgcttaaatgcctgaagatcgcccctcggaaagtgctcaatcccctgatgtggatcaccgcgttcattagatgggtctacaagaaaatggtggcccgcgttgctgacaacatcaaccaggtgaatcgggaaattggatggatggagggcgggcaactggccctcggaaaccctgctcccatccctagacacgcccccattccgcgctacagcacgtatctgatgcttctgctcatcgtctcctacgccagcgcttgttctgagctgattcaggcgtccagccggatcacaacctgctctaccgaaggcgtgaatacaaagtgtagactgtccgggaccgcccttatccgcgctggcagcgttggagccgaggcctgcctcatgctgaagggcgtgaaagaagatcagacaaagtttctgaaaattaagacggtctctagcgagctctcctgtcgggaggggcagagctattggaccggatctttctcccctaaatgcctgagctccagacgctgccatcttgtgggcgaatgtcacgttaaccggtgcctgtcttggagagacaatgagacaagcgctgaattttccttcgtgggggagtctaccacaatgcgcgaaaacaagtgttttgagcaatgcggaggctgggggtgtggctgcttcaatgtcaaccccagctgtctctttgtgcacacctacctgcagtccgtgcggaaggaggccctgagagtcttcaattgcatcgattgggttcataaacttacgctcgaaattaccgactttgatggatctgtgagcacaatcgacctgggcgcgtccagctctcggttcaccaactgggggtccgtgagcctgtctctcgatgctgagggaatttccggcagcaattctttttccttcatcgaaagccccgggaagggatatgccatcgtcgacgagcctttctccgaaattccgcgccagggctttctgggggagatcagatgtaacagcgagtctagcgtgctttccgcccacgaatcttgcctgcgggctcccaatctcgttagctacaaacctatgattgatcagctggagtgtacaaccaacctgatcgaccccttcgtggtctttgaaagaggctcccttcctcaaacgcgcaatgataagacattcgccgcgtctaaaggaaaccggggcgtgcaggcttttagcaaggggtccgttcaggccgacctcaccctgatgttcgataactttgaggtggacttcgtcggagccgctgtgtcttgcgacgccgcttttctgaatctcacaggctgctatagctgtaacgccggggcgagagtttgcctgtccattaccagcaccggaacaggcacgctttctgcccataataaggatggctccctgcacatcgtgctccccagcgaaaacgggaccaaagaccaatgtcagatcctgcatttcacagtccctgaggtggaggaagagtttatgtactcttgcgatggagacgaacgccccctgcttgtgaagggcaccctcattgctatcgatccgttcgacgatagacgggaggccgggggagagtccacagtcgttaatcctaaaagcggctcctggaacctgtttgactggttctctgggctgatgagctggttcggaggccccctcaagaccattctgcttatctgtctgtacgtggctctctccattggcctgtttttcctgcttatctatctggggcgcacgggactcagcaaaatgtggctggccgccacaaagaaggcttcttga

SEQ ID NO: 14503 - RNA, 3480 nt, synthetic construct
  misc_feature 1..3480: note = derived and/or modified CDS sequence (opt5) from RVFV(2007001811)__EU574040.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatcagccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgatatcggagtccatatggctcacgacgatcaaagcgtgtcctctaagatcgttgcccattgccctccccaggacccgtgtctggtgcacggctgcattgtctgtgcgcacgggcttatcaactaccagtgccataccgccctgagcgctttcgtggtggttttcgtcttttcctctattgccatcatttgtctcgctatcctgtatagagtgcttaaatgcctgaagatcgcccctcggaaagtgctcaatcccctgatgtggattacagcgttcatcagatgggtctacaagaaaatggtggcccgcgttgctgacaacattaaccaggtgaatcgggaaatcggatggatggagggcgggcaactggtcctcggaaaccctgcccccattcctagacacgctcccatcccgcgctacagcacctatctgatgcttctgctcattgtgtcctacgccagcgcctgttctgagctgatccaggcttccagccggatcacgacatgctctaccgaaggcgttaataccaagtgtagactgtccgggacagcgcttattcgcgccggcagcgtgggagctgaggcctgcctcatgctgaagggcgtcaaagaagatcagaccaagtttctgatgatcaaaacagtgtctagcgagctctcctgtcgggaggggcagagctattggacgggatctttctcccctaagtgcctgagctccagacgctgccatcttgttggcgaatgtcacgtgaaccggtgcctgtcttggagagacaatgagaccagcgccgaattttccttcgtcggggagtctacaaccatgcgcgaaaacaaatgttttgagcaatgcggaggctgggggtgtggctgcttcaatgtgaaccccagctgtctctttgtgcacacatacctgcagtccgtccggaaggaggctctgagagttttcaattgcattgattgggtgcataaacttaccctcgaaatcacggactttgatggatctgtgagcaccattgacctgggcgcctccagctctcggttcacaaactgggggtccgtcagcctgtctctcgatgcggagggaatctccggcagcaattctttttccttcatcgaaagccccgggaagggatatgctattgtggacgagcctttctccgaaatcccgcgccagggctttctgggggagattagatgtaacagcgagtctagcgttctttccgcccacgaatcttgcctgcgggcccccaatctcatcagctacaagcctatgattgatcagctggagtgtaccacaaacctgatcgaccccttcgtggtctttgaaagaggctcccttcctcaaacccgcaatgagaaaacgttcgctgcctctaagggaaaccggggcgtgcaggcgtttagcaaagggtccgttcaggctgatctcacactgatgttcgacaactttgaagtggatttcgtcggagccgccgtgtcttgcgacgctgcctttctgaatctcaccggctgctatagctgtaacgctggggccagagtttgcctgtccatcacaagcaccggaaccggcacactttctgcgcataataaggacggctccctgcacattgtgctccccagcgagaacgggacgaaggatcaatgtcagatcctgcatttcaccgtccctgaggtggaagaggaatttatgtactcttgcgacggagatgagcgccccctgcttgtgaaaggcacactcattgccatcgacccgttcgatgacagacgggaggctgggggagaatccaccgtcgttaatcctaagagcggctcctggaactttttcgattggttctctgggctgatgagctggtttggaggccccctgaaaacaattctcctgatctgtctttacgtggccctgtccatcggcctcttctttctgctgatttatcttgggcgcaccggactgagcaagatgtggctcgctgccacgaaaaaggcctcttga

SEQ ID NO: 14504 - RNA, 3480 nt, synthetic construct
  misc_feature 1..3480: note = derived and/or modified CDS sequence (opt5) from RVFV(ANK-6087)__DQ380216.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcatgacacaggaggatgctacctgtaagcctgttacatacgccggggcttgctcctctttcgacgtgctgctggaaaaaggaaagtttcccctcttccagagctatgcccaccatcgcaccctgcttgaggcggtccacgatacaattatcgccaaagctgacccgccttcctgtgatctgcagagcgcccacggcaacccctgcatgaaggaaaagctcgtgatgaaaacccattgtcctaatgactaccaatctgctcactatctgaacaatgatgggaagatggcctccgttaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtgtgcgaggtcggcgtgcaagctctcaagaaatgcgatggccagctgtccaccgcgcatgaagtggtcccctttgccgttttcaagaatagcaaaaaggtgtaccttgacaagctggatctcaaaacagaggaaaacctgcttcctgactcctttgtgtgtttcgagcacaaggggcagtacaaaggaaagctggattctggccagaccaaacgggaactcaagagctttgacatttcccaatgccccaagatcgggggacacggcagcaaaaagtgtacgggggatgctgccttctgctctgcctatgagtgtacagctcagtacgccaatgcgtattgctcccatgctaacggaagcggcatcgtccagattcaagtgtctggcgtttggaaaaagcccctgtgtgtggggtacgagcgcgtcgtggttaaaagagaactgagcgccaagcctatccagcgggtggagccgtgcaccacatgtattaccaagtgcgaaccccacggactcgtcgtgcgctccaccggctttaaaatctctagcgccgtcgcttgtgcctccggggtgtgcgttacaggaagccagtctccttccacggagattaccctgaagtatcccggcatcagccagtcttccgggggcgacatcggagtgcatatggctcacgatgaccaaagcgtctcctctaaaattgtggcccattgccctccccaggacccgtgtcttgttcacggctgcatcgtgtgtgcgcacgggctgattaattaccagtgccatacagccctcagcgctttcgtcgtggtgttcgtcttttcctctatcgccattatctgtctggctatcctttatagagttctgaagtgcctcaaaattgcccctcggaaggtgctgaaccccctgatgtggatcaccgcgttcattagatgggtgtaccgcaaaatggtcgcccgggtggctgataatatcaaccaggttaacagagaaattggatggatggagggcgggcaactcgtgctgggaaatcctgcccccatccctcgccacgtccccattccgcggtacagcacatatcttatgctgctcctgatcgtgtcctacgctagcgcctgttctgagctgatccaggcctccagcagaattaccacgtgctctacagaaggcgttaacaccaagtgtcgcctttccgggaccgctctcatccgggcgggcagcgtgggagccgaggcttgcctgatgctgaagggcgtcaaagaagaccagacaaagtttctcaaaattaagaccgtgtctagcgagctgtcctgtagagaggggcagagctattggacaggatctttctcccctaaatgccttagctcccgccggtgccatctggttggcgaatgtcacgtgaatagatgcctctcttggcgcgataacgagacgagcgccgaattttccttcgtcggggagtctaccacaatgcgggaaaataagtgttttgagcaatgcggaggctgggggtgtggctgcttcaacgtgaatcccagctgtctgtttgtgcacacctacctgcagtccgtcagaaaggaggcccttcgggttttcaactgcatcgactgggtgcataaactcacactggaaattaccgattttgacggatctgtgagcacgatcgatctgggcgcttccagctctcgcttcaccaattgggggtccgtcagcctctctctggacgccgagggaatctccggcagcaactctttttccttcattgaaagccccgggaagggatatgcgatcgtggatgagcctttctccgaaattccgagacagggctttcttggggagatccggtgtaatagcgagtctagcgttctgtccgctcacgaatcttgcctcagagcccccaacctgattagctacaaacctatgatcgaccagctggagtgttccacaaatcttatcgatcccttcgtggtctttaagcgcggctctctccctcaaacccggaacgacaaaacattcgccgctagcaagggaaatagaggcgtgcaggccttttccaaggggtctgttcaggcggatctgaccctgatgttcgacaactttgaagtggacttcgtcggagctgccgtgagctgcgatgccgcttttctcaacctgacgggctgctattcctgtaatgccggggctcgcgtttgccttagcattacatctaccggaacaggcaccctgtccgcccataacaaagacggcagcctccacatcgtgctgccctctgagaatgggaccaaggatcaatgtcagattctgcatttcacagtccctgaagtggaggaggaatttatgtactcctgcgacggagatgagagaccccttctcgtgcggggcacgctgatcgcgattgacccgttcgatgaccgcagagaagccgggggagagagcaccgtcgttaaccctaaatccggctcttggaactttttcgattggttcagcgggctgatgtcctggtttggaggccccctcaagacaatcctgcttatctgtctgtacgtggctctcagcattggcctgttctttctgcttatctatctggggcggaccggactctctaaaatgtggctggccgctacaaagaaggcctcctga

SEQ ID NO: 14505 - RNA, 3480 nt, synthetic construct
  misc_feature 1..3480: note = derived and/or modified CDS sequence (opt5) from RVFV(2007000234)__JF326191.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattcgcagagaaacgatggccggcatcgctatgaccgtgctgcctgcccttgctgtcttcgccctggcgcccgtggtttttgccgaggaccctcacctccggaatcgccccgggaaaggacataactatattgatggcatgacacaggaggacgctacctgtaagcctgtgacatacgccggcgcttgctcctctttcgatgtcctgctggaaaaagggaagtttcccctcttccagagctatgcccaccatagaaccctgcttgaggcggtgcacgacacaatcattgccaaagctgatcccccttcctgtgacctgcagagcgcccacggaaatccctgcatgaaggaaaagctcgttatgaaaacccattgtcctaacgattaccaatctgctcactatctgaataacgacggcaagatggcctccgtgaaatgcccgccgaagtacgagcttacggaagattgtaatttttgccggcagatgaccggggccagcctgaaaaagggatcttatcctctccaggacctgttctgtcagtccagcgaggacgatggctctaaactgaagacaaagatgaaaggggtctgcgaggtgggagtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaagggccagtacaaagggaccatggactctggacagacgaagcgcgaactgaaatcctttgatatctcccaatgccccaagattggcgggcacggaagcaagaaatgtacaggcgacgctgccttctgctctgcctatgagtgtaccgctcagtacgccaacgcgtattgctcccatgctaatgggagcggaatcgtgcagatccaagtttctggcgtgtggaagaaacccctctgtgtcggctacgagagagtggttgtgaagcgggaactgagcgccaaacctattcagcgcgtcgagccgtgcacaacctgtatcaccaagtgcgaaccccacgggctggtggtcagatccacaggatttaagatttctagcgccgtggcttgtgcctccggcgtttgcgtgacggggagccagtctccttccaccgagatcacactcaaatatcccggaattagccagtcttccggcggggatatcggcgtccatatggctcacgacgatcaaagcgtgtcctctaagatcgttgcccattgccctccccaggacccgtgtctggtgcacggatgcattgtctgtgcgcacggccttatcaactaccagtgccataccgccctgagcgctttcgtggtgattttcgtttttagctctacagccatcatttgtctcgctgtcctgtatcgggtgcttaaatgcctgaagatcgcccctagaaaagtgctcaatcccctgatgtggatcaccgcgttcattcgctgggtctacaagaaaatggtggcccgggttgctgacaacatcaaccaggtgaatagagaaattgggtggatggagggaggccaactggccctcgggaaccctgctcccatccctcgccacgcccccattccgcggtacagcacgtatctgatgcttctgctcatcgtctcctacgccagcgcttgttctgagctgattcaggcgtccagcagaatcacaacctgctctaccgaaggagtgaatacaaagtgtcgcctgtccggcaccgcccttatccgggctgggagcgttggcgccgaggcctgcctcatgctgaagggagtgaaagaagatcagacaaagtttctgaaaattaagacggtctctagcgagctctcctgtagagagggccagagctattggaccgggtctttctcccctaaatgcctgagctcccgccggtgccatcttgtgggagaatgtcacgttaacagatgcctgtcttggcgcgacaatgagacaagcgctgaattttccttcgtgggcgagtctaccacaatgcgggaaaacaagtgttttgagcaatgcgggggatggggctgtgggtgcttcaatgtcaaccccagctgtctctttgtgcacacctacctgcagtccgtgagaaaggaggccctgcgggtcttcaattgcatcgattgggttcataaacttacgctcgaaattaccgactttgatggctctgtgagcacaatcgacctgggagcgtccagctctcgcttcaccaactggggctccgtgagcctgtctctcgatgctgaggggatttccggaagcaattctttttccttcatcgaaagccccggcaaggggtatgccatcgtcgacgagcctttctccgaaattccgagacagggatttctgggcgagatccggtgtaacagcgagtctagcgtgctttccgcccacgaatcttgcctgagagctcccaatctcgttagctacaaacctatgattgatcagctggagtgtacaaccaacctgatcgaccccttcgtggtctttgaacgcgggtcccttcctcaaacgcggaatgataagacattcgccgcgtctaaaggcaacagaggagtgcaggcttttagcaagggctccgttcaggccgacctcaccctgatgttcgataactttgaggtggacttcgtcggggccgctgtgtcttgcgacgccgcttttctgaatctcacaggatgctatagctgtaacgccggcgcgcgcgtttgcctgtccattaccagcaccgggacaggaacgctttctgcccataataaggatggctccctgcacatcgtgctccccagcgaaaacggcaccaaagaccaatgtcagatcctgcatttcacagtccctgaggtggaggaagagtttatgtactcttgcgatggggacgaaagacccctgcttgtgaagggaaccctcattgctatcgatccgttcgacgatcggcgcgaggccggcggggagtccacagtcgttaatcctaaaagcggatcctggaactttttcgactggttctctggcctgatgagctggtttgggggacccctgaagaccattctcctgatctgtctttacgtggctctgtccattggcctcttctttctgctgatctatcttggcagaacggggctgagcaaaatgtggctcgccgccacaaagaaggcttcttga

SEQ ID NO: 14506 - RNA, 3480 nt, synthetic construct
  misc_feature 1..3480: note = derived and/or modified CDS sequence (opt5) from RVFV(SA-75)__DQ380189.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgtcacggcaaggaccctgaagataaaatcagcctcgtcaaggggccgccccataaaaagagagttggaatcgtgcggtgcgagcgcagacgggacgccaagcaaattggccgcgaaacgatggccagaatcgctatgaccgtgctgcctgcccttgctgtcttcgccctggcgcccgtggtttttgccgaggatcctcacctccggaaccgccccgggaaaggacataattatattgacggcatgacacaggaggatgctacctgtaagcctgtgacatacgccggcgcttgctcctctttcgacgtcctgctggaaaaagggaagtttcccctcttccagagctatgcccaccatagaaccctgcttgaggcggtgcacgatacaatcattgccaaagctgacccgccttcctgtgatctgcagagcgcccacggaaacccctgcatgaaggaaaagctcgttatgaaaacccattgtcctaatgactaccaatctgctcactatctgaacaatgatggcaagatggcctccgtgaaatgtcccccgaagtacgagcttacggaagactgcaacttttgccggcagatgaccggggccagcctgaaaaagggatcttatcctctccaggacctgttctgtcagtccagcgaggatgacggctctaaactgaagacaaagatgaaaggggtctgcgaggtgggagtgcaagctctcaagaaatgcgatggccagctgtccaccgcgcatgaagtcgttccctttgccgtgttcaagaatagcaaaaaggtgtaccttgacaagctggatctcaaaacagaggaaaacctgcttcctgactcctttgtctgtttcgagcacaagggccagtacaaagggaccatggattctggacagacgaagcgcgaactgaaatcctttgacatcagccaatgccccaagattggcgggcacggaagcaagaaatgtacaggcgatgctgccttctgctctgcctatgagtgtaccgctcagtacgccaatgcgtattgctcccatgctaacgggagcggagtggttcagatccaagtgtctggcgtctggaagaaacccctctgtgtgggctacgagagagttgtggtcaagcgggaactgagcgccaaacctatccagcgcgtggagccgtgcacaacctgtattaccaagtgcgaaccccacgggctggtcgtgagatccacaggatttaagatctctagcgccgttgcttgtgcctccggcgtgtgcgtcacggggagccagtctccttccaccgagattacactcaaatatcccggaatcagccagtcttccggcggggacattggcgtgcatatggctcacgatgaccaaagcgtttcctctaagatcgtggcccattgccctccccaggacccgtgtctggtccacggatgcatcgtgtgtgcgcacggccttattaattaccagtgccataccgccctgagcgctttcgtggttgtcttcgtgttttcctctgtggccatcatttgtctcgctatcctgtataaagtccttaagtgcctgaaaattgcccctcggaaggtgctcaaccccctgatgtggatcacagttttcatcagatgggtgtacaaaaagatggtcgcgcgcgtggccgataatattaaccaggttaaccgggaaatcgggtggatggagggaggccaactggctctcgggaatcctgcccccattcctagacacgctcccatcccgcgctacagcacctatctgatgcttctgctcattgtgtcctacgccagcgcctgttctgagctgatccaggcttccagccggattacgacatgctctaccgaaggagtcaacaccaagtgtagactgtccggcacagcgcttatccgcgccgggagcgtgggcgctgaggcctgcctcatgctgaaaggagttaaggaagaccagaccaaatttctgaagatcaaaacagtgtctagcgagctctcctgtcgggagggccagagctattggacggggtctttctcccctaagtgcctgagctccagacgctgccatcttgtcggagaatgtcacgtgaatcggtgcctgtcttggagagataacgagaccagcgccgaattttccttcgtgggcgagtctacaaccatgcgcgaaaataagtgttttgagcaatgcgggggatggggctgtgggtgcttcaacgtcaatcccagctgtctctttgttcacacatacctgcagtccgtgcggaaagaggctctgagagtgttcaactgcattgactgggtccataaacttaccctcgaaatcacggattttgacggctctgtgagcaccattgatctgggagcctccagctctcggttcacaaattggggctccgttagcctgtctctcgacgcggaggggatctccggaagcaactctttttccttcattgaaagccccggcaaggggtatgctatcgtggatgagcctttctccgaaatcccgcgccagggatttctgggcgagattagatgtaatagcgagtctagcgtcctttccgcccacgaatcttgcctgcgggcccccaacctcatcagctacaagcctatgattgaccagctggagtgtaccacaaatctgatcgatcccttcgtggtttttgaaagagggtcccttcctcaaacccgcaacgacaaaacgttcgctgcctctaagggcaatcggggagtgcaggcgtttagcaagggctccgtccaggctgatctcacactgatgttcgacaactttgaggtggacttcgttggggccgccgtgtcttgcgatgctgcctttctgaacctcaccggatgctatagctgtaatgctggcgccagagtctgcctgtccattacaagcaccgggaccggaacactttctgcgcataacaaagacggctccctgcacatcgtgctccccagcgaaaatggcacgaaggatcaatgtcagatcctgcatttcaccgtgcctgaggtcgaggaagagtttatgtactcttgcgacggggatgaacgccccctgcttgttaaaggaacactcattgccatcgacccgttcgatgacagacgggaggctggcggggagtccaccgtggtgaaccctaagagcggatcctggaactttttcgattggttctctggcctgatgagctggtttgggggacccctgaaaacaattctcctgatctgtctttacgtcgccctgtccattggcctcttctttctgctgatctatcttggccgcaccgggctgagcaagatgtggctcgctgccacgaagaaagcctcttga

SEQ ID NO: 14507 - RNA, 3480 nt, synthetic construct
  misc_feature 1..3480: note = derived and/or modified CDS sequence (opt5) from RVFV(KEN07-KUR340)__EF460404.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatctcccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgatatcggagtccatatggctcacgacgatcaaagcgtgtcctctaagatcgttgcccattgccctccccaggacccgtgtctggtgcacggctgcattgtctgtgcgcacgggcttatcaactaccagtgccataccgccctgagcgctttcgtggtgattttcgtttttagctctacagccatcatttgtctcgctgtcctgtatagaatgcttaaatgcctgaagatcgcccctcggatcgtgctcaatcccctgatgtggattaccgcgttcatcagatgggtgtacaaaaagatggtcgcccgcgtggctgacaacattaaccaggttaatcgggaaatcggatggatggagggcgggcaactggccctcggaaaccctgctcccattcctagacacgcccccatcccgcgctacagcacgtatctgatgcttctgctcattgtgtcctacgccagcgcttgttctgagctgatccaggcgtccagccggatcacaacctgctctaccgaaggcgtcaatacaaaatgtagactgtccgggaccgcccttattcgcgctggcagcgtgggagccgaggcctgcctcatgctgaagggcgttaaggaagatcagacaaaatttctgaagatcaaaacggtgtctagcgagctctcctgtcgggaggggcagagctattggaccggatctttctcccctaagtgcctgagctccagacgctgccatcttgtcggcgaatgtcacgtgaaccggtgcctgtcttggagagacaatgagacaagcgctgaattttccttcgttggggagtctaccacaatgcgcgaaaacaaatgttttgagcaatgcggaggctgggggtgtggctgcttcaatgtgaaccccagctgtctctttgtccacacctacctgcagtccgtgcggaaggaggccctgagagtgttcaattgcattgattgggtccataaacttacgctcgaaatcaccgactttgatggatctgttagcacaattgacctgggcgcgtccagctctcggttcaccaactgggggtccgtgagcctgtctctcgatgctgagggaatctccggcagcaattctttttccttcatcgaaagccccgggaaaggatatgccattgtggacgagcctttctccgaaatcccgcgccagggctttctgggggagattagatgtaacagcgagtctagcgtcctttccgcccacgaatcttgcctgcgggctcccaatctcgtgagctacaagcctatgatcgatcagctggagtgtacaaccaacctgattgaccccttcgttgtgtttgaaagaggctcccttcctcaaacgcgcaatgataaaacattcgccgcgtctaagggaaaccggggcgtccaggcttttagcaaagggtccgtgcaggccgacctcaccctgatgttcgataactttgaggttgacttcgtgggagccgctgtctcttgcgacgccgcttttctgaatctcacaggctgctatagctgtaacgccggggcgagagtgtgcctgtccatcaccagcaccggaacaggcacgctttctgcccataataaggatggctccctgcacatcgttctccccagcgaaaacgggaccaaggaccaatgtcagattctgcatttcacagtgcctgaggtcgaggaagagtttatgtactcttgcgatggagacgaacgccccctgcttgtgaaaggcaccctcatcgctattgatccgttcgacgatagacgggaggccgggggagagtccacagtggtcaatcctaagagcggctcctggaactttttcgactggttctctgggctgatgagctggtttggaggccccctgaaaaccatcctcctgatttgtctttacgttgctctgtccatcggcctcttctttctgctgatctatcttgggcgcacgggactgagcaagatgtggctcgccgccacaaagaaggcttcttga

SEQ ID NO: 14508 - RNA, 3480 nt, synthetic construct
  misc_feature 1..3480: note = derived and/or modified CDS sequence (opt5) from RVFV(35/74)__JF784387.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaacaatattacatgtcacggcaaggaccctgaagataaaatcagcctcgtcaaggggccgccccataaaaagagagttggaatcgtgcggtgcgagcgcagacgggacgccaagcaaattggccgcgaaacgatggccgggatcgctatgaccgtgctgcctgcccttgctgtcttcgccctggcgcccgtggtttttgccgaggatcctcacctcagaaaccggcccggaaaaggccataattatattgacggcatgacacaggaggatgctacctgtaagcctgtgacatacgccggggcttgctcctctttcgacgtcctgctggaaaaaggaaagtttcccctcttccagagctatgcccaccatcgcaccctgcttgaggcggtgcacgatacaatcattgccaaagctgacccgccttcctgtgatctgcagagcgcccacggcaacccctgcatgaaggaaaagctcgttatgaaaacccattgtcctaatgactaccaatctgctcactatctgaacaatgatgggaagatggcctccgtgaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtctgcgaggtgggcgtgcaagctctcaagaaatgcgatggccagctgtccaccgcgcatgaagtcgttccctttgccgtgttcaagaatagcaaaaaggtgtaccttgacaagctggatctcaaaacagaggaaaacctgcttcctgactcctttgtctgtttcgagcacaaggggcagtacaaaggaaccatggattctggccagacgaagcgggaactgaaatcctttgacatcagccaatgccccaagattgggggacacggcagcaagaaatgtacaggggatgctgccttctgctctgcctatgagtgtaccgctcagtacgccaatgcgtattgctcccatgctaacggaagcggcgtggttcagatccaagtgtctggcgtctggaagaaacccctctgtgtggggtacgagcgcgttgtggtcaagagagaactgagcgccaaacctatccagcgggtggagccgtgcacaacctgtattaccaagtgcgaaccccacggactggtcgtgcgctccacaggctttaagatctctagcgccgttgcttgtgcctccggggtgtgcgtcacgggaagccagtctccttccaccgagattacactcaaatatcccggcatcagccagtcttccgggggcgacattggagtgcatatggctcacgatgaccaaagcgtttcctctaagatcgtggcccattgccctccccaggacccgtgtctggtccacggctgcatcgtgtgtgcgcacgggcttattaattaccagtgccataccgccctgagcgctttcgtggttgtcttcgtgttttcctctgtggccatcatttgtctcgctatcctgtataaagtccttaagtgcctgaaaattgcccctagaaaggtgctcgatcccctgatgtggatcacagttttcatccggtgggtgtacaaaaagatggtcgcgagagtggccgacaacattaatcaggttaaccgcgaaatcggatggatggagggcgggcaactggctctcggaaaccctgcccccattcctcggcacgctcccatcccgagatacagcacctatctgatgcttctgctcattgtgtcctacgccagcgcctgttctgagctgatccaggcttccagccgcattacgacatgctctaccgaaggcgtcaataccaagtgtcggctgtccgggacagcgcttatcagagccggcagcgtgggagctgaggcctgcctcatgctgaaaggcgttaaggaagatcagaccaaatttctgaagatcaaaacagtgtctagcgagctctcctgtcgcgaggggcagagctattggacgggatctttctcccctaagtgcctgagctcccggagatgccatcttgtcggcgaatgtcacgtgaaccgctgcctgtcttggcgggacaatgagaccagcgccgaattttccttcgtgggggagtctacaaccatgagagaaaacaagtgttttgagcaatgcggaggctgggggtgtggctgcttcaatgtcaaccccagctgtctctttgttcacacatacctgcagtccgtgcgcaaagaggctctgcgggtgttcaattgcattgattgggtccataaacttaccctcgaaatcacggactttgatggatctgtgagcaccattgacctgggcgcctccagctctagattcacaaactgggggtccgttagcctgtctctcgatgcggagggaatctccggcagcaattctttttccttcattgaaagccccgggaagggatatgctatcgtggacgagcctttctccgaaatcccgcggcagggctttctgggggagattcgctgtaacagcgagtctagcgtcctttccgcccacgaatcttgcctgagagcccccaatctcatcagctacaagcctatgattgatcagctggagtgtaccacaaacctgatcgaccccttcgtggtttttgaacggggctcccttcctcaaaccagaaatgataaaacgttcgctgcctctaagggaaaccgcggcgtgcaggcgtttagcaaggggtccgtccaggctgacctcacactgatgttcgacaattttgaggtggatttcgttggagccgccgtgtcttgcgacgctgcctttctgaacctcaccggctgctatagctgtaacgctggggcccgggtctgcctgtccattacaagcaccggaaccggcacactttctgcgcataataaagatggctccctgcacatcgtgctccccagcgaaaacgggacgaaggaccaatgtcagatcctgcatttcaccgtgcctgaggtcgaggaagagtttatgtactcttgcgatggagacgaaagacccctgcttgttaaaggcacactcattgccatcgatccgttcgacgatcgcagagaggctgggggagagtccaccgtggtgaatcctaagagcggctcctggaactttttcgactggttctctgggctgatgagctggtttggaggccccctgaaaacaattctcctgatctgtctttacgtcgccctgtccattggcctcttctttctgctgatctatcttgggcggaccggactgagcaagatgtggctcgctgccacgaagaaagcctcttga

SEQ ID NO: 14509 - RNA, 3480 nt, synthetic construct
  misc_feature 1..3480: note = derived and/or modified CDS sequence (opt5) from RVFV(200803167)__JF311382.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggacctccacctgagaaatcggcctggaaaaggccataactatattgatggcatgacacaggaggacgctacctgtaagcccgtgacatacgccggggcttgctcctctttcgatgtcctgctcgaaaaaggaaagtttcctctgttccagagctatgcccaccatcgcacccttctggaggcggtgcacgacacaatcattgccaaagctgatccgccctcctgtgacctccagagcgcccacggcaatccttgcatgaaggaaaagctggttatgaaaacccattgtcccaacgattaccaatctgctcactatcttaataacgacgggaagatggcctccgtgaaatgccctcccaagtacgagctgacggaagattgtaatttttgcagacagatgaccggagccagcctcaaaaagggctcttatccgctgcaggacctgttctgtcagtccagcgaggacgatgggtctaaactcaagacaaagatgaaaggagtctgcgaggtgggcgtgcaagctctgaagaaatgcgacggccagctttccaccgcgcatgaagtcgttccttttgccgtgttcaagaacagcaaaaaggtgtacctggataagctcgacctgaaaacagaggaaaatcttctgcccgattcctttgtctgtttcgagcacaaggggcagtacaaaggaaccatggactctggccagacgaagcgggaactcaagagctttgatatctcccaatgccctaaaattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctgtgtgtcgggtacgagcgcgtggttgtgaagagagaactgagcgccaaacccattcagcgggtcgagccttgcacaacctgtatcaccaagtgcgaaccgcacggactcgtggtccgctccacaggctttaagatttctagcgccgtggcttgtgcctccggggtttgcgtgacgggaagccagtctccctccaccgagatcgctctgaaatatcctggcattagccagtcttccgggggcgatatcggagtccatatggcccacgacgatcaaagcgtgtcctctaagatcgttgcgcattgtccccctcaggacccctgccttgtgcacggctgcattgtctgtgcccacgggctgatcaactaccagtgccatacagctctcagcgccttcgtggtggttttcgtcttttcctctattgctatcatttgtctggccatcctttatagagtgctgaaatgcctcaagatcgcgccgcggaaagtgctgaatcctctgatgtggattaccgccttcatcagatgggtctacaagaaaatggtggctcgcgttgccgacaacattaaccaggtgaatcgggaaatcggatggatggagggcgggcaactcgtcctgggaaaccccgctcctattcccagacacgcccctatcccccgctacagcacatatcttatgctgctcctgattgtgtcctacgccagcgcttgttctgagctgatccaggcgtccagccggatcaccacgtgctctacagaaggcgttaataccaagtgtagactttccgggaccgccctcattcgcgctggcagcgtgggagccgaggcctgcctgatgctgaagggcgtcaaagaagatcagacaaagtttctcaaaatcaagaccgtgtctagcgagctgtcctgtcgggaggggcagagctattggacaggatctttctccccgaaatgccttagctccagacgctgccatctggttggcgaatgtcacgtgaaccggtgcctctcttggagagacaatgagacgagcgctgaattttccttcgtcggggagtctaccacaatgcgcgaaaacaagtgttttgagcaatgcggaggctgggggtgtggctgcttcaatgtgaaccctagctgtctgtttgtgcacacctacctgcagtccgtccggaaggaggcccttagagttttcaattgcattgattgggtgcataaactcacactggaaatcaccgactttgatggatctgtgagcacgattgacctgggcgcgtccagctctcggttcaccaactgggggtccgtcagcctctctctggatgctgagggaatctccggcagcaattctttttccttcatcgaaagccccgggaagggatatgccattgtggacgagcccttctccgaaatccctcgccagggctttcttggggagattagatgtaacagcgagtctagcgttctgtccgcccacgaatcttgcctccgggctccgaatctgatcagctacaaacccatgattgatcagctggagtgtacaaccaaccttatcgaccctttcgtggtctttgaaagaggctccctcccccaaacacgcaatgataagaccttcgccgcgtctaaaggaaaccggggcgtgcaggcttttagcaaggggtccgttcaggccgacctgacgctgatgttcgataactttgaggtggacttcgtcggagccgctgtgtcttgcgacgccgcttttctcaatctgacaggctgctatagctgtaacgccggggcgagagtttgcctttccatcaccagcacaggaaccggcaccctgtctgcccataataaggatggctccctccacattgtgctgcctagcgaaaacgggacaaaagaccaatgtcagatcctgcatttcacggtccccgaggtggaggaagagtttatgtactcttgcgatggagacgaacgccctcttctcgtgaagggcaccctgattgctatcgatcccttcgacgatagacgggaggccgggggagagtccacagtcgttaatccgaaaagcggctcctggaactttttcgactggttctctgggctgatgagctggtttggaggccctctcaagaccatgctgcttatttgtctgtacgtggctctctccatcggcctgttctttctgcttatctatctggggcgcacaggactcagcaaaatgtggctggccgccaccaagaaggcttcttga

SEQ ID NO: 14510 - RNA, 3480 nt, synthetic construct
  misc_feature 1..3480: note = derived and/or modified CDS sequence (opt5) from RVFV(25010-24)__KM210509.1__NSm-Gn-Gc
  source 1..3480: mol_type = other RNA
atgatcgagagagcctgggacagcctgcgggaagaggaaatgcccgaggaactctcctgctctattagcggcatccgcgaggtgaagacctcctctcaggagctgtacagagctcttaaagccattatcgcggctgatgggctgaataatattacatgtcacggaaaggaccctgaagataaaatcagcctcatcaagggcccgccccataaaaagcgggtcgggattgttcgctgcgagagacggcgcgacgccaagcaagtgggaagagaaacgatggccggcatcgctatgaccgtgctgcctgcccttgctgtcttcgccctggcgcccgtggtttttgccgaggatcctcacctccggaaccgccccgggaaaggacataattatattgacggcatgacacaggaggatgctacctgtaagcctgtgacatacgccggcgcttgctcctctttcgacgtcctgctggaaaaagggaagtttcccctcttccagagctatgcccaccatagaaccctgcttgaggcggtgcacgatacaatcattgccaaagctgacccgccttcctgtgatctgcagagcgcccacggaaacccctgcatgaaggaaaagctcgttatgaaaacccattgtcctaatgactaccaatctgctcactatctgaacaatgatggcaagatggcctccgtgaaatgtcccccgaagtacgagcttacggaagactgcaacttttgccggcagatgaccggggccagcctgaaaaagggatcttatcctctccaggacctgttctgtcagtccagcgaggatgacggctctaaactgaagacaaagatgaaaggggtctgcgaggtgggagtgcaagctctcaagaaatgcgatggccagctgtccaccgcgcatgaagtcgttccctttgccgtgttcaagaatagcaaaaaggtgtaccttgacaagctggatctcaaaacagaggaaaacctgcttcctgactcctttgtctgtttcgagcacaagggccagtacaaagggaccatggattctggacagacgaagcgcgaactgaaatcctttgacatctcccaatgccccaagattggcgggcacggaagcaagaaatgtacaggcgatgctgccttctgctctgcctatgagtgtaccgctcagtacgccaatgcgtattgctcccatgctaacgggagcggaatcgtgcagatccaagtttctggcgtgtggaagaaacccctctgtgtcggctacgagagagtggttgtgaagcgggaactgagcgccaaacctattcagcgcgtcgagccgtgcacaacctgtatcaccaagtgcgaaccccacgggctgattgtgagatccacaggatttaagatctctagcgccgtcgcttgtgcctccggcgtgtgcgttacggggagccagtctccttccaccgagattacactcaaatatcccggaatcagccagtcttccggcggggacatcggcgtgcatatggctcacgatgaccaaagcgtctcctctaagattgtggcccattgccctccccaggacccgtgtctggttcacggatgcatcgtgtgtgcgcacggccttattaattaccagtgccataccgccctgagcgctttcgtcgtggtgttcgtttttagctctgtcgccatcatttgtctcgctatcctgtataaagtgcttaagtgcctgaaaatcgcccctaagaaagtgctcaaccccctgatgtggattacagcgttcatccggtgggtctacaagaagatggtggccagagttgctgataatattaaccaggtgaaccgcgaaatcgggtggatggagggaggccaactggccctcgggaatcctgctcccattcctcggcacgcccccatcccgagatacagcacctatctgatgcttctgctcattgtctcctacgccagcgcttgttctgagctgatccaggcgtccagccgcatcacgacatgctctaccgaaggagtgaacaccaaatgtcggctgtccggcacagcccttattagagctgggagcgttggcgccgaggcctgcctcatgctgaagggagtgaaagacgatcagaccaagtttctgaaaatcaagacagtctctagcgaactctcctgtcgcgagggccagagctattggacggggtctttctcccctaagtgcctgagctcccggagatgccatcttgtgggagagtgtcacgttaatcgctgcctgtcttggcgggacaacgaaaccagcgctgagttttccttcgtgggcgaatctacaaccatgagagagaataaatgttttgaacaatgcgggggatggggctgtgggtgcttcaacgtcaatcccagctgtctctttgtgcacacatacctgcagtccgtgcgcaaggaggccctgcgggtcttcaactgcattgattgggttcataaacttaccctcgagatcacggactttgatggctctgtgagcaccattgacctgggagcgtccagctctagattcacaaattggggctccgtgagcctgtctctcgatgctgaagggatctccggaagcaactctttttccttcatcgagagccccggcaaggggtatgccattgtcgacgaacctttctccgagatcccgcggcagggatttctgggcgaaattcgctgtaatagcgagtctagcgtgctttccgcccacgagtcttgcctgagagctcccaacctcatcagctacaaacctatgattgatcagctggaatgtaccacaaatctgatcgaccccttcgttgtgtttgagcgggggtcccttcctcaaaccagaaacgataagacgttcgccgcgtctaagggcaatcgcggagtccaggcttttagcaaaggctccgtgcaggccgacctcacactgatgttcgacaactttgaagttgatttcgtgggggccgctgtctcttgcgacgccgcttttctgaacctcaccggatgctatagctgtaatgccggcgcgcgggtgtgcctgtccatcacaagcaccgggaccggaacactttctgcccataacaaggatggctccctgcacattgttctccccagcgagaatggcacgaaagaccaatgtcagatcctgcatttcaccgtgcctgaagtcgaggaggaatttatgtactcttgcgatggggacgagagacccctgcttgtgaagggaacactcattgctatcgatccgttcgacgatcgcagagaagccggcggggagtccaccgtggtcaaccctaaaagcggatcctggaactttttcgactggttctctggcctgatgagctggtttgggggacccctgaagacaattctcctgatctgtctttacgttgctctgtccatcggcctcttctttctgctgatttatcttggccggaccgggctgagcaagatgtggctcgccgccacgaaaaaggcttcttga

SEQ ID NO: 14511 - RNA, 3480 nt, synthetic construct
  misc_feature 1..3480: note = derived and/or modified CDS sequence (opt5) from RVFV(Sudan 2V-2007)__JQ820490.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcttttgatatctcccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctggcgtgtggaagaaacccctctgtgtcgggtacgagcgcgtggttgtgaagagagaactgagcgccaaacctattcagcgggtcgagccgtgcacaacctgtatcaccaagtgcgaaccccacggactggtggtccgctccacaggctttaagatttctagcgccgtggcttgtgcctccggggtttgcgtgacgggaagccagtctccttccaccgagatcacactcaaatatcccggcattagccagtcttccgggggcgatatcggagtccatatggctcacgacgatcaaagcgtgtcctctaagatcgttgcccattgccctccccaggacccgtgtagcgtgcacggctgcattgtctgtgcgcacgggctgatcaactaccagtgccataccgccctttccgctttcgtggtggttttcgtcttttctagcattgccatcatttgtctggctatcctctatagagtgctgaaatgccttaagatcgcccctcggaaagtgctgaatcccctcatgtggattacagcgttcatcagatgggtctacaagaaaatggtggcccgcgttgctgacaacattaaccaggtgaatcgggaaatcggatggatggagggcgggcaactggtcctgggaaaccctgcccccattcctagacacgctcccatcccgcgctactccacctatctcatgctgcttctgattgtgagccatgcctctgcctgttccgagctcatccaggctagctctcggatcacgacatgctccaccgaaggcgttaataccaagtgtagactgagcgggacagcgctgattcgcgccggctctgtgggagctgaggcctgccttatgctcaagggcgtcaaagaagatcagaccaagtttctgaaaatcaagacagtgagctccgagctgagctgtcgggaggggcagtcttactggacgggatccttcagccctaaatgcctctcctctagacgctgccacctggttggcgaatgtcacgtgaaccggtgccttagctggagagacaatgagacctccgccgaattttctttcgtcggggagagcacaaccatgcgcgaaaacaagtgttttgagcaatgcggaggctgggggtgtggctgcttcaatgtgaacccctcctgtctgtttgtgcatacatatctccagtctgtccggaaggaggctctgagagttttcaattgcattgattgggtgcacaaactgacccttgaaatcacggactttgatggaagcgtgtccaccattgacctcggcgccagcagctcccggttcacaaactgggggagcgtctctctgtccctggatgcggagggaatcagcggctctaattcctttagcttcatcgaatcccccgggaagggatacgctattgtggacgagcctttcagcgaaatcccgcgccagggctttctcggggagattagatgtaactctgagagctccgttctgtctgcccatgaaagctgccttcgggcccccaatctgatctcctataaacctatgattgatcagctcgagtgtaccacaaacctgatcgaccccttcgtggtctttgaaagaggctctctgcctcaaacccgcaatgataagacgttcgctgccagcaaaggaaaccggggcgtgcaggcgttttccaaggggtctgttcaggctgaccttacactcatgttcgataactttgaggtggacttcgtcggagccgccgtgagctgcgacgctgcctttctgaatctgaccggctgctactcctgtaacgctggggccagagtttgcctcagcatcacatctaccggaaccggcacactgtccgcgcacaataaggatggcagccttcatattgtgctgccctctgaaaacgggacgaaagaccaatgtcagatcctccacttcaccgtccctgaggtggaggaagagtttatgtattcctgcgatggagacgaacgccccctgctggtgaagggcacacttatggccattgatccgttcgacgatagacgggaggctgggggagagagcaccgtcgttaatcctaaatccggctcttggaactttttcgactggttcagcgggctcatgtcctggtttggaggccccctgaagacaatcctgctcatttgtctgtacgtggcccttagcatcggcctgttctttctcctgatctacctggggcgcaccggactttctaaaatgtggctggctgccacgaagaaggcctcctga

SEQ ID NO: 14512 - RNA, 3480 nt, synthetic construct
  misc_feature 1..3480: note = derived and/or modified CDS sequence (opt5) from RVFV(SAUDI 200010901)__KU978778.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcggccgcagacgggatacgaagcaaattgggcgcgagaccatggccggaatcgccatgacagtgctgcctgctcttgccgtcttcgctctggcccccgtggtttttgcggaagaccctcacctcagaaatcggcccggcaaaggccataactatattgatgggatgacccaggaggacgccacatgtaagcctgtgacctacgctggagcctgctcctctttcgatgtcctgctggagaaaggcaagtttcccctcttccagagctatgctcaccatcgcacactgcttgaagccgtgcacgacaccatcattgcgaaagccgatcccccttcctgtgacctgcagagcgctcacgggaatccctgcatgaaggagaagctcgttatgaaaacgcattgtcctaacgattaccaatctgcccactatctgaataacgacggaaagatggcttccgtgaaatgcccgccgaagtacgaacttaccgaggattgtaatttttgcagacagatgacaggcgccagcctgaaaaaggggtcttatcctctccaggacctgttctgtcagtccagcgaagacgatggatctaaactgaagaccaagatgaaaggcgtctgcgaggtgggcgtgcaagccctcaagaaatgcgacgggcagctgtccacagctcatgaggtcgttccctttgcggtgttcaagaacagcaaaaaggtgtaccttgataagctggacctcaaaaccgaagagaatctgcttcctgattcctttgtctgtttcgaacacaagggacagtacaaaggcacgatggactctgggcagacaaagcgggagctgaaatcctttgatatcagccaatgccccaagattggaggccacgggagcaagaaatgtaccggagacgccgctttctgctctgcctatgaatgtacagcccagtacgctaacgccttttgctcccatgcgaatggcagcggcatcgtgcagatccaagtttctggggtgtggaagaaacccctctgtgtcggatatgagcgcgtggttgtgaagagagagctgagcgctaaacctattcagcgggtcgaaccgtgcaccacctgtatcacaaagtgcgagccccacggcctggtggtccgctccacggggttcaagatttctagcgccgtggcctgtgcttccggagtttgcgtgaccggcagccagtctccttccacagaaatcaccctcaaataccccgggattagccagtcttccggcggagatatcggcgtccatatggcccacgacgatcaaagcgtgtcctctaagatcgttgctcattgccctccccaggacccgtgtctggtgcacgggtgcattgtctgtgcccacggacttatcaactatcagtgccatacagcgctgagcgccttcgtggtggtttttgtcttctcctctattgctatcatttgtctcgccatcctgtacagagtgcttaaatgcctgaagatcgctcctcggaaagtgctcaatcccctgatgtggattaccgcctttatcagatgggtctataagaaaatggtggcgcgcgttgccgacaacattaaccaggtgaatcgggagatcggctggatggaagggggacaactggtcctcggcaaccctgctcccattcctagacacgcccccatcccgcgctacagcacgtacctgatgcttctgctcattatctcctatgctagcgcctgttctgagctgatccaggcctccagccggattacaacctgctctaccgagggggtgaatacaaagtgtagactgtccggcaccgctcttatccgcgcgggaagcgttggcgccgaggcttgcctcatgctgaagggggtgaaagaagatcagacaaagttcctgaaaattaagacggtctctagcgaactctcctgtcgggagggacagagctactggaccggctctttttcccctaaatgcctgagctccagacgctgccatcttgtgggggagtgtcacgttaaccggtgcctgtcttggagagacaatgaaacaagcgccgagttctcctttgtgggagaatctaccacaatgcgcgagaacaagtgtttcgaacaatgcggcgggtggggctgtggatgctttaatgtcaaccccagctgtctcttcgtgcacacctatctgcagtccgtgcggaaggaggccctgagagtctttaattgcatcgattgggttcataaacttacgctcgagattaccgacttcgatggctctgtgagcacaatcgacctgggggcttccagctctcggtttaccaactggggatccgtgagcctgtctctcgatgccgaaggcatctccgggagcaattctttctccttcattgagagccccggaaagggctacgcgatcgtcgacgaacctttttccgagattccgcgccaggggttcctgggcgaaatcagatgtaacagcgagtctagcgtgctttccgctcacgagtcttgcctgcgggcccccaatctcattagctataaacctatgatcgatcagctggaatgtacaaccaacctgatcgacccctttgttgtgttcgagagaggatcccttcctcaaacgcgcaatgaaaagacatttgccgcttctaaaggcaacagaggggtccaggccttcagcaagggatccgtgcaggcggatctcaccctgatgtttgacaacttcgaggttgattttgtgggcgctgccgtctcttgcgacgccgctttcctgaatctcacagggtgctacagctgtaacgccggagctcgggtgtgcctgtccattaccagcaccggcacaggcacgctttctgcccataataaggacgggtccctgcacatcgttctccccagcgaaaacggaaccaaagatcaatgtcagattctgcattttacagtgcctgaggtcgaggaagagttcatgtattcttgcgacggcgatgaacgccccctgcttgtgaaggggaccctcatcgcgattgacccgtttgatgacagacgggaggccggaggcgagtccacagtggtcaatcctaaaagcgggtcctggaacttcttcgattggttttctggactgatgagctggttcggcggccccctgaagaccatcctcctgatctgtctttacgttgctctgtccattgggctctttttcctgctgatctaccttggacgcacgggcctgagcaaaatgtggctcgccgctacaaagaaggcctcttga

SEQ ID NO: 14513 - RNA, 3480 nt, synthetic construct
  misc_feature 1..3480: note = derived and/or modified CDS sequence (opt5) from RVFV(2373/74)__DQ380194.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaataatattacatgttatggcaaggaccctgaagataaaatcagcctcatcaaggggccgccccacaaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcatctcagaaaccggcccggaaaaggccacaattacatcgacggcatgacacaggaggatgctacctgtaagcctgttacatatgccggggcttgctcctctttcgacgtgctgctggaaaaaggaaagtttcccctcttccagagctacgcccatcaccgcaccctgcttgaggcggtccatgatacaattatcgccaaagctgacccgccttcctgtgatctgcagagcgcccacggcaacccctgcatgaaggaaaagctcgtgatgaaaacccactgtcctaatgactatcaatctgctcattacctgaacaatgatgggaagatggcctccgttaaatgtcccccgaagtatgagcttacggaagactgcaacttttgcagacagatgaccggagccagcctgaaaaagggctcttaccctctccaggacctgttctgtcagtccagcgaggatgacgggtctaaactgaagacaaagatgaaaggagtgtgcgaggtcggcgtgcaagctctcaagaaatgcgatggccagctgtccaccgcgcacgaagtggtcccctttgccgttttcaagaatagcaaaaaggtgtaccttgacaagctggatctcaaaacagaggaaaacctgcttcctgactcctttgtgtgtttcgagcataaggggcagtataaaggaaccatggattctggccagacgaagcgggaactgaaatcctttgacatttcccaatgccccaagatcgggggacacggcagcaagaaatgtacaggggatgctgccttctgctctgcctacgagtgtaccgctcagtatgccaatgcgtactgctcccacgctaacggaagcggcatcgtccagattcaagtgtctggcgtttggaagaaacccctctgtgtggggtatgagcgcgtcgtggttaagagagaactgagcgccaaacctatccagcgggtggagccgtgcacaacctgtattaccaagtgcgaaccccatggactggtcgtgcgctccacaggctttaagatctctagcgccgtcgcttgtgcctccggggtgtgcgttacgggaagccagtctccttccaccgagattacactcaaataccccggcatcagccagtcttccgggggcgacatcggagtgcacatggctcatgatgaccaaagcgtctcctctaagatggtggcccactgccctccccaggacccgtgtctggttcatggctgcattgtgtgtgcgcacgggcttatcaattatcagtgccacaccgccctgagcgctttcgtcgtggtgttcgtttttagctctgtcgccattatctgtctcgctattctgtacaaagtgcttaagtgcctgaaaatcgcccctagaaaggtgctcaaccccctgatgtggatcacagcgttcattcggtgggtctacaaaaagatggtggccagagttgctgataatatcaaccaggtgaaccgcgaaattggatggatggagggcgggcaactggccctcggaaatcctgctcccatccctcggcatgcccccattccgagatatagcacctacctgatgcttctgctcatcgtctcctatgccagcgcttgttctgagctgattcaggcgtccagccgcatcacgacatgctctaccgaaggcgtgaacaccaagtgtcggctgtccgggacagcccttatcagagctggcagcgttggagccgaggcctgcctcatgctgaaaggcgtgaaggaagaccagaccaaatttctgaagattaaaacagtctctagcgagctctcctgtcgcgaggggcagagctactggacgggatctttctcccctaagtgcctgagctcccggagatgccaccttgtgggcgaatgtcatgttaatcgctgcctgtcttggcgggataacgagaccagcgctgaattttccttcgtgggggagtctacaaccatgagagaaaataagtgttttgagcaatgcggaggctgggggtgtggctgcttcaacgtcaatcccagctgtctctttgtgcacacatatctgcagtccgtgcgcaaagaggccctgcgggtcttcaactgcatcgactgggttcacaaacttaccctcgaaattacggattttgacggatctgtgagcaccctggatctgggcgcgtccagctctagattcacaaattgggggtccgtgagcctctctctggacgctgagggaatctccggcagcaactctttttccttcattgaaagccccgggaaaggatacgccatcgtcgatgagcctttctccgaaatcccgcggcagggctttcttggggagattcgctgtaatagcgagtctagcgtgctgtccgcccatgaatcttgcctcagagctcccaacctgatcagctataagcctatgattgaccagctggagtgtaccacaaatcttatcgatcccttcgttgtgtttgaacggggctccctccctcaaaccagaaacgagaaaacgttcgccgcgtctaagggaaatcgcggcgtccaggcttttagcaaggggtccgtgcaggccgacctgacactgatgttcgataactttgaagttgacttcgtgggagccgctgtctcttgcgacgccgcttttctcaacctgaccggctgctacagctgtaatgccggggcgcgggtgtgcctttccattacaagcaccggaaccggcacactgtctgcccacaacaaagatggctccctccatatcgttctgcccagcgagaatgggacgaaggaccaatgtcagatcctgcacttcaccgtgcctgaggtcgaagaggaatttatgtactcttgcgatggagacgagagaccccttctcgtgaaaggcacactgattgctatcgatccgttcgacgatcgcagagaggccgggggagaatccaccgtggtcaaccctaagagcggctcctggaactttttcgactggttctctgggctgatgagctggtttggaggccccctcaaaacaattctgcttatctgtctgtatgttgctctctccattggcctgttctttctgcttatctacctggggcggaccggactcagcaagatgtggctggccgccacgaagaaggcttcttga

SEQ ID NO: 14514 - RNA, 3480 nt, synthetic construct
  misc_feature 1..3480: note = derived and/or modified CDS sequence (opt5) from RVFV(KEN/Kil-006/07)__HM586966.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggagtggtgcggtgcgagcgcagacgggatgccaagcaaatcggccgcgaaacgatggccgggattgctatgaccgtcctgcctgcccttgctgtgttcgccctggcgcccgttgtgtttgccgaggaccctcacctcagaaatcggcccggaaaaggccataactatatcgatggcatgacacaggaggacgctacctgtaagcctgtcacatacgccggggcttgctcctctttcgatgtgctgctggaaaaaggaaagtttccgctgttccagagctatgcccaccatcgcaccctgcttgaggcggttcacgacacaattatcgccaaagctgatcccccttcctgtgacctgcagagcgccgatggcaataagtgcatgaaggaaaaactcgtgatgaagacccactgtcccaacgactaccaatctgctcattatctgaataacgatgggaaaatggcctccgtcaagtgccctcccaaatacgagcttacggaagactgtaatttttgcagacagatgaccggagccagcctgaagaaaggctcttatccgctccaggacctgttctgtcagtccagcgaggatgacgggtctaagctgaagacaaaaatgaagggagtgtgcgaggtgggcgtccaagctctcaaaaagtgcgatggccagctgtccaccgcgcacgaagttgtgccttttgccgtgttcaaaaacagcaagaaggtctaccttgacaaactggatctcaagacagaggaaaatctgcttcccgactcctttgtgtgtttcgagcataaagggcagtacaagggaaccatggattctggccagacgaaacgggaactcaagagctttgacatttcccaatgccctaagatcgggggacacggcagcaaaaagtgtacaggggatgctgccttctgctctgcctatgagtgtaccgctcagtacgccaacgcgtattgctcccacgctaatggaagcggcattgttcagatccaagtgtctggcgtctggaaaaagcccctctgtgtggggtacgagcgcgttgtggtcaaaagagaactgagcgccaagcccatccagcgggtggagccttgcacaacctgtattaccaagtgcgaaccgcatggactggtcgtgcgctccacaggctttaaaatctctagcgccgttgcttgtgcctccggggtgtgcgtcacgggaagccagtctccctccaccgagattacactcaagtatcctggcatcagccagtcttccgggggcgacattggagtgcacatggctcatgatgaccaaagcgtttcctctaaaatcgtggcccactgcccgcctcaggacccctgtctggtccatggctgcatcgtgtgtgcgcacgggcttattaactaccagtgccacaccgccctgagcgctttcgtggttatcttcgtcttttcctctacagccattatctgtctcgctgtgctgtatagagtgcttaagtgcctgaaaattgccccgcggaaggtcctcaatcctctgatgtggatcaccgcgttcatcagatgggtgtacaaaaagatggttgcccgcgtggctgataacattaaccaggtcaatcgggaaatcggatggatggagggcgggcaactggccctcggaaaccccgctcctattcccagacatgcccctatcccccgctacagcacgtatctgatgcttctgctcattgtgtcctacgccagcgcttgttctgagctgatccaggcgtccagccggattacaacctgctctaccgaaggcgttaatacaaagtgtagactgtccgggaccgcccttatccgcgctggcagcgtgggagccgaggcctgcctcatgctgaaaggcgtcaaggaagaccagacaaaatttctgaagatcaaaacggtgtctagcgagctctcctgtcgggaggggcagagctattggaccggatctttctccccgaagtgcctgagctccagacgctgccaccttgttggcgaatgtcatgtgaaccggtgcctgtcttggagagataatgagacaagcgctgaattttccttcgtcggggagtctaccacaatgcgcgaaaacaagtgttttgagcaatgcggaggctgggggtgtggctgcttcaatgtgaaccctagctgtctctttgtgcacacctacctgcagtccgtccggaaagaggccctgagagttttcaattgcattgactgggtgcacaaacttacgctcgaaatcaccgattttgacggatctgtgagcacaattgatctgggcgcgtccagctctcggttcaccaactgggggtccgtcagcctgtctctcgacgctgagggaatctccggcagcaattctttttccttcattgaaagccccgggaaaggatatgccatcgtggatgagcccttctccgaaatccctcgccagggctttctgggggagattagatgtaacagcgagtctagcgttctttccgcccatgaatcttgcctgcgggctccgaatctcgtgagctacaagcccatgatcgaccagctggagtgtacaaccaacctgattgatcctttcgtcgtgtttgaaagaggctcccttccccaaacgcgcaatgacaaaacattcgccgcgtctaagggaaaccggggcgttcaggcttttagcaaggggtccgtgcaggccgatctcaccctgatgttcgacaactttgaggtcgacttcgtgggagccgctgtttcttgcgatgccgcttttctgaatctcacaggctgctatagctgtaacgccggggcgagagtgtgcctgtccatcaccagcaccggaacaggcacgctttctgcccacaataaagacggctccctgcatattgtcctccctagcgaaaacgggaccaaggatcaatgtcagatcctgcacttcacagtgcccgaggtggaggaagagtttatgtactcttgcgacggagatgaacgccctctgcttgtcaaaggcaccctcatcgctattgaccccttcgatgacagacgggaggccgggggagagtccacagttgtgaatcccaagagcggctcctggaactttttcgattggttctctgggctgatgagctggtttggaggccctctgaaaaccatcctcctgatttgtctttacgtggctctgtccatcggcctcttctttctgctgatttatcttgggcgcacgggactgagcaagatgtggctcgccgccacaaagaaggcttcttga

SEQ ID NO: 14515 - RNA, 3480 nt, synthetic construct
  misc_feature 1..3480: note = derived and/or modified CDS sequence (opt5) from RVFV(MgH824)__DQ380210.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaacaatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggctataattacatcgacggcatgacacaggaggatgctacctgtaagcctgttacatatgccggggcttgctcctctttcgacgtgctgctggaaaaaggaaagtttcccctcttccagagctacgcccatcaccgcaccctgcttgaggcggtccatgatacaattatcgccaaagctgacccgccttcctgtgatctgcagagcgcccacggcaacccctgcatgaaggaaaagctcgtgatgaaaacccactgtcctaatgactatcaatctgctcattacctgaacaatgatgggaagatggcctccgttaaatgtcccccgaagtatgagcttacggaagactgcaacttttgcagacagatgaccggagccagcctgaaaaagggctcttaccctctccaggacctgttctgtcagtccagcgaggatgacgggtctaaactgaagacaaagatgaaaggagtgtgcgaggtcggcgtgcaagctctcaagaaatgcgatggccagctgtccaccgcgcacgaagtggtcccctttgccgttttcaagaatagcaaaaaggtgtaccttgacaagctggatctcaaaacagaggaaaacctgcttcctgactcctttgtgtgtttcgagcggaaggggcagtataaaggaaccatggattctggccagacgaagcgcgaactgaaatcctttgacattagccaatgccccaagatcgggggacatggcagcaagaaatgtacaggggatgctgccttctgctctgcctacgagtgtaccacacagtatgctaatgcctactgctcccacgcgaacggaagcggcgtcgtgcagatccaagtttctggcgtgtggaagaaacccctctgtgtcgggtatgagagagtggttgtgaagcgggaactgagcgctaaacctattcagcgcgtcgagccgtgcaccacctgtatcacaaagtgcgaaccccacggactggtggtcagatccacgggctttaagatttctagcgccgtggcctgtgcttccggggtttgcgtgaccggaagccagtctccttccacagagatcaccctcaaataccccggcattagccagtcttccgggggcgacatcggagtccatatggcccacgatgaccaaagcgtgtcctctaagatcgttgctcattgccctccccaggacccgtgtctggtgcacggctgcattgtctgtgcccatgggcttatcaattatcagtgccacacagcgctgagcgccttcgtggtggttttcgtcttttcctctattgctatcatttgtctcgccatcctgtaccgggtgcttaaatgcctgaagatcgctcctagaaaagtgctcaaccccctgatgtggattaccgccttcatccgctggatttacaagaaaatggtcgcgcgggtggccgataatatcaaccaggttaacagagaaattggatggatggagggcgggcaactggtgctcggaaatcctgctcccatccctcgccacgcccccattccgcggtatagcacgtacctgatgcttctgctcatcgtctcctatgctagcgcctgttctgagctgatccaggcctccagcagaattacaacctgctctaccgaaggcgtggacacaaagtgtcgcctgtccgggaccgctcttatccgggcgggcagcgttggagccgaggcttgcctcatgctgaagggcgtgaaagaagatcagacaaagtttctgaaaattaagacggtctctagcgagctctcctgtagagaggggcagagctactggaccggatctttctcccctaaatgcctgagctcccgccggtgccatcttgtgggcgaatgtcacgttaacagatgcctgtcttggcgcgacaatgagacaagcgccgaattttccttcgtgggggagtctaccacaatgcgggaaaacaagtgttttgagcaatgcggaggctgggggtgtggctgcttcaatgtcaaccccagctgtctctttgtgcatacctatctgcagtccgtgagaaaggaggccctgcgggtcttcaattgcatcgattgggttcacaaacttacgctcgaaattaccgactttgatggatctgtgagcacaatcgacctgggcgcttccagctctcgcttcaccaactgggggtccgtgagcctgtctctcgatgccgagggaatctccggcagcaattctttttccttcattgaaagccccgggaagggatacgcgatcgtcgacgagcctttcccggaaattcccagacagggctttctgggggagatccggtgtaactccgagagctctgtgcttagcgctcacgaatcctgcctgagagcccctaatctcatttcttataaacccatgatcgatcagctggagtgtacaaccaacctgatcgaccctttcgttgtgtttgaacgcggcagccttccccaaacgcggaatgataagacattcgccgcttccaaaggaaacagaggcgtccaggccttttctaaggggagcgtgcaggcggacctcaccctgatgttcgacaattttgaggttgatttcgtgggagctgccgtctcctgcgacgccgcttttctgaacctcacaggctgctactcttgtaacgccggggctcgcgtgtgcctgagcattacctccaccggaacaggcagcctttctgcccataataaggatggctccctgcacatcgttctccctagcgaaaacgggacgaaagaccaatgtcagattctgcatttcaccgtgcccgaggtcgaggaagagtttatgtactcttgcgatggagacgaaagaccgctgcttgtgaagggcacactcatcgcgattgatcctttcgacgatcggcgcgaggccgggggagagtccaccgtggtcaatcccaaaagcggctcctggaactttttcgactggttctctgggctgatgagctggtttggaggccctctgaagacaatcctcctgatctgtctttatgttgctctgtccattggcctcttctttctgctgatctaccttgggagaaccggactgagcaaaatgtggctcgccgctacgaagaaggcctcttga

SEQ ID NO: 14516 - RNA, 3480 nt, synthetic construct
  misc_feature 1..3480: note = derived and/or modified CDS sequence (opt5) from RVFV(SA01-1322)__KX096942.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcggccgcagacgggatacgaagcaaattgggcgcgagaccatggccggaatcgccatgacagtgctgcctgctcttgccgtcttcgctctggcccccgtggtttttgcggaagaccctcacctcagaaatcggcccggcaaaggccataactatattgatgggatgacccaggaggacgccacatgtaagcctgtgacctacgctggagcctgctcctctttcgatgtcctgctggagaaaggcaagtttcccctcttccagagctatgctcaccatcgcacactgcttgaagccgtgcacgacaccatcattgcgaaagccgatcccccttcctgtgacctgcagagcgctcacgggaatccctgcatgaaggagaagctcgttatgaaaacgcattgtcctaacgattaccaatctgcccactatctgaataacgacggaaagatggcttccgtgaaatgcccgccgaagtacgaacttaccgaggattgtaatttttgcagacagatgacaggcgccagcctgaaaaaggggtcttatcctctccaggacctgttctgtcagtccagcgaagacgatggatctaaactgaagaccaagatgaaaggcgtctgcgaggtgggcgtgcaagccctcaagaaatgcgacgggcagctgtccacagctcatgaggtcgttccctttgcggtgttcaagaacagcaaaaaggtgtaccttgataagctggacctcaaaaccgaagagaatctgcttcctgattcctttgtctgtttcgaacacaagggacagtacaaaggcacgatggactctgggcagacaaagcgggagctgaaatcctttgatatcagccaatgccccaagattggaggccacgggagcaagaaatgtaccggagacgccgctttctgctctgcctatgaatgtacagcccagtacgctaacgccttttgctcccatgcgaatggcagcggcatcgtgcagatccaagtttctggggtgtggaagaaacccctctgtgtcggatatgagcgcgtggttgtgaagagagagctgagcgctaaacctattcagcgggtcgaaccgtgcaccacctgtatcacaaagtgcgagccccacggcctggtggtccgctccacggggttcaagatttctagcgccgtggcctgtgcttccggagtttgcgtgaccggcagccagtctccttccacagaaatcaccctcaaataccccgggattagccagtcttccggcggagatatcggcgtccatatggcccacgacgatcaaagcgtgtcctctaagatcgttgctcattgccctccccaggacccgtgtctggtgcacgggtgcattgtctgtgcccacggacttatcaactatcagtgccatacagcgctgagcgccttcgtggtggtttttgtcttctcctctattgctatcatttgtctcgccatcctgtacagagtgcttaaatgcctgaagatcgctcctcggaaagtgctcaatcccctgatgtggattaccgcctttatcagatgggtctataagaaaatggtggcgcgcgttgccgacaacattaaccaggtgaatcgggagatcggctggatggaagggggacaactggtcctcggcgatcctgctcccattcctagacacgcccccatcccgcgctacagcacgtacctgatgcttctgctcattatctcctatgctagcgcctgttctgagctgatccaggcctccagccggattacaacctgctctaccgagggggtgaacacaaagtgtagactgtccggcaccgctcttatccgcgcgggaagcgttggcgccgaggcttgcctcatgctgaagggggtgaaagaagaccagacaaagttcctgaaaattaagacggtctctagcgaactctcctgtcgggagggacagagctactggaccggctctttttcccctaaatgcctgagctccagacgctgccatcttgtgggggagtgtcacgttaatcggtgcctgtcttggagagataacgaaacaagcgccgagttctcctttgtgggagaatctaccacaatgcgcgagaataagtgtttcgaacaatgcggcgggtggggctgtggatgctttaacgtcaatcccagctgtctcttcgtgcacacctatctgcagtccgtgcggaaggaggccctgagagtctttaactgcatcgactgggttcataaacttacgctcgagattaccgatttcgacggctctgtgagcacaatcgatctgggggcttccagctctcggtttaccaattggggatccgtgagcctgtctctcgacgccgaaggcatctccgggagcaactctttctccttcattgagagccccggaaagggctacgcgatcgtcgatgaacctttttccgagattccgcgccaggggttcctgggcgaaatcagatgtaatagcgagtctagcgtgctttccgctcacgagtcttgcctgcgggcccccaacctcattagctataaacctatgatcgaccagctggaatgtacaaccaatctgatcgatccctttgttgtgttcgagagaggatcccttcctcaaacgcgcaacgaaaagacatttgccgcttctaaaggcaatagaggggtccaggccttcagcaagggatccgtgcaggcggacctcaccctgatgtttgataacttcgaggttgactttgtgggcgctgccgtctcttgcgacgccgctttcctgaacctcacagggtgctacagctgtaatgccggagctcgggtgtgcctgtccattaccagcaccggcacaggcacgctttctgcccataacaaggatgggtccctgcacatcgttctccccagcgaaaatggaaccaaagaccaatgtcagattctgcattttacagtgcctgaggtcgaggaagagttcatgtattcttgcgatggcgacgaacgccccctgcttgtgaaggggaccctcatcgcgattgatccgtttgacgatagacgggaggccggaggcgagtccacagtggtcaaccctaaaagcgggtcctggaatttcttcgactggttttctggactgatgagctggttcggcggccccctgaagaccatcctcctgatctgtctttacgttgctctgtccattgggctctttttcctgctgatctaccttggacgcacgggcctgagcaaaatgtggctcgccgctacaaagaaggcctcttga

SEQ ID NO: 14517 - RNA, 3480 nt, synthetic construct
  misc_feature 1..3480: note = derived and/or modified CDS sequence (opt5) from RVFV(Kenya 56 (IB8))__DQ380190.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaacaatattacatgtcacggcaaggaccctgaagataaaatcagcctcatcaaggggccgccccataaaaagcaagtcggaattgttagatgcgagcggcgcagagacgccaagcagatcggccgggaaacgatggccgggattgctatgaccgtgctgcctgcccttgctgtgttcgccctggcgcccgtcgtgtttgccgaggatcctcacctccgcaacagacccggaaaaggccataattatatcgacggcatgacacagggggatgctacctgtaagcctgttacatacgccggagcttgctcctctttcgacgtgctgctggagaaaggcaagtttcccctcttccagagctatgcccaccatcggaccctgcttgaagcggtccacgatacaattatcgccaaagctgacccgccttcctgtgatctgcaaagcgcccacgggaacccctgcatgaaggagaagctcgtgatgaaaacccattgtcctaaggactaccagtctgctcactatctgaataacgatggaaaaatggcctccgttaagtgtcccccgaaatacgaacttacggaggactgcaatttttgccgccagatgaccggcgccagcctgaagaaagggtcttatcctctccaggacctgttctgtcaatccagcgaagatgacggatctaagctgaagacaaaaatgaagggcgtgtgcgaggtcggcgtgcaggctctcaaaaagtgcgatgggcagctgtccaccgcgcatgaggtggtcccctttgccgttttcaaaaacagcaagaaggtgtaccttgacaaactggatctcaagacagaagagaatctgcttcctgactcctttgtgtgtttcgaacacaaaggacagtacaagggcaccatggattctgggcaaacgaaaagagagctgaagtcctttgacatttcccagtgccccaagatcggaggccacgggagcaaaaagtgtacaggagatgctgccttctgctctgcctatgaatgtaccgctcagtacgccaacgcgtattgctcccatgctaatggcagcggcatcgtccaaattcaggtgtctggggtttggaaacggcccctctgtgtgggatacgagcgcgtcgtggttaagagagagctgagcgccaaacctatccagcgggtggaaccgtgcacaacctgtattaccaagtgcgagccccacggcctggtcgtgcgctccacagggtttaagatctctagcgccgtcgcttgtgcctccggagtgtgcgttacgggcagccagtctccttccaccgaaattacactcaaatatcccgggatgagccaatcttccggcggagacatcggcgtgcatatggctcacgatgaccagagcgtctcctctaagatcgtggcccattgccctccccaggacccgtgtctggttcacgggtgcattgtgtgtgcgcacggacttatcaactaccagtgccataccgccctgagcgctttcgtcgtggtgttcgtttttagctctgtcgccattatctgtctcgctattctgtataaagtgcttaagtgcctgaaaatcgcccctagaaaggtgctcaatcccctgatgtggatcacagcgttcattcggtgggtctacaaaaagatggtggccagagttgctgataacatcaatcaagtgaaccgcgagattggctggatggaagggggacagcctgccctgggcaaccccgctcctatcccccggcacgccccgattcctagatacagcacctatctcatgctgcttctgatcgtctcctacgccagcgcttgttctgagctcattcaggcgtccagccgcatcacgacatgctctaccgagggggtgaataccaagtgtcggctgtccggcacagccctgatcagagctggaagcgttggcgccgaagcctgccttatgctcaaaggggtgaaggaggaccagaccaaatttctgaagattaaaacagtctctagcgaactgtcctgtcgcgagggacaaagctattggacgggctctttctcccccaagtgcctcagctcccggagatgccatctggtgggggagtgtcacgttaaccgctgcctttcttggcgggataatgaaaccagcgctgagttttccttcgtgggagaatctacaaccatgagagagaacaagtgttttgaacagtgcggcgggtggggctgtggatgcttcaatgtcaaccccagctgtctgtttgtgcacacatacctccagtccgtgcgcaaagaggccctgcgggtcttcaattgcatcgactgggttcataagctgacccttgagattacggattttgacggctctgtgagcaccatcgatctcggggcgtccagctctagattcacaaactggggatccgtgagcctgtctctggacgctgaaggcatttccgggagcaattctttttccttcatcgagagccctggaaaaggctatgccatcgtcgatgaaccgttctccgagattccccggcaggggtttctcggcgaaatccgctgtaacagcgagtctagcgtgctgtccgcccacgagtcttgccttagagctcctaatctgattagctacaagcccatgatcgaccaactcgaatgtaccacaaacctgattgatcctttcgttgcctttgagcggggatccctgccccagaccagaaatgacaaaacgttcgcggcttctaagggcaaccgcggggtgcaggcctttagcaagggatccgtccaagccgatcttacactcatgttcgacaattttgaagtggacttcgttggcgctgccgtgtcttgcgatgctgcctttctgaacctgaccgggtgctatagctgtaacgcgggagcccgggtctgcctctccatcacaagcaccggcaccggcacactgtctgctcataataaagacgggtcccttcacatcgtgctgcctagcgagaacggaacgaaggatcagtgtcagattctccatttcaccgttcccgaagtggaggaggaatttatgtactcttgcgacggcgatgagagaccgctgctggtcaaagggacacttatcgccattgaccctttcgatgaccgcagagaagctggaggcgagtccaccgtggtgaatcccaagagcgggtcctggaactttttcgattggttctctggactcatgagctggtttggcggccctctgaaaacaatcctgctcatttgtctgtacgtcgccctttccatcgggctgttctttctcctgatctatctgggacggaccggccttagcaagatgtggctggccgctacgaagaaagcgtcttga

SEQ ID NO: 14518 - RNA, 3480 nt, synthetic construct
  misc_feature 1..3480: note = derived and/or modified CDS sequence (opt5) from RVFV(KEN/Mal-032/07)__HM586967.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaaaacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggccgcctgcaggaggacgctacatgtaagcctgtgacctacgccggggcttgctcctctttcgatgtcctgctcgaaaaaggaaagtttccgctgttccagagctatgcccaccatagaacacttctggaggcggtgcacgacaccatcattgccaaagctgatcccccttcctgtgacctccagagcgccgatggcaataagtgcatgaaggaaaaactggttatgaagacacactgtcccaacgactaccaatctgctcattatcttaataacgatgggaaaatggcctccgtgaagtgccctcccaaatacgagctgaccgaagactgtaatttttgccggcagatgacgggagccagcctcaagaaaggctcttatccgctgcaggacctgttctgtcagtccagcgaggatgacgggtctaagctcaagaccaaaatgaagggagtctgcgaggtgggcgtgcaagctctgaaaaagtgcgatggccagctttccacagcgcacgaagtcgttccttttgccgtgttcaaaaacagcaagaaggtgtacctggacaaactcgatctgaagaccgaggaaaatcttctgcccgactcctttgtctgtttcgagcataaagggcagtacaagggaacaatggattctggccagaccaaacgcgaactcaagagctttgacatctcccaatgccctaagattgggggacacggcagcaaaaagtgtacgggggatgctgccttctgctctgcctatgagtgtacagctcagtacgccaacgcgtattgctcccacgctaatggaagcggcatcgtgcagatccaagtttctggcgtgtggaaaaagcccctgtgtgtcgggtacgagagagtggttgtgaaacgggaactgagcgccaagcccattcagcgcgtcgagccttgcaccacatgtatcaccaagtgcgaaccgcatggactcgtggtcagatccaccggctttaaaatttctagcgccgtggcttgtgcctccggggtttgcgtgacaggaagccagtctccctccacggagatcaccctgaagtatcctggcattagccagtcttccgggggcgacatcggagtccacatggctcatgatgaccaaagcgtgtcctctaaaatcgttgcccactgcccgcctcaggacccctgtcttgtgcatggctgcattgtctgtgcgcacgggctgatcaactaccagtgccacacagccctcagcgctttcgtggtgattttcgtcttttcctctaccgccatcatttgtctggctgttctttatcgggtgctgaagtgcctcaaaatcgccccgagaaaggtgctgaatcctctgatgtggatcacagcgttcattcgctgggtctacaaaaagatggtggcccgggttgctgataacatcaaccaggtgaatagagaaattggatggatggagggcgggcaactcgccctgggaaaccccgctcctatcccccgccatgcccctattccccggtacagcacctatcttatgctgctcctgatcgtctcctacgccagcgcttgttctgagctgattcaggcgtccagcagaatcacgacatgctctaccgaaggcgtgaataccaagtgtcgcctttccgggacagccctcatccgggctggcagcgttggagccgaggcctgcctgatgctgaaaggcgtgaaggaagaccagaccaaatttctcaagattaaaacagtctctagcgagctgtcctgtagagaggggcagagctattggacgggatctttctccccgaagtgccttagctcccgccggtgccacctggtgggcgaatgtcatgttaacagatgcctctcttggcgcgataatgagaccagcgctgaattttccttcgtgggggagtctacaaccatgcgggaaaacaagtgttttgagcaatgcggaggctgggggtgtggctgcttcaatgtcaaccctagctgtctgtttgtgcacacatacctgcagtccgtgagaaaagaggcccttcgggtcttcaattgcatcgactgggttcacaagctcaccctggaaattacggattttgacggatctgtgagcaccatcgatctgggcgcgtccagctctcgcttcacaaactgggggtccgtgagcctctctctggacgctgagggaatttccggcagcaattctttttccttcatcgaaagccccgggaaaggatatgccatcgtcgatgagcccttctccgaaattcctagacagggctttcttggggagatccggtgtaacagcgagtctagcgtgctgtccgcccatgaatcttgcctcagagctccgaatctggttagctacaagcccatgattgaccagctggagtgtaccacaaaccttatcgatcctttcgtggtctttgaacgcggctccctcccccaaacccggaatgacaaaacgttcgccgcgtctaagggaaacagaggcgtgcaggcttttagcaaggggtccgttcaggccgatctgacactgatgttcgacaactttgaggtggacttcgtcggagccgctgtgtcttgcgatgccgcttttctcaatctgaccggctgctatagctgtaacgccggggcgcgcgtttgcctttccattacaagcaccggaaccggcacactgtctgcccacaataaagacggctccctccatatcgtgctgcctagcgaaaacgggacgaaggatcaatgtcagatcctgcacttcaccgtccccgaggtggaggaagagtttatgtactcttgcgacggagatgaaagacctcttctcgtgaaaggcacactgattgctatcgaccccttcgatgaccggcgcgaggccgggggagagtccaccgtcgttaatcccaagagcggctcctggaactttttcgattggttctctgggctgatgagctggtttggaggccctctcaaaacaattctgcttatctgtctgtacgtggctctctccattggcctgttctttctgcttatctatctggggagaaccggactcagcaagatgtggctggccgccacgaagaaggcttcttga

SEQ ID NO: 14519 - RNA, 3480 nt, synthetic construct
  misc_feature 1..3480: note = derived and/or modified CDS sequence (opt5) from RVFV(KEN/Gar-008/06)__HM586965.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacatcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatctcccaatgccccaagattgggggacacggcagcaagaaatgtacaggggacgctgccttctgctctgcctatgagtgtaccgctcagtacgccaacgcgtattgctcccatgctaatggaagcggcatcgtgcagatccaagtttctcgcgtgtggaagaaacccctctgtgtcggctacgagagagtggttgtgaagcgggaactgagcgccaaacctattcagcgcgtcgagccgtgcacaacctgtatcaccaagtgcgaaccccacgggctggtggtcagatccacaggatttaagatttctagcgccgtggcttgtgcctccggcgtttgcgtgacggggagccagtctccttccaccgagatcacactcaaatatcccggaattagccagtcttccggcggggatatcggcgtccatatggctcacgacgatcaaagcgtgtcctctaagatcgttgcccattgccctccccaggacccgtgtctggtgcacggatgcattgtctgtgcgcacggccttatcaactaccagtgccataccgccctgagcgctttcgtggtgattttcgtttttagctctacagccatcatttgtctcgctgtcctgtatcgggtgcttaaatgcctgaagatcgcccctagaaaagtgctcaatcccctgatgtggatcaccgcgttcattcgctgggtctacaagaaaatggtggcccgggttgctgacaacatcaaccaggtgaatagagaaattgggtggatggagggaggccaactggccctcgggaaccctgctcccatccctcgccacgcccccattccgcggtacagcacgtatctgatgcttctgctcatcgtctcctacgccagcgcttgttctgagctgattcaggcgtccagcagaatcacaacctgctctaccgaaggagtgaatacaaagtgtcgcctgtccggcaccgcccttatccgggctgggagcgttggcgccgaggcctgcctcatgctgaagggagtgaaagaagatcagacaaagtttctgaaaattaagacggtctctagcgagctctcctgtagagagggccagagctattggaccgggtctttctcccctaaatgcctgagctcccgccggtgccatcttgtgggagaatgtcacgttaacagatgcctgtcttggcgcgacaatgagacaagcgctgaattttccttcgtgggcgagtctaccacaatgcgggaaaacaagtgttttgagcaatgcgggggatggggctgtgggtgcttcaatgtcaaccccagctgtctctttgtgcacacctacctgcagtccgtgagaaaggaggccctgcgggtcttcaattgcatcgattgggttcataaacttacgctcgaaattaccgactttgatggctctgtgagcacaatcgacctgggagcgtccagctctcgcttcaccaactggggctccgtgagcctgtctctcgatgctgaggggatttccggaagcaattctttttccttcatcgaaagccccggcaaggggtatgccatcgtcgacgagcctttctccgaaattccgagacagggatttctgggcgagatccggtgtaacagcgagtctagcgtgctttccgcccacgaatcttgcctgagagctcccaatctcgttagctacaaacctatgattgatcagctggagtgtacaaccaacctgatcgaccccttcgtggtctttgaacgcgggtcccttcctcaaacgcggaatgataagacattcgccgcgtctaaaggcaacagaggagtgcaggcttttagcaagggctccgttcaggccgacctcaccctgatgttcgataacctgaaggtggactttgtcggggccgctgtgtcttgcgacgccgctttcctcaatctgacaggatgctatagctgtaacgccggcgcgcgcgtttgcctttccattaccagcaccgggacaggaacgctgtctgcccataataaagatggctccctccacatcgtgctgcccagcgagaacggcaccaaggaccaatgtcagatcctgcattttacagtccctgaagtgaaagaggagttcatgtactcttgcgatggggacgaaagagcccttctcatgaagggaaccctgattgctatcgatccctttgacgatcggcgcgaggctggcggggaatccacagtggtcaatccgaaaagcggatcctggaacttctttgactggttctctggcctgatgagctggttcgggggacctctcaagaccattctgcttatctgtctgtacgttgccctctccattggcctgtttttcctgcttatctatctgggcagaacggggctcagcaagatgtggctggccgctaccaaaaaggcgtcttga

SEQ ID NO: 14520 - RNA, 3480 nt, synthetic construct
  misc_feature 1..3480: note = derived and/or modified CDS sequence (opt5) from RVFV(Beijing-01)__KX611606.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccattatcgcggctgatggactgaacaatattacatgtcacggcaaggaccctgaagataaaatcagcctcatcaaggggccgccccataaaaagagagtcggaattgttcggtgcgagcgcagacgggacgccaagcaaatcggccgcgaaacgatggccgggattgctatgaccgtgctgcctgcccttgctgtgttcgccctggcgcccgtcgtgtttgccgaggatcctcacctcagaaaccggcccggaaaaggccataattatatcgacggcgttacacaggaggatgctacctgtaagcctgtgacatacgccggggcttgctcctctttcgacgtcctgctggaaaaaggaaagtttcccctcttccagagctatgcccaccatcgcaccctgcttgaggcggtgcacgatacaattatcgccaaagctgacccgccttcctgtgatctgcagagcgcccacggcaacccctgcatgaaggaaaagctcgttatgaaaacccattgtcctaatgactaccaatctgctcactatctgaacaatgatgggaagatggcctccgtgaaatgtcccccgaagtacgagcttacggaagactgcaacttttgcagacagatgaccggagccagcctgaaaaagggctcttatcctctccaggacctgttctgtcagtccagcgaggatgacgggtctaaactgaagacaaagatgaaaggagtctgcgaggtgggcgtgcaagctctcaagaaatgcgatggccggctgtccaccgcgcatgaagtcgttccctttgccgtgttcaagaatagcaaaaaggtgtaccttgacaagctggatctcaaaacagaggaaaacctgcttcctgactcctttgtctgtttcgagcacaaggggcagtacaaaggaaccatggattctggccagacgaagcgcgaactgaaatcctttgacatttcccagtgccccaagatcgggggacacggcagcaagaaatgtacaggggatgctgccttctgctctgcctatgagtgtaccgctcaatacgccaatgcgtattgctcccatgctaacggaagcggcatcgtgcagattcaggtttctggcgtgtggaagaaacccctctgtgtcgggtacgagagagtggttgtgaagcgggaactgagcgccaaacctatccaacgcgtcgagccgtgcacaacctgtattaccaagtgcgaaccccacggactggtggtcagatccacaggctttaagatctctagcgccgtggcttgtgcctccggggtttgcgtgacgggaagccagtctccttccaccgagattacactcaaatatcccggcatcagccagtcttccgggggcgacatcggagtccatatggctcacgatgaccagagcgtgtcctctaagattgttttcgactgccctccccaagatccgtgtctggtgcatggctgcatcgtctgtgcccacgggcttattaattaccagtgccacaccgcgctgagcgccttcgtggtggtttttgtcttctcctctgtggctatcatttgtctcgccatcctgtataaagtgcttcggtgcctgaagatcgctcctaaaaaggtcctcaaccccctgatgtggattacagcctttatcagatgggtgtacaaaaagatggttgcgcgcgtggccgacaatattaaccaggtcaaccgggaaatcggatggatggagggcgggcagctggctctcggaaatcctgcccccattcctagacatgctcccatcccgcgctacagcacctatctgatgcttctgctcattatctcctacgccagcgcctgttctgagctgatccaagctagcagccggattacgacatgctctaccgaaggcgtgaacaccaagtgtagactgtccgggacagcgcttatccgcgccggcagcgttggagctgaggcctgcctcatgttcgaaggcgtgaaagaggatcagaccaagtttctgaaaattaagacagtctctagcgagctgtcctgtcgggaagggcagagctattggacgggatctttctcccctaaatgcctcagctccagacgctgccacctggtgggcgagtgtcatgttaatcggtgcctttcttggagagacaacgaaaccagcgccgagttttccttcgtgggggaatctacaaccatgcgcgagaataagtgttttgagcagtgcggaggctgggggtgtggctgcttcaacgtcaatcccagctgtctgtttgtgcacacatacctccaatccgtgcggaaggaagctctgagagtcttcaactgcatcgattgggttcacaaactgacccttgagattacggactttgatggatctgtgagcaccatcgacctcggcgcctccagctctcggttcacaaattgggggtccgtgagcctgtctctggatgcggaaggaatctccggcagcaactctttctcctttattgagagccccgggaagggatatgctatcgtcgacgaacctttctccgagattccgcgccagggctttctcggggagatcagatgtaatagcgaatctagcgtgctgtccgcccatgagtcttgccttcgggcccccaacctgattagctacaaacctatgatcgatcagctcgaatgtaccacaaatctgatcgaccccttcgttgtgtttgagagaggctccctgcctcagacccgcaacgataagacgttcgctgcctctaaaggaaatcggggcgtccaagcgtttagcaaggggtccgtgcaggctgaccttacactcatgttcgacaactttgaagttgatttcgtgggagccgccgtctcttgcgacgctgcctttctgaacctgaccggctgctatagctgtaatgctggggccagagtgtgcctctccattacaagcaccggaaccggcacactgtctgcgcacaacaaggatggctcccttcatatcgttctgcccagcgagaatgggacgaaagaccagtgtcaaattctccacttcaccgtgcctgaggtcgaagaggaatttatgtactcttgcgatggagacgagcgccccctgctggtgaagggcacacttatcgccattgatccgttcgacgatagacgggaggctgggggagaatccaccgtggtcaaccctaaaagcggctcctggaatttctttgactggttctctgggctcatgagctggtttggaggccccctgaagacaatcctgctcatctgtctgtacgttgccctttccattggcctgttctttctcctgatctatctggggcgcaccggacttagcaaaatgtggctggctgccacgaagaaggcctcttga

SEQ ID NO: 14521 - RNA, 3480 nt, synthetic construct
  misc_feature 1..3480: note = derived and/or modified CDS sequence (opt5) from RVFV(KEN/Bar-035/07)__HM586969.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaaaacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggccgcctgcaggaggacgctacatgtaagcctgtgacctacgccggggcttgctcctctttcgatgtcctgctcgaaaaaggaaagtttccgctgttccagagctatgcccaccatagaacacttctggaggcggtgcacgacaccatcattgccaaagctgatcccccttcctgtgacctccagagcgccgatggcaataagtgcatgaaggaaaaactggttatgaagacacactgtcccaacgactaccaatctgctcattatcttaataacgatgggaaaatggcctccgtgaagtgccctcccaaatacgagctgaccgaagactgtaatttttgccggcagatgacgggagccagcctcaagaaaggctcttatccgctgcaggacctgttctgtcagtccagcgaggatgacgggtctaagctcaagaccaaaatgaagggagtctgcgaggtgggcgtgcaagctctgaaaaagtgcgatggccagctttccacagcgcacgaagtcgttccttttgccgtgttcaaaaacagcaagaaggtgtacctggacaaactcgatctgaagaccgaggaaaatcttctgcccgactcctttgtctgtttcgagcataaagggcagtacaagggaacaatggattctggccagaccaaacgcgaactcaagagctttgacatctcccaatgccctaagattgggggacacggcagcaaaaagtgtacgggggatgctgccttctgctctgcctatgagtgtacagctcagtacgccaacgcgtattgctcccacgctaatggaagcggcatcgtgcagatccaagtttctggcgtgtggaaaaagcccctgtgtgtcgggtacgagagagtggttgtgaaacgggaactgagcgccaagcccattcagcgcgtcgagccttgcaccacatgtatcaccaagtgcgaaccgcatggactcgtggtcagatccaccggctttaaaatttctagcgccgtggcttgtgcctccggggtttgcgtgacaggaagccagtctccctccacggagatcaccctgaagtatcctggcattagccagtcttccgggggcgacatcggagtccacatggctcatgatgaccaaagcgtgtcctctaaaatcgttgcccactgcccgcctcaggacccctgtcttgtgcatggctgcattgtctgtgcgcacgggctgatcaactaccagtgccacacagccctcagcgctttcgtggtgattttcgtcttttcctctaccgccatcatttgtctggctgttctttatcgggtgctgaagtgcctcaaaatcgccccgagaaaggtgctgaatcctctgatgtggatcacagcgttcattcgctgggtctacaaaaagatggtggcccgggttgctgataacatcaaccaggtgaatagagaaattggatggatggagggcgggcaactcgccctgggaaaccccgctcctatcccccgccatgcccctattccccggtacagcacctatcttatgctgctcctgatcgtctcctacgccagcgcttgttctgagctgattcaggcgtccagcagaatcacgacatgctctaccgaaggcgtgaataccaagtgtcgcctttccgggacagccctcatccgggctagaagcgttggcgccgaggcctgcctgatgctgaaaggagtgaaggaagaccagaccaaatttctcaagattaaaacagtctctagcgagctgtcctgtcgcgagggccagagctattggacggggtctttctccccgaagtgccttagctcccggagatgccacctggtgggagaatgtcatgttaaccgctgcctctcttggcgggataatgagaccagcgctgaattttccttcgtgggcgagtctacaaccatgagagaaaacaagtgttttgagcaatgcgggggatggggctgtgggtgcttcaatgtcaaccctagctgtctgtttgtgcacacatacctgcagtccgtgcggaaagaggcccttcgcgtcttcaattgcatcgactgggttcacaagctcaccctggaaattacggattttgacggctctgtgagcaccatcgatctgggagcgtccagctctagattcacaaactggggctccgtgagcctctctctggacgctgaggggatttccggaagcaattctttttccttcatcgaaagccccggcaaagggtatgccatcgtcgatgagcccttctccgaaattcctcggcagggatttcttggcgagatcagatgtaacagcgagtctagcgtgctgtccgcccatgaatcttgcctccgcgctccgaatctggttagctacaagcccatgattgaccagctggagtgtaccacaaaccttatcgatcctttcgtggtctttgaacgggggtccctcccccaaaccagaaatgacaaaacgttcgccgcgtctaagggcaaccgcggagtgcaggcttttagcaagggctccgttcaggccgatctgacactgatgttcgacaactttgaggtggacttcgtcggggccgctgtgtcttgcgatgccgcttttctcaatctgaccggatgctatagctgtaacgccggcgcgagagtttgcctttccattacaagcaccgggaccggaacactgtctgcccacaataaagacggctccctccatatcgtgctgcctagcgaaaacggcacgaaggatcaatgtcagatcctgcacttcaccgtccccgaggtggaggaagagtttatgtactcttgcgacggggatgaacggcctcttctcgtgaaaggaacactgattgctatcgaccccttcgatgaccgcagagaggccggcggggagtccaccgtcgttaatcccaagagcggatcctggaactttttcgattggttctctggcctgatgagctggtttgggggacctctcaaaacaattctgcttatctgtctgtacgtggctctctccattggcctgttctttctgcttatctatctgggccggaccgggctcagcaagatgtggctggccgccacgaagaaggcttcttga

SEQ ID NO: 14522 - RNA, 3480 nt, synthetic construct
  misc_feature 1..3480: note = derived and/or modified CDS sequence (opt5) from RVFV(KEN/Bar-032/07)__HM586968.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaaaacctcctctcaggagctgtaccgcgctcttaaagccatcattgcggctgatggactgaacaatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggccgcctgcaggaggacgctacatgtaagcctgtgacctacgccggggcttgctcctctttcgatgtcctgctcgaaaaaggaaagtttccgctgttccagagctatgcccaccatagaacacttctggaggcggtgcacgacaccatcattgccaaagctgatcccccttcctgtgacctccagagcgccgatggcaataagtgcatgaaggaaaaactggttatgaagacacactgtcccaacgactaccaatctgctcattatcttaataacgatgggaaaatggcctccgtgaagtgccctcccaaatacgagctgaccgaagactgtaatttttgccggcagatgacgggagccagcctcaagaaaggctcttatccgctgcaggacctgttctgtcagtccagcgaggatgacgggtctaagctcaagaccaaaatgaagggagtctgcgaggtgggcgtgcaagctctgaaaaagtgcgatggccagctttccacagcgcacgaagtcgttccttttgccgtgttcaaaaacagcaagaaggtgtacctggacaaactcgatctgaagaccgaggaaaatcttctgcccgactcctttgtctgtttcgagcataaagggcagtacaagggaacaatggattctggccagaccaaacgcgaactcaagagctttgacatctcccaatgccctaagattgggggacacggcagcaaaaagtgtacgggggatgctgccttctgctctgcctatgagtgtacagctcagtacgccaacgcgtattgctcccacgctaatggaagcggcatcgtgcagatccaagtttctggcgtgtggaaaaagcccctgtgtgtcgggtacgagagagtggttgtgaaacgggaactgagcgccaagcccattcagcgcgtcgagccttgcaccacatgtatcaccaagtgcgaaccgcatggactcgtggtcagatccaccggctttaaaatttctagcgccgtggcttgtgcctccggggtttgcgtgacaggaagccagtctccctccacggagatcaccctgaagtatcctggcattagccagtcttccgtcggggacatcggcgtgcacatggctcatgatgaccaaagcgtttcctctaaaatcgtggcccactgcccgcctcaggacccctgtcttgtccatggatgcattgtgtgtgcgcacggcctgatcaactaccagtgccacacagccctcagcgctttcgtggttattttcgtcttttcctctaccgccatcatttgtctggctgtgctttatcgggtgctgaagtgcctcaaaatcgccccgagaaaggtcctgaatcctctgatgtggatcacagcgttcattcgctgggtgtacaaaaagatggttgcccgggtggctgataacatcaaccaggtcaatagagaaattgggtggatggagggaggccaactcgccctggggaaccccgctcctatcccccgccatgcccctattccccggtacagcacctatcttatgctgctcctgatcgtgtcctacgccagcgcttgttctgagctgattcaggcgtccagcagaatcacgacatgctctaccgaaggagttaataccaagtgtcgcctttcccacacagccctcatccgggctggcagcgtgggggccgaggcctgcctgatgctgaaaggcgtcaaggaagaccagaccaaatttctcaagattaaaacagtgtctagcgagctgtcctgtagagagggacagagctattggacgggctctttctccccgaagtgccttagctcccgccggtgccatctggttggggaatgtcacgtgaacagatgcctctcttggcgcgataatgagaccagcgctgaattttccttcgtcggagagtctacaaccatgcgggaaaacaagtgttttgagcaatgcggcgggtggggatgtggctgcttcaatgtgaaccctagctgtctgtttgtgcacacatacctgcagtccgtcagaaaagaggcccttcgggttttcaattgcatcgactgggtgcataagctcaccctggaaattacggattttgacgggtctgtgagcaccatcgatctgggcgcgtccagctctcgcttcacaaactggggatccgtcagcctctctctggacgctgagggcatttccgggagcaattctttttccttcatcgaaagccccggaaaaggctatgccatcgtggatgagcccttctccgaaattcctagacaggggtttcttggagagatccggtgtaacagcgagtctagcgttctgtccgcccacgaatcttgcctcagagctccgaatctggtgagctacaagcccatgattgaccagctggagtgtaccacaaaccttatcgatcctttcgtcgtgtttgaacgcggctccctcccccaaacccggaatgacaaaacgttcgccgcgtctaaggggaacagaggcgttcaggcttttagcaagggatccgtgcaggccgatctgacactgcgcttcgacaactttgaggtcgacttcgtgggcgccgctgtttcttgcgatgccgcttttctcaatctgaccgggtgctatagctgtaacgccggagcgagagtgtgcctttccattacaagcaccggcaccgggacactgtctgcccataataaagacggatccctccacatcgtcctgcctagcgaaaacggcacgaaggatcaatgtcagatcctgcatttcaccgtgcccgaggtggaggaagagtttatgtactcttgcgacggcgatgaacggcctcttctcgtcaaagggacactgattgctatcgaccccttcgatgaccgcagagaggccggaggcgagtccaccgttgtgaatcccaagagcgggtcctggaactttttcgattggttctctggactgatgagctggtttggcgggcctctcaaaacaattctgcttatctgtctgtacgtggctctctccattggactgttctttctgcttatctatctgggccggaccggcctcagcaagatgtggctggccgccacgaagaaggcttcttga

SEQ ID NO: 14523 - RNA, 3480 nt, synthetic construct
  misc_feature 1..3480: note = derived and/or modified CDS sequence (opt5) from RVFV(TAN/Dod-002/07)__HM586971.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaataatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagcaaaaaggtgtaccttgataagctggacctcaaaacagaggaaaatctgcttcctgattcctttgtctgtttcgagcacaaggggcagtacaaaggaaccatggactctggccagacgaagcgggaactgaaatcctttgatatctcccaatgccccaagattgggggacacggccgcaagaaatgtacaggggacgctgccttctgcagcgcctatgagtgtaccgctcagtacgccaacgcgtattgctctcatgctaatggatccggcatcgtgcagatccaagttagcggcgtgtggaagaaacccctctgtgtcgggtacgagagagtggttgtgaagcgggaactgtctgccaaacctattcagcgcgtcgagccgtgcacaacctgtatcaccaagtgcgaaccccacggactggtggtcagaagcacaggctttaagatttcctctgccgtggcttgtgccagcggggtttgcgtgacgggatcccagagcccttctaccgagatcacactcaaatatcccggcatttcccagagctctgggggcgatatcggagtccatatggctcacgacgatcaatccgtgagctccaagatcgttgcccattgccctccccaggacccgtgtctggtgcacggctgcattgtctgtgcgcaggcctggatcatttctcagtggcacaccgctcttagcgccttcgtggtgatcttcgtttttagctctacagctattatctgcctggccgtcctctaccgggtgctgaaatgtcttaagatcgcgcctagaaaagtgctgaaccccctcatgtggattaccgccttcatccgctgggtctataagaaaatggtggctcgggttgccgacaatattaaccaagtgaacagagaaatcgggtggatggagggaggccagctggctctggggaatcctgcccccattcctcgccatgcccccatcccgcggtacagcacgtacctcatgctgcttctgattgtctcctatgctagcgcgtgctctgagctcatccaggcctccagcagaatcacaacctgttctaccgaaggagtgaacacaaagtgccgcctgtccggcaccgctctgattcgggccgggagcgttggcgccgaggcttgtcttatgctcaagggagtgaaagaagatcagacaaagtttctgaaaatcaagacggtctctagcgagctgtcctgcagagagggccaaagctactggaccgggtctttctcccctaaatgtctcagctcccgccggtgccacctggtgggagaatgccatgttaatagatgtctttcttggcgcgacaacgagacaagcgccgaattttccttcgtgggcgagtctaccacaatgcgggaaaataagtgctttgagcagtgtgggggatggggctgcgggtgtttcaacgtcaatcccagctgcctgtttgtgcacacctatctccagtccgtgagaaaggaggcgctgcgggtcttcaactgtattgattgggttcacaaactgacgcttgaaatcaccgactttgatggctctgtgagcacaattgacctcggagcttccagctctcgcttcaccaattggggctccgtgagcctgtctctggatgccgaggggatctccggaagcaactctttttccttcatcgaaagccccggcaaggggtacgccattgtcgacgagcctttctccgaaatcccgagacagggatttctcggcgagattcggtgcaatagcgagtctagcgtgctgtccgctcatgaatcttgtcttagagcccccaacctggttagctataaacctatgatcgatcaactcgagtgcacaaccaatctgattgaccccttcgtggtctttgaacgcgggtccctgcctcagacgcggaacgataagacattcgcggcttctaaaggcaatagaggagtgcaggcctttagcaagggctccgttcaagccgaccttaccctcatgttcgataactttgaggtggacttcgtcggggctgccgtgtcttgtgacgctgcctttctgaacctgacaggatgctacagctgcaatgcgggcgcccgcgtttgtctctccatcaccagcaccgggacaggaacgctgtctgctcacaacaaggatggctcccttcatatcgtgctgcccagcgaaaatggcaccaaagaccagtgccagattctccacttcacagtccctgaggtggaggaagagtttatgtattcttgtgatggggacgaaagacccctgctggtgaagggaacccttatcgccattgatccgttcgacgatcggcgcgaggctggcggggagtccacagtcgttaaccctaaaagcggatcctggaactttttcgactggttctctggcctcatgagctggtttgggggacccctgaagaccatcctgctcatttgcctgtacgtggccctttccatcggcctgttctttctcctgatctacctgggcagaacggggcttagcaaaatgtggctggccgctacaaagaaggcgtcttga

SEQ ID NO: 14524 - RNA, 3480 nt, synthetic construct
  misc_feature 1..3480: note = derived and/or modified CDS sequence (opt5) from RVFV(Smithburn)__DQ380193.1__NSm-Gn-Gc
  source 1..3480: mol_type = other RNA
atgatcgagggcgcctgggacagcctgagagaagaggaaatgcccgaggaactctcctgctctattagcgggatccgggaggtgaagacctcctctcaggagctgtaccgcgctcttaaagccacaattgcggctgatggactgaacaatatcacgtgtcacggcaaggaccctgaagataaaattagcctcatcaaggggccgccccataaaaagagagtcggagttgtgcggtgcgagcgccaaagagacgccaagcagatcggccgggggaccatggccggaattgctatgacagtgttccctgccctggtcgtgtttgctcttgcccccgttgtgttcgcggaagatcctcaccttcgcaacagacccggcaaaggccataattatatcgacgggatgacccaggaggatgccacatgtaagcctgtcacctacgctggagcctgctcctcttttgacgtgctcctggagaaaggcaagttcccgctgtttcagagctatgctcaccatcggacactcctggaagccgttcacgatattatcattgcgaaagccgatcccccttcctgtaaccttcaaagcgctcacgggaatccctgcatgaaggagaagctggtgatgaaaacctactgtcctaacgactatcagtctgcccattacctcaataacgacggaaagatggcttccgtcaaatgtcccccgaagcacgaactgacggaggattgcaatttctgccgccagatgaccggcgccagccttaaagaagggtcttatcctctgcaggacctcttttgtcaatccagcgaggacgatggatctaagctgaaaacaaagatgaagggcgtgtgcgaggtgggcgtccaggttctgaaaaagtgcgacgggcagctctccaccgcccatgaagtggtgcccttcgctgtctttaaaaacagcaagaaagtgtacctggataagctggacctgaagacagaggaaaatctcctgcctgattccttcgtttgttttgagcacaaaggacagtacaagggcaccatggactctgggcaaatcaaaagagaacttaagagcttcgatatttcccagtgccccaaaatcggaggccacgggagcaagaagtgtacgggagacgcggccttttgctctgcttatgagtgtacagcccagtacgccaacgcttattgctcccatgccaatggcagcggcatcgtgcaaattcaggtctctggggtgtggaaaaagcccctgtgtgttggatacgagcgggtggtcgtgaaacgcgaactcagcgcgaagcctatccagagagtcgagccgtgcaccacatgtattaccaaatgcgaaccccacggcctggtggttcggtccaccgggttcaagatctctagcgctgtggcctgtgcctccggagtctgcgtgacaggcagccagtctccttccacggagattaccctgaagtatcccgggatcagccaatcttccggcggagatatcggcgttcatatggctcacgacgatcagagcgtgtcctctaaaattgtcgcccattgccctccccaggacccgtgtctcgtgcacgggtgcatcgtgtgtgctcacggactgattaactaccagtgccatacagccttcagcgcgtttgttgtcgtgttcgtgttttcctctgtcgtgatcatttgtcttgccatcctgtataaggttctcaaatgcctgaagatcgctcctcgcaaagtgcttaatcccctgatgtggattaccgccttcatcagatgggtctacaagaaaatggtggctcgggttgccgacaacattaaccaagtgaatagagaaatcggctggatggaagggggacagctcgtcctgggcaaccctgcgcccattcctcgccacgcccccatcccgcggtacagcacatatctgatgctcctgcttattgtgtcctacgctagcgcctgttctgagctgatccaggcttccagcagaatcaccacgtgctctacagagggggttaataccaagtgtcgcctctccggcaccgccctgattcgggccggaagcgtgggcgctgaggcgtgcctgatgcttaagggggtcaaagaagatcagacaaagtttctcaaaatcaagaccgtgtctagcgagctgtcctgtagagagggacaaagctattggacaggctctttctcccctaaatgcctgagctcccgccggtgccatctcgtgggggaatgtcacgtcaacagatgcctgtcttggcgcgacaatgagacgagcgccgaattttccttcgttggagagtctaccacaatgcgggaaaacaagtgttttgagcagtgcggcgggtggggctgtggatgcttcaatgtgaaccccagctgtctttttgtgcacacctacctgcagtccgtcagaaaggaggctctccgcgtgttcaattgcattgattgggttcataaactgacactggaaatcaccgactttgatggctctgtgagcacggtcgaccttggggcctccagctctcggttcaccaactggggatccgtgagcctctctctggatgccgagggcatttccgggagcaattctttctcctttatcgaaagccccggaaagggctatgctatcgttgacgagcctttctccgaaattccgagacaggggtttctgggcgagatccggtgtaacagcgagtctagcgtgctctccgcccacgaatcttgcctgcgcgcgcccaatcttattagctacaaacctatgatcgatcaactggagtgtacaaccaacctcattgaccccttcgtcgtgtttgaaagaggatccctgcctcagacacggaatgataagaccttcgctgcctctaaaggcaacagaggggttcaggcctttagcaagggatccgtgcaagctgacctgacgcttatgttcgataactttgaggtcgacttcgtgggcgccgcggtgtcttgcgacgctgcctttctcaatctgacagggtgctatagctgtaacgccggagctcgcgtctgcctgtccatcaccagcacaggcaccggcaccctctctgcccataataaggatgggtccctgcacatcgttcttcccagcgaaaacggaacaaaagaccagtgtcagattctgcatttcacggtgcctgaggtggaggaagagtttatgtactcttgcgatggcgacgaacggcccctcctggtcaaggggaccctgatcgctattgatccgttcgacgatagacgcgaggccggaggcgagtccacagtggttaatcctaaaagcgggtcctggaacttctttgactggttctctggacttatgagctggtttggcggccccctcaagaccatcctgctgatttgtctctacgtggcgctgtccatcgggcttttctttttcctgatctatctcggaagaacaggcctgagcaaaatgtggctggccgctaccaagaaggcctcttga

SEQ ID NO: 14525 - RNA, 3480 nt, synthetic construct
  misc_feature 1..3480: note = derived and/or modified CDS sequence (opt5) from RVFV(KEN/Gar-004/06)__HM586964.1__NSm-Gn-Gc
  source 1..3480: mol_type = other RNA
atgatcgagggcgcctgggacagcctgagagaagaggaaatgcccgaggaactctcctgctctgtgagcgggattcgggaggtcaagacctcctctcaggagctgtaccgcgctcttaaagccatcattgcggctgatggactgaataatatcacatgtcacggcaagaaccctgaagacaaaattagcctcatcaaggggccgccccataaaaagagagttggaatcgtgcggtgcgagcgcagacgggatgccaagcaaattggccgcgaaacgatggccgggatcgctatgaccgtgctgcctgcccttgctgtcttcgccctggcgcccgtggtttttgccgaggaccctcacctcagaaatcggcccggaaaaggccataactatattgatggcatgacacaggaggacgctacctgtaagcctgtgacatacgccggggcttgctcctctttcgatgtcctgctggaaaaaggaaagtttcccctcttccagagctatgcccaccatcgcaccctgcttgaggcggtgcacgacacaatcattgccaaagctgatcccccttcctgtgacctgcagagcgcccacggcaatccctgcatgaaggaaaagctcgttatgaaaacccattgtcctaacgattaccaatctgctcactatctgaataacgacgggaagatggcctccgtgaaatgcccgccgaagtacgagcttacggaagattgtaatttttgcagacagatgaccggagccagcctgaaaaagggctcttatcctctccaggacctgttctgtcagtccagcgaggacgatgggtctaaactgaagacaaagatgaaaggagtctgcgaggtgggcgtgcaagctctcaagaaatgcgacggccagctgtccaccgcgcatgaagtcgttccctttgccgtgttcaagaacagccagaaagtgtaccttgataagctggacctcaagacagaggaaaatctgcttcctgattcctttgtctgtttcgagcacaaagggcagtacaagggaaccatggactctggccaaacgaaacgggaacttaagagctttgatatctcccagtgccccaaaattgggggacacggccgcaagaagagaacaggggacgctgccttctgtagcgcctatgagtgcaccgctcagtacgccaacgcgtattgttctcgggctaatggatccggcatcgtgcaaatccaggttagccgcgtgtggaaaaagcccctctgcgtcggctacgagagagtggttgtgaaacgggaactgtctgccaagcctattcagagagtcgagccgtgtacaacctgcatcaccaaatgtgaaccccatgggctggtggtccgcagcacaggatttaagatttcctctgccgtggcttgcgccagcggcgtttgtgtgacggggtcccagagcccttctaccgagatcacactcaagtatcccggaatttcccaaagctctggcggggatatcggcgtccacatggctcatgacgatcagtccgtgagctccaaaatcgttgcccactgccctccccaggacccgtgcctggtgcatggatgtattgtctgcgcgcacggccttatcaacaatcagtctcacagcgccctgtccgctttcgtggtgattttcgtttttagcagcaccgccatcatttgtctcgctgtcctgtaccgggtgcttaagtgcctgaaaatcgcccctagaaaggtgctcaaccccctgatgtggatcacagcgttcattcgctgggtctataaaaagatggtggcccgggttgctgacaacatcaatcaagtgaacagagaaattgggtggatggagggaggccagctggccctcgggaatcctgctcccatccctcgccatgcccccattccgcggtactccacctacctgatgcttctgctcatcgtcagctatgcctctgcttgttccgagctgattcaggcgagctctagaatcacgacatgctccaccgaaggagtgaacaccaaatgtcgcctgagcggcacagcccttatccgggctgggtctgttggcgccgaggcctgcctcatgctgaagggagtgaaggaagatcagaccaaatttctgaagattaaaacagtcagctccgagctcagctgtagagagggccaatcttactggacggggtccttcagccctaagtgcctgtcctctcgccggtgtcaccttgtgggagaatgccatgttaatagatgcctgagctggcgggacaacgagacctccgctgaattttctttcgtgggcgagagcacaaccatgcgcgaaaataaatgttttgagcagtgcgggggatggggctgtgggtgcttcaacgtcaatccctcctgtctctttgtgcacacatatctgcagtctgtgagaaaggaggccctgcgggtcttcaactgcatcgattgggttcacaagctgaccctcgaaattacggactttgatggcagcgtgtccaccatcgacctgggagcgtcttcttccagattcacaaattggggcagcgtgtctctgtccctcgatgctgaggggattagcggatctaactcctttagcttcatcgaatcccccggcaaagggtacgccatcgtcgacgagcctttcagcgaaattccgcgccagggatttctgggcgagatccggtgtaattctgagagctccgtgctttctgcccatgaaagctgcctgagagctcccaacctcgtttcctataagcctatgattgatcaactggagtgtaccacaaatctgatcgaccccttcgtggtctttgaacgcgggtctcttcctcagaccagaaacgataaaacgttcgccgcgagcaagggcaaccggggagtgcaggctttttccaaaggctctgttcaagccgacctcacactgcgcttcgataattttgaggtggacttcgtcggggccgctgtgagctgcgacgccgcttttctgaacctcaccggatgttactcctgcaatgccggcgcgagagtttgcctgagcattacatctaccgggaccggaacactttccgcccacaacaaggatggcagcctgcatatcgtgctcccctctgaaaatggcacgaaggaccagtgtcagatcctgcacttcaccgtccctgaggtggaggaagagtttatgtattcctgcgatggggacgaacggcccctgcttgtgaaaggaacactcattgctatcgatccgttcgacgatcgcagagaggccggcggggagagcaccgtcgttaaccctaagtccggatcttggaactttttcgactggttcagcggcctgatgtcctggtttgggggacccctgaaaacaattctcctgatctgtctttacgtggctctgagcattggcctcttctttctgctgatctaccttggccggaccgggctgtctaagatgtggctcgccgccacgaaaaaggcttcctga

SEQ ID NO: 14526 - RNA, 3204 nt, synthetic construct
  misc_feature 1..3204: note = derived and/or modified CDS sequence (opt5) from RVFV(ZH-548)__DQ380206.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctcctgtccgcccatggcaacccttgtatgaaagagaagctggttatgaagacacactgcccgaatgattatcagtctgctcactacctcaacaatgacgggaaaatggccagcgtgaagtgtccccctaaatatgaactgaccgaggattgcaacttttgtagacagatgacaggagcgtcccttaagaaaggctcttaccccctgcaggacctcttctgccaaagctccgaggatgacggcagcaagctgaagaccaaaatgaagggggtctgtgaagtgggagttcaggcccttaaaaagtgcgatggccagctgtctacggctcatgaggtggtcccttttgccgtgttcaaaaattccaagaaagtgtatctcgacaagctggacctgaagaccgaagagaacctcctgcccgatagctttgtctgtttcgagcacaaagggcagtacaagggaacaatggactctggccaaaccaaacgggaacttaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcagatccaagtgtctggcgtgtggaaaaagcctctgtgcgtcgggtatgaacgcgtggttgtgaaaagagagctcagcgccaagcccattcagcgggtcgaaccttgtacgacatgcatcaccaaatgtgagccccacggactggtggttcgctccacaggctttaagattagctctgccgtggcttgcgcctccggggtctgtgtgaccggaagccagtctcccagcaccgagatcacacttaagtaccctggcatttcccaatctagcggcggggatatcggagtccatatggcgcacgacgatcagtccgtgagctctaaaattgttgctcattgcccgccccaggacccttgtctggtgcacgattgcatcgtctgcgcccatggcctcatcaattatcagtgtcacacggccctgtccgctttcgtggttgtgttcgtctttagctctattgccatcatttgcctggctatcctctacagagtgctgaagtgtcttaaaattgcgccccggaaggtgctgaaccctctcatgtggatcaccgccttcatccgctggatttataaaaagatggttgccagagtcgctgacaatatcaaccaagtgaatcgggaaattgggtggatggagggaggccagctggtgcttgggaaccccgccccgatccctcgccacgctcccattcctagatactccacatacctgatgctcctgctgatcgtcagctatgcctccgcgtgctctgaactcatccaggccagctcccggattaccacatgttctaccgagggcgtgaacacgaagtgccgcctgagcggaacagctcttatcagagccggctccgttggggctgaagcctgtctgatgctcaaaggagtgaaggaggatcagaccaaatttctgaagattaaaaccgtcagctctgagctgtcctgccgggaaggccaaagctactggacagggtctttctcccccaagtgtcttagctctagacgctgccatctcgtgggagagtgtcacgttaatcggtgcctgagctggagagacaacgaaacctccgccgagtttagcttcgtgggcgaatctacaacgatgcgcgagaataaatgctttgagcagtgtgggggctggggatgcggctgtttcaacgtcaatccttcctgcctgtttgtgcatacctatctccagagcgttcggaaggaagctctgagagtgttcaactgtatcgactgggtccacaaacttacactggagattaccgattttgacgggtccgtgtctacaatcgatctcggagcgagctcctctcgcttcaccaattggggcagcgtgtccctgtctctggacgccgaagggattagcggatccaacagcttttctttcatcgagtcccccggcaaagggtacgctatcgtcgatgagccgttcagcgaaattcctcggcagggctttcttggagagatcagatgcaattctgaatccagcgttctctctgcccacgagtcctgtctgcgcgcccccaacctgattagctataagcccatgatcgaccaactcgaatgcacgaccaatctgattgatcctttcgtggtgtttgagcggggctcccttccgcagacaagaaacgacaaaaccttcgctgccagcaaggggaatcgcggagtccaggcgttttctaaaggcagcgtgcaggctgatctgacactcatgttcgacaactttgaggttgatttcgtgggggccgccgtctcctgtgacgctgcctttctgaatctgaccggatgctactcttgtaacgcgggcgctcgggtgtgccttagcatcacgtccacagggaccggctctctcagcgcccataacaaggatggatccctgcacatcgttctgccctctgaaaatggcacaaaggaccaatgccagattctccatttcaccgtgcctgaggtcgaagaggaatttatgtatagctgtgacggggatgagagacccctgcttgtgaaaggaaccctgatcgccattgaccctttcgatgaccggcgcgaggctggcggggaatccacagttgtgaaccccaagagcggatcttggaactttttcgattggttctccggcctcatgagctggtttggcgggcctctgaaaacgatcctgcttatttgcctctacgtcgccctgtctatcggactgttctttctcctgatctaccttggcagaaccgggctgtccaagatgtggctcgctgccacaaagaaggcgagctga

SEQ ID NO: 14527 - RNA, 3204 nt, synthetic construct
  misc_feature 1..3204: note = derived and/or modified CDS sequence (opt5) from RVFV(2007000094)__EU574055.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgtacagagtgctcaagtgtctgaaaattgcgccccggaaggtgcttaaccctctgatgtggatcaccgccttcatccgctgggtttataaaaagatggtcgccagagtggctgataatattaaccaggtgaatcgggaaatcggatggatggagggcgggcagctcgtcctgggcaaccccgccccgattcctcgccacgctcccatccctagatactccacataccttatgctgctcctgattgtgagctatgcctccgcgtgctctgaactgatccaggccagctcccggatcaccacatgttctaccgagggagttaacacgaagtgccgcctcagcggcacagctctgattagagccgggtccgtgggagctgaagcctgtcttatgctgaaaggcgtcaaggaggaccaaaccaaatttctcaagatcaaaaccgtgagctctgagctgtcctgccgggaagggcagagctactggacaggatctttctcccccaagtgtctgagctctagacgctgccatcttgttggcgagtgtcacgtgaatcggtgcctcagctggagagataacgaaacctccgccgagtttagcttcgtcggggaatctacaacgatgcgcgagaataaatgctttgagcagtgtggcggatggggctgcgggtgtttcaacgtgaatccttcctgcctgtttgttcatacctatctgcagagcgtgcggaaggaagctctcagagtcttcaactgtattgactgggtgcacaagctgacacttgagatcaccgactttgatggatccgtgtctacaattgacctgggcgcgagctcctctcgcttcaccaattgggggagcgtctccctctctctggatgccgaaggaatcagcggctccaacagcttttctttcattgagtcccccgggaaaggctacgctatcgttgacgagccgttcagcgaaatccctcggcaaggatttctgggcgagattagatgcaattctgaatccagcgtgctttctgcccacgagtcctgtctccgcgcccccaacctgatcagctataagcccatgattgatcagctggaatgcacgaccaatctcatcgaccctttcgtggtctttgagcgggggtccctgccgcagacaagaaacgataaaaccttcgctgccagcaagggaaatcgcggcgtgcaggcgttttctaaagggagcgttcaagctgaccttacactgatgttcgataactttgaggtggacttcgtcggagccgccgtgtcctgtgatgctgcctttctcaatctgaccggctgctactcttgtaacgcgggggctcgggtttgcctgagcattacgtccacaggcaccggaacactttctgcccataacaaggacggcagcctccacatcgtgctgccctccgaaaatgggaccaaggatcagtgccagatcctgcatttcaccgtccctgaggtggaagaggaatttatgtattcttgtgacggagacgagagacccctcctggttaaaggcacacttattgccatcgatcctttcgacgatcggcgcgaggctgggggagaaagcacggtggtcaaccccaagtccggcagctggaactttttcgactggttctctggcctgatgtcctggtttgggggacctctcaaaaccattctgctgatctgcctttacgtggccctcagcattggcctgttctttctgctcatctacctggggagaacaggactttctaagatgtggctggctgccaccaaaaaggcgtcctga

SEQ ID NO: 14528 - RNA, 3204 nt, synthetic construct
  misc_feature 1..3204: note = derived and/or modified CDS sequence (opt5) from RVFV(ZH-548M12)__M25276.1__Gn-Gc
  source 1..3204: mol_type = other RNA
atggccggcatcgctatgacagtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctcctgtccgcccatggcaacccttgtatgaaagagaagctggttatgaagacacactgcccgaatgattatcagtctgctcaccatctcaacaatgacgggaaaatggccagcgtgaagtgtccccctaaatacgaactgaccgaggattgcaacttttgtagacagatgacaggagcgtcccttaagaaaggctcttatcccctgcaggacctcttctgccaaagctccgaggatgacggcagcaagctgaagaccaaaatgaagggggtctgtgaagtgggagttcaggcccttaaaaagtgcgatggccagctgtctacggctcacgaggtggtcccttttgccgtgttcaaaaattccaagaaagtgtacctcgacaagctggacctgaagaccgaagagaacctcctgcccgatagctttgtctgtttcgagcataaagggcagtataagggaacaatggactctggccaaaccaaacgggaacttaagtcctttgatatcagccagtgcccgaaaattgggggacacggctctaagaagtgcacaggcgacgctgccttctgttccgcctacgagtgcaccgctcagtacgcgaatgcctattgtagccacgctaacgggtccggaatcgttcagatccaagtgtctggcgtgtggaaaaagcctctgtgcgtcgggtacgaacgcgtggttgtgaaaagagagctcagcgccaagcccattcagcgggtcgaaccttgtacgacatgcatcaccaaatgtgagccccatggactggtggttcgctccacaggctttaagattagctctgccgtggcttgcgcctccggggtctgtgtgaccggaagccagtctcccagcaccgagatcacacttaagtatcctggcatttcccaatctagcggcggggatatcggagtccacatggcgcatgacgatcagtccgtgagctctaaaattgttgctcactgcccgccccaggacccttgtctggtgcatgattgcatcgtctgcgcccacggcctcatcaattaccagtgtcacacggccctgtccgctttcgtggttgtgttcgtctttagctctattgccatcatttgcctggctatcctctatagagtgctgaagtgtcttaaaattgcgccccggaaggtgctgaaccctctcatgtggatcaccgccttcatccgctggatttacaaaaagatggttgccagagtcgctgacaatatcaaccaagtgaatcgggaaattgggtggatggagggaggccagctggtgcttgggaaccccgccccgatccctcgccatgctcccattcctagatattccacatacctgatgctcctgctgatcgtcagctacgcctccgcgtgctctgaactcatccaggccagctcccggattaccacatgttctaccgagggcgtgaacacgaagtgccgcctgagcggaacagctcttatcagagccggctccgttggggctgaagcctgtctgatgctcaaaggagtgaaggaggatcagaccaaatttctgaagctgaaaaccgtcagctctgagctttcctgccgggaaggccaaagctattggacagggtctttctcccccaagtgtctcagctctagacgctgccacctggtgggagagtgtcatgttaatcggtgcctgagctggagagacaacgaaacctccgccgagtttagcttcgtgggcgaatctacaacgatgcgcgagaataaatgctttgagcagtgtgggggctggggatgcggctgtttcaacgtcaatccttcctgcctctttgtgcacacctacctgcagagcgttcggaaggaagctcttagagtgttcaactgtattgactgggtccacaagctgacactcgagatcaccgattttgacgggtccgtgtctacaattgatctgggagcgagctcctctcgcttcaccaattggggcagcgtgtccctgtctcttgacgccgaagggatcagcggatccaacagcttttctttcattgagtcccccggcaaagggtatgctatcgtcgatgagccgttcagcgaaatccctcggcagggctttctcggagagattagatgcaattctgaatccagcgttctgtctgcccatgagtcctgtctgcgcgcccccaacctcatcagctacaagcccatgattgaccaactggaatgcacgaccaatcttatcgatcctttcgtggtgtttgagcggggctccctgccgcagacaagaaacgacaaaaccttcgctgccagcaaggggaatcgcggagtccaggcgttttctaaaggcagcgtgcaggctgatctcacactgatgttcgacaactttgaggttgatttcgtgggggccgccgtctcctgtgacgctgcctttctgaatcttaccggatgctattcttgtaacgcgggcgctcgggtgtgcctcagcattacgtccacagggaccggctctctgagcgcccacaacaaggatggatccctgcatatcgttctcccctctgaaaatggcacaaaggaccaatgccagatcctgcacttcaccgtgcctgaggtcgaagaggaatttatgtacagctgtgacggggatgagagaccccttctggtgaaaggaaccctcattgccatcgaccctttcgatgaccggcgcgaggctggcggggaatccacagttgtgaaccccaagagcggatcttggaactttttcgattggttctccggcctgatgagctggtttggcgggcctctgaaaacgattcttctcatctgcctgtatgtcgccctgtctattggactcttctttctgcttatctacctgggcgggaccggactctccaagatgtggctggctgccaccaaaaaggcgagctga

SEQ ID NO: 14529 - RNA, 3204 nt, synthetic construct
  misc_feature 1..3204: note = derived and/or modified CDS sequence (opt5) from RVFV(Sudan 86-2010)__JQ820489.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgtacagagtgctcaagtgtctgaaaattgcgccccggaaggtgcttaaccctctgatgtggatcaccgccttcatccgctgggtttataaaaagatggtcgccagagtggctgataatattaaccaggtgaatcgggaaatcggatggatggagggcgggcagctcgtcctgggcaaccccgccccgattcctcgccacgctcccatccctagatactccacataccttatgctgctcctgattgtgagctatgcctccgcgtgctctgaactgatccaggccagctcccggatcaccacatgttctaccgagggagttaacacgaagtgccgcctcagcggcacagctctgattagagccgggtccgtgggagctgaagcctgtcttatgctgaaaggcgtcaaggaggaccaaaccaaatttctcaagatcaaaaccgtgagctctgagctgtcctgccgggaagggcagagctactggacaggatctttctcccccaagtgtctgagctctagacgctgccatcttgttggcgagtgtcacgtgaatcggtgcctcagctggagagataacgaaacctccgccgagtttagcttcgtcggggaatctacaacgatgcgcgagaataaatgctttgagcagtgtggcggatggggctgcgggtgtttcaacgtgaatccttcctgcctgtttgttcatacctatctgcagagcgtgcggaaggaagctctcagagtcttcaactgtattgactgggtgcacaagctgacacttgagatcaccgactttgatggatccgtgtctacaattgacctgggcgcgagctcctctcgcttcaccaattgggggagcgtctccctctctctggatgccgaaggaatcagcggctccaacagcttttctttcattgagtcccccgggaaaggctacgctatcgttgacgagccgttcagcgaaatccctcggcaaggatttctgggcgagattagatgcaattctgaatccagcgtgctttctgcccacgagtcctgtctccgcgcccccaacctgatcagctataagcccatgattgatcagctggaatgcacgaccaatctcatcgaccctttcgtgatttttgagcgggggtccctgccgcagacaagaaacgataaaaccttcgctgccagcaagggaaatcgcggcgtccaggcgttttctaaagggagcgtgcaagctgaccttacactgatgttcgataactttgaggttgacttcgtgggagccgccgtctcctgtgatgctgcctttctcaatctgaccggctgctactcttgtaacgcgggggctcgggtgtgcctgagcatcacgtccacaggcaccggaacactttctgcccataacaaggacggcagcctccacatcgttctgccctccgaaaatgggaccaaggatcagtgccagattctgcatttcaccgtgcctgaggtcgaagaggaatttatgtattcttgtgacggagacgagagacccctcctggtgaaaggcacacttatcgccattgatcctttcgacgatcggcgcgaggctgggggagaaagcacggttgtgaaccccaagtccggcagctggaactttttcgactggttctctggcctgatgtcctggtttgggggacctctcaaaaccatcctgctgatttgcctttacgtcgccctcagcatcggcctgttctttctgctcatctacctggggagaacaggactttctaagatgtggctggctgccaccaaaaaggcgtcctga

SEQ ID NO: 14530 - RNA, 3204 nt, synthetic construct
  misc_feature 1..3204: note = derived and/or modified CDS sequence (opt5) from RVFV(ZS-6365)__DQ380205.1__Gn-Gc
  source 1..3204: mol_type = other RNA
atggccggcatcgctatgacagtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgtacagagtgctcaagtgtctgaaaattgcgccccggaaggtgcttaaccctctgatgtggatcaccgccttcatccgctggatttataaaaagatggttgccagagtcgctgataatatcaaccaggtgaatcgggaaattggatggatggagggcgggcagctcgtgctgggcaaccccgccccgatccctcgccacgctcccattcctagatactccacataccttatgctgctcctgatcgtcagctatgcctccgcgtgctctgaactgatccaggccagctcccggattaccacatgttctaccgagggagtgaacacgaagtgccgcctcagcggcacagctctgatcagagccgggtccgttggagctgaagcctgtcttatgctgaaaggcgtgaaggaggaccaaaccaaatttctcaagattaaaaccgtcagctctgagctgtcctgccgggaagggcagagctactggacaggatctttctcccccaagtgtctgagctctagacgctgccatcttgtgggcgagtgtcacgttaatcggtgcctcagctggagagataacgaaacctccgccgagtttagcttcgtgggggaatctacaacgatgcgcgagaataaatgctttgagcagtgtggcggatggggctgcgggtgtttcaacgtcaatccttcctgcctgtttgtgcatacctatctgcagagcgttcggaaggaagctctcagagtgttcaactgtatcgactgggtccacaagctgacacttgagattaccgactttgatggatccgtgtctacaatcgacctgggcgcgagctcctctcgcttcaccaattgggggagcgtgtccctctctctggatgccgaaggaattagcggctccaacagcttttctttcatcgagtcccccgggaaaggctacgctatcgtcgacgagccgttcagcgaaattcctcggcaaggatttctgggcgagatcagatgcaattctgaatccagcgttctttctgcccacgagtcctgtctccgcgcccccaacctgattagctataagcccatgatcgatcagctggaatgcacgaccaatctcattgaccctttcgtggtgtttgagcgggggtccctgccgcagacaagaaacgataaaaccttcgctgccagcaagggaaatcgcggcgtccaggcgttttctaaagggagcgtgcaagctgaccttacactgatgttcgataactttgaggttgacttcgtgggagccgccgtctcctgtgatgctgcctttctcaatctgaccggctgctactcttgtaacgcgggggctcgggtgtgcctgagcatcacgtccacaggcaccggatctcttagcgcccataacaaggacggctccctccacatcgttctgccctctgaaaatgggacaaaggatcagtgccagattctgcatttcaccgtgcctgaggtcgaagaggaatttatgtatagctgtgacggagacgagagacccctcctggtgaaaggcacccttatcgccattgatcctttcgacgatcggcgcgaggctgggggagaatccacagttgtgaaccccaagagcggctcttggaactttttcgactggttctccggcctgatgagctggtttgggggacctctcaaaacgatcctgctgatttgcctttacgtcgccctctctatcggcctgttctttctgctcatctacctggggagaaccggactttccaagatgtggctggctgccaccaaaaaggcgagctga

SEQ ID NO: 14531 - RNA, 3204 nt, synthetic construct
  misc_feature 1..3204: note = derived and/or modified CDS sequence (opt5) from RVFV(1853/78)__DQ380220.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggagttgtgcaaatccaggtgtctggcgtctggaaaaagcctctttgcgtggggtatgaacgcgttgtggtcaaaagagagctgagcgccaagcccatccagcgggtggaaccttgtacgacatgcattaccaaatgtgagccccacggactcgttgtgcgctccacaggctttaagatcagctctgccgtcgcttgcgcctccggggtgtgtgtcaccggaagccaatctcccagcaccgagattacactgaagtaccctggcatctcccagtctagcggcggggatattggagtgcatatggcgcacgacgatcagtccgttagctctaaaatcgtggctcattgcccgccccaggacccttgtcttgtccacggctgcattgtgtgcgcccatgggctgatcaattatcaatgtcacacggccctctccgctttcgttgtggtcttcgtgtttagctctatcgccattatctgcctggctattctgtacagagtgctcaagtgtctgaaaatcgcgccccggaaggttcttaaccctctgatgtggattaccgccttcatccgctgggtctataaaaagatggtggccagagtggctgataatatcaaccaggtcaatcgggaaattggatggatggagggcgggcagctcgtgctgggcaaccccgccccgatccctcgccacgctcccattcctagatactccacataccttatgctgctcctgatcgttagctatgcctccgcgtgctctgaactgattcaggccagctcccggatcaccacatgttctaccgagggagtgaacacgaagtgccgcctcagcggcacagctctgatcagagccgggtccgtcggagctgaagcctgtcttatgctgaaaggcgtgaaggaggaccaaaccaaatttctcaagattaaaaccgttagctctgagctgtcctgccgggaagggcagagctactggacaggatctttctcccccaagtgtctgagctctagacgctgccatcttgtgggcgagtgtcacgtcaatcggtgcctcagctggagagataacgaaacctccgccgagtttagcttcgtgggggaatctacaacgatgcgcgagaataaatgctttgagcagtgtggcggatggggctgcgggtgtttcaacgttaatccttcctgcctgtttgtgcatacctatctgcagagcgtccggaaggaagctctcagagtgttcaactgtatcgactgggtgcacaagctgacacttgagattaccgactttgatggatccgtctctacaatcgacctgggcgcgagctcctctcgcttcaccaattgggggagcgtttccctctctctggatgccgaaggaattagcggctccaacagcttttctttcatcgagtcccccgggaaaggctacgctattgtggacgagccgttcagcgaaatccctcggcaaggatttctgggcgagatcagatgcaattctgaatccagcgtgctttctgcccacgagtcctgtctccgcgcccccaacctgattagctataagcccatgatcgatcagctggaatgcacgaccaatctcattgaccctttcgtcgtgtttgagcgggggtccctgccgcagacaagaaacgataaaaccttcgctgccagcaagggaaatcgcggcgttcaggcgttttctaaagggagcgtgcaagctgaccttacactgatgttcgataactttgaggtcgacttcgtgggagccgccgtttcctgtgatgctgcctttctcaatctgaccggctgctactcttgtaacgcgggggctcgggtgtgcctgagcatcacgtccacaggcaccggaacactttctgcccataacaaggacggcagcctccacattgtcctgccctccgaaaatgggaccaaggatcagtgccagatcctgcatttcaccgtgcctgaggttgaagaggaatttatgtattcttgtgacggagacgagagacccctcctggtgaaaggcacacttatcgccattgatcctttcgacgatcggcgcgaggctgggggagaaagcacggtcgtgaaccccaagtccggcagctggaactttttcgactggttctctggcctgatgtcctggtttgggggacctctcaaaaccatcctgctgatttgcctttacgtggccctcagcatcggcctgttctttctgctcatttacctggggagaacaggactttctaagatgtggctggctgccaccaaaaaggcgtcctga

SEQ ID NO: 14532 - RNA, 3204 nt, synthetic construct
  misc_feature 1..3204: note = derived and/or modified CDS sequence (opt5) from RVFV(T1)__DQ380201.1__Gn-Gc
  source 1..3204: mol_type = other RNA
atggccggcatcgctatgacagtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctgtgctgtacagagtgctcaagtgtctgaaaatcgcgccccggaaggttcttaaccctctgatgtggattaccgccttcatccgctggatctataaaaagatggtcgccagagtggctgataatattaaccaggtgaatcgggaaatcggatggatggagggcgggcagctcgtcctgggcaaccccgccccgattcctcgccacgctcccatccctagatactccacataccttatgctgctcctgattgtgagctatgcctccgcgtgctctgaactgatccaggccagctcccggatcaccacatgttctaccgagggagttaacacgaagtgccgcctcagcggcacagctctgattagagccgggtccgtgggagctgaagcctgtcttatgctgaaaggcgtcaaggaggaccaaaccaaatttctcaagatcaaaaccgtgagctctgagctgtcctgccgggaagggcagagctactggacaggatctttctcccccaagtgtctgagctctagacgctgccatcttgttggcgagtgtcacgtgaatcggtgcctcagctggagagataacgaaacctccgccgagtttagcttcgtcggggaatctacaacgatgcgcgagaataaatgctttgagcagtgtggcggatggggctgcgggtgtttcaacgtgaatccttcctgcctgtttgttcatacctatctgcagagcgtgcggaaggaagctctcagagtcttcaactgtattgactgggtgcacaagctgacacttgagatcaccgactttgatggatccgtgtctacaattgacctgggcgcgagctcctctcgcttcaccaattgggggagcgtctccctctctctggatgccgaaggaatcagcggctccaacagcttttctttcattgagtcccccgggaaaggctacgctatcgttgacgagccgttcagcgaaatccctcggcaaggatttctgggcgagattagatgcaattctgaatccagcgtgctttctgcccacgagtcctgtctccgcgcccccaacctgatcagctataagcccatgattgatcagctggaatgcacgaccaatctcatcgaccctttcgtggtctttgagcgggggtccctgccgcagacaagaaacgataaaaccttcgctgccagcaagggaaatcgcggcgtgcaggcgttttctaaagggagcgttcaagctgaccttacactgatgttcgataactttgaggtggacttcgtcggagccgccgtgtcctgtgatgctgcctttctcaatctgaccggctgctactcttgtaacgcgggggctcgggtttgcctgagcattacgtccacaggcaccggatctcttagcgcccataacaaggacggctccctccacatcgtgctgccctctgaaaatgggacaaaggatcagtgccagatcctgcatttcaccgtccctgaggtggaagaggaatttatgtatagctgtgacggagacgagagacccctcctggttaaaggcacccttattgccatcgatcctttcgacgatcggcgcgaggctgggggagaatccacagtggtcaaccccaagagcggctcttggaactttttcgactggttctccggcctgatgagctggtttgggggacctctcaaaacgattctgctgatctgcctttacgtggccctctctattggcctgttctttctgctcatctacctggggagaaccggactttccaagatgtggctggctgccaccaaaaaggcgagctga

SEQ ID NO: 14533 - RNA, 3204 nt, synthetic construct
  misc_feature 1..3204: note = derived and/or modified CDS sequence (opt5) from RVFV(Kenya 83 (21445))__DQ380198.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgtacagagtgctcaagtgtctgaaaattgcgccccggaaggtgcttaaccctctgatgtggatcaccgccttcatccgctgggtttataaaaagatggtcgccagagtggctgataatattaaccaggtgaatcgggaaatcggatggatggagggcgggcagctcgccctgggcaaccccgctccgattcctcgccacgcccccatccctagatactccacataccttatgctgctcctgattgtcagctatgcgtccgcctgctctgaactgatccaggctagctcccggatcaccacatgttctaccgagggagtgaacacgaagtgccgcctcagcggcacagccctgattagagctgggtccgttggagccgaagcctgtcttatgctgaaaggcgtgaaggaggaccaaaccaaatttctcaagatcaaaaccgtcagctctgagctgtcctgccgggaagggcagagctactggacaggatctttctcccccaagtgtctgagctctagacgctgccatcttgtgggcgagtgtcacgttaatcggtgcctcagctggagagataacgaaacctccgctgagtttagcttcgtgggggaatctacaacgatgcgcgagaataaatgctttgagcagtgtggcggatggggctgcgggtgtttcaacgtcaatccttcctgcctgtttgtgcatacctatctgcagagcgttcggaaggaagcgctcagagtgttcaactgtattgactgggtccacaagctgacacttgagatcaccgactttgatggatccgtgtctacaattgacctgggcgccagctcctctcgcttcaccaattgggggagcgtgtccctctctctggatgctgaaggaatcagcggctccaacagcttttctttcattgagtcccccgggaaaggctacgccatcgtcgacgagccgttcagcgaaatccctcggcaaggatttctgggcgagattagatgcaattctgaatccagcgttctttctgcccacgagtcctgtctccgcgctcccaacctgatcagctataagcccatgattgatcagctggaatgcacgaccaatctcatcgaccctttcgtggtgtttgagcgggggtccctgccgcagacaagaaacgataaaaccttcgccgcgagcaagggaaatcgcggcgtccaggctttttctaaagggagcgtgcaagccgaccttacactgatgttcgataactttgaggttgacttcgtgggagccgctgtctcctgtgatgccgcgtttctcaatctgaccggctgctactcttgtaacgctggggcccgggtgtgcctgagcattacgtccacaggcaccggaacactttctgcccataacaaggacggcagcctccacatcgttctgccctccgaaaatgggaccaaggatcagtgccagatcctgcatttcaccgtgcctgaggtcgaagaggaatttatgtattcttgtgacggagacgagagacccctcctggtgaaaggcacacttattgctatcgatcctttcgacgatcggcgcgaggccgggggagaaagcacggttgtgaaccccaagtccggcagctggaactttttcgactggttctctggcctgatgtcctggtttgggggacctctcaaaaccattctgctgatctgcctttacgtcgctctcagcattggcctgttctttctgctcatctacctggggagaacaggactttctaagatgtggctggccgcgaccaaaaaggcctcctga

SEQ ID NO: 14534 - RNA, 3204 nt, synthetic construct
  misc_feature 1..3204: note = derived and/or modified CDS sequence (opt5) from RVFV(Sudan 85-2010)__JQ820488.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgtacagagtgctcaagtgtctgaaaattgcgccccggaaggtgcttaaccctctgatgtggatcaccgccttcatccgctgggtttataaaaagatggtcgccagagtggctgataatattaaccaggtgaatcgggaaatcggatggatggagggcgggcagctcgtcctgggcaaccccgccccgattcctcgccacgctcccatccctagatactccacataccttatgctgctcctgattgtgagctatgcctccgcgtgctctgaactgatccaggccagctcccggatcaccacatgttctaccgagggagttaacacgaagtgccgcctcagcggcacagctctgattagagccgggtccgtgggagctgaagcctgtcttatgctgaaaggcgtcaaggaggaccaaaccaaatttctcaagatcaaaaccgtgagctctgagctgtcctgccgggaagggcagagctactggacaggatctttctcccccaagtgtctgagctctagacgctgccatcttgttggcgagtgtcacgtgaatcggtgcctcagctggagagataacgaaacctccgccgagtttagcttcgtcggggaatctacaacgatgcgcgagaataaatgctttgagcagtgtggcggatggggctgcgggtgtttcaacgtgaatccttcctgcctgtttgttcatacctatctgcagagcgtgcggaaggaagctctcagagtcttcaactgtattgactgggtgcacaagctgacacttgagatcaccgactttgatggatccgtgtctacaattgacctgggcgcgagctcctctcgcttcaccaattgggggagcgtctccctctctctggatgccgaaggaatcagcggctccaacagcttttctttcattgagtcccccgggaaaggctacgctatcgttgacgagccgttcagcgaaatccctcggcaaggatttctgggcgagattagatgcaattctgaatccagcgtgctttctgcccacgagtcctgtctccgcgcccccaacctgatcagctataagcccatgattgatcagctggaatgcacgaccaatctcatcgaccctttcgtggtctttgagcgggggtccctgccgcagacaagaaacgagaaaaccttcgctgccagcaagggaaatcgcggcgtgcaggcgttttctaaagggagcgttcaagctgatcttacactgatgttcgacaactttgaagtggatttcgtcggagccgccgtgtcctgtgacgctgcctttctcaatctgaccggctgctactcttgtaacgcgggggctcgggtttgcctgagcattacgtccacaggcaccggaacactttctgcccataacaaggatggcagcctccacatcgtgctgccctccgagaatgggaccaaggaccagtgccagatcctgcatttcaccgtccctgaagtggaggaagagtttatgtattcttgtgatggagacgagagacccctcctggttaaaggcacacttattgccatcgaccctttcgatgaccggcgcgaagctgggggagagagcacggtggtcaaccccaagtccggcagctggaactttttcgattggttctctggcctgatgtcctggtttgggggacctctcaaaaccattctgctgatctgcctttacgtggccctcagcattggcctgttctttctgctcatctacctggggagaacaggactttctaagatgtggctggctgccaccaaaaaggcgtcctga

SEQ ID NO: 14535 - RNA, 3204 nt, synthetic construct
  misc_feature 1..3204: note = derived and/or modified CDS sequence (opt5) from RVFV(2007004194)__EU574031.1__Gn-Gc
  source 1..3204: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgagcaacgacgggaaaatggcctccgtgaagtgtccccctaaatatgaactcaccgaggattgcaatttttgtagacagatgacaggagcgtctctgaagaaaggcagctacccccttcaagacctgttctgccagtccagcgaggatgacggctctaagctcaagaccaaaatgaagggggtctgtgaagtgggagttcaggccctgaaaaagtgcgatggccagctttccacggctcatgaggtggtcccttttgccgtgttcaaaaacagcaagaaagtgtatctggacaagctcgacctgaagaccgaagagaatctgctccccgattcttttgtctgtttcgagcacaaagggcaatacaagggaacaatggactccggccagaccaaacgggaacttaagagctttgatatctctcagtgcccgaaaattgggggacatggctccaagaagtgcacaggcgacgctgccttctgtagcgcctacgagtgcaccgctcagtatgcgaacgcctactgttcccacgctaatgggtctggaatcgttcaaatccaggtgagcggcgtgtggaaaaagcctctgtgcgtcgggtatgaacgcgtggttgtgaaaagagagctgtccgccaagcccattcagcgggtcgaaccttgtacgacatgcatcaccaaatgtgagccccacggactcgtggttcgcagcacaggctttaagatttcttccgccgtggcttgcgccagcggggtctgtgtgaccggatctcaaagcccctccaccgagatcacactgaagtaccctggcatttctcagagctccggcggggatatcggagtccatatggcgcacgacgatcagagcgtgtcttccaaaattgttgctcattgcccgccccaggacccttgtcttgtgcacggctgcatcgtctgcgcccatgggctgatcaactatcaatgtcacacggccctcagcgctttcgtggttgtgttcgtcttttcttccattgccatcatttgcctggctatcctgtacagagtgctcaagtgtctgaaaattgcgccccggaaggtgcttaatcctctgatgtggatcaccgccttcatccgctgggtttataaaaagatggtcgccagagtggctgataacattaatcaggtgaaccgggaaatcggatggatggagggcgggcagctcgtcctgggcaatcccgccccgattcctcgccacgctcccatccctagatacagcacataccttatgctgctcctgattgtgtcctatgcctctgcgtgcagcgaactgatccaggcctcctctcggatcaccacatgtagcaccgagggagttaacacgaagtgccgcctctccggcacagctctgattagagccgggagcgtgggagctgaagcctgtcttatgctgaaaggcgtcaaggaggaccaaaccaaatttctcaagatcaaaaccgtgtcttccgagctgagctgccgggaagggcagtcttactggacaggatccttcagccccaagtgtctgtctagcagacgctgccatcttgttggcgagtgtcacgtgaaccggtgcctctcctggagagataatgaaaccagcgccgagttttctttcgtcggggaatccacaacgatgcgcgagaacaaatgctttgagcagtgtggcggatggggctgcgggtgtttcaatgtgaaccctagctgcctgtttgttcatacctatctgcagtccgtgcggaaggaagctctcagagtcttcaattgtattgactgggtgcacaagctgacacttgagatcaccgactttgatggatctgtgagcacaattgacctgggcgcgtcctctagccgcttcaccaactgggggtccgtctctctcagcctggatgccgaaggaatctccggcagcaattctttttccttcattgagagccccgggaaaggctacgctatcgttgacgagccgttctctgaaatccctcggcaaggatttctgggcgagattagatgcaactccgaaagctctgtgctttccgcccacgagagctgtctccgcgcccccaatctgatctcctataagcccatgattgatcagctggaatgcacgaccaacctcatcgaccctttcgtggtctttgagcgggggagcctgccgcagacaagaaatgataaaaccttcgctgcctctaagggaaaccgcggcgtgcaggcgtttagcaaagggtccgttcaagctgaccttacactgatgttcgataattttgaggtggacttcgtcggagccgccgtgtcttgtgatgctgcctttctcaacctgaccggctgctacagctgtaatgcgggggctcgggtttgcctgtccattacgtctacaggcaccggaacacttagcgcccataacaaggacggctccctccacatcgtgctgccctctgaaaacgggaccaaggatcagtgccagatcctgcatttcaccgtccctgaggtggaagaggaatttatgtatagctgtgacggagacgagagacccctcctggttaaaggcacacttattgccatcgatcctttcgacgatcggcgcgaggctgggggagaatccacggtggtcaatcccaagagcggctcttggaactttttcgactggttctccggcctgatgagctggtttgggggacctctcaaaaccattctgctgatctgcctttacgtggccctctctattggcctgttctttctgctcatctacctggggagaacaggactttccaagatgtggctggctgccaccaaaaaggcgagctga

SEQ ID NO: 14536 - RNA, 3204 nt, synthetic construct
  misc_feature 1..3204: note = derived and/or modified CDS sequence (opt5) from RVFV(2250/74)__DQ380209.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgtacagagtgctcaagtgtctgaaaattgcgccccggaaggtgcttaaccctctgatgtggatcaccgccttcatccgctggatttataaaaagatggttgccagagtcgctgataatatcaaccaggtgaatcgggaaattggatggatggagggcgggcagctcgtgctgggcaaccccgccccgatccctcgccacgctcccattcctagatactccacataccttatgctgctcctgatcgtcagctatgcctccgcgtgctctgaactgatccaggccagctcccggattaccacatgttctaccgagggagtgaacacgaagtgccgcctcagcggcacagctctgatcagagccgggtccgttggagctgaagcctgtcttatgctgaaaggcgtgaaggaggaccaaaccaaatttctcaagattaaaaccgtcagctctgagctgtcctgccgggaagggcagagctactggacaggatctttctcccccaagtgtctgagctctagacgctgccatcttgtgggcgagtgtcacgttaatcggtgcctcagctggagagataacgaaacctccgccgagtttagcttcgtgggggaatctacaacgatgcgcgagaataaatgctttgagcagtgtggcggatggggctgcgggtgtttcaacgtcaatccttcctgcctgtttgtgcatacctatctgcagagcgttcggaaggaagctctcagagtgttcaactgtatcgactgggtccacaagctgacacttgagattaccgactttgatggatccgtgtctacaatcgacctgggcgcgagctcctctcgcttcaccaattgggggagcgtgtccctctctctggatgccgaaggaattagcggctccaacagcttttctttcatcgagtcccccgggaaaggctacgctatcgtcgacgagccgttcagcgaaattcctcggcaaggatttctgggcgagatcagatgcaattctgaatccagcgttctttctgcccacgagtcctgtctccgcgcccccaacctgattagctataagcccatgatcgatcagctggaatgcacgaccaatctcattgaccctttcgtggtgtttgagcgggggtccctgccgcagacaagaaacgataaaaccttcgctgccagcaagggaaatcgcggcgtccaggcgttttctaaagggagcgtgcaagctgaccttacactgatgttcgataactttgaggttgacttcgtgggagccgccgtctcctgtgatgctgcctttctcaatctgaccggctgctactcttgtaacgcgggggctaaggtgtgcctgagcatcacgtccacaggcaccggatctcttagcgcccataacaaggacggctccctccacatcgttctgccctctgaaaatgggacaaaagatcagtgccagattctgcatttcaccgtgcctgaggtcgaagaggaatttatgtatagctgtgacggagacgagcggcccctcctggtgaagggcacccttatcgccattgatcctttcgacgatagacgggaggctgggggagaatccacagttgtgaaccccaaaagcggctcttggaactttttcgactggttctccggcctgatgagctggtttgggggacctctcaagacgatcctgctgatttgcctttacgtcgccctctctatcggcctgttctttctgctcatctacctggggcgcaccggactttccaaaatgtggctggctgccacaaagaaggcgagctga

SEQ ID NO: 14537 - RNA, 3204 nt, synthetic construct
  misc_feature 1..3204: note = derived and/or modified CDS sequence (opt5) from RVFV(Sudan 28-2010)__JQ820491.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgtacagagtgctcaagtgtctgaaaattgcgccccggaaggtgcttaaccctctgatgtggatcaccgccttcatccgctgggtttataaaaagatggtcgccagagtggctgataatattaaccaggtgaatcgggaaatcggatggatggagggcgggcagctcgtcctgggcaaccccgccccgattcctcgccacgctcccatccctagatactccacataccttatgctgctcctgattgtgagctatgcctccgcgtgctctgaactgatccaggccagctcccggatcaccacatgttctaccgagggagttaacacgaagtgccgcctcagcggcacagctctgattagagccgggtccgtgggagctgaagcctgtcttatgctgaaaggcgtcaaggaggaccaaaccaaatttctcaagatcaaaaccgtgagctctgagctgtcctgccgggaagggcagagctactggacaggatctttctcccccaagtgtctgagctctagacgctgccatcttgttggcgagtgtcacgtgaatcggtgcctcagctggagagataacgaaacctccgccgagtttagcttcgtcggggaatctacaacgatgcgcgagaataaatgctttgagcagtgtggcggatggggctgcgggtgtttcaacgtgaatccttcctgcctgtttgttcatacctatctgcagagcgtgcggaaggaagctctcagagtcttcaactgtattgactgggtgcacaagctgacacttgagatcaccgactttgatggatccgtgtctacaattgacctgggcgcgagctcctctcgcttcaccaattgggggagcgtctccctctctctggatgccgaaggaatcagcggctccaacagcttttctttcattgagtcccccgggaaaggctacgctatcgttgacgagccgttcagcgaaatccctcggcaaggatttctgggcgagattagatgcaattctgaatccagcgtgctttctgcccacgagtcctgtctccgcgcccccaacctgatcagctataagcccatgattgatcagctggaatgcacgaccaatctcatcgaccctttcgtggtctttgagcgggggtccctgccgcagacaagaaacgataaaaccttcgctgccagcaagggaaatcgcggcgtgcaggcgttttctaaagggagcgttcaagctgaccttacactgatgttcgataactttgaggtggacttcgtcggagccgccgtgtcctgtgatgctgcctttctcaatctgaccggctgctactcttgtaacgcgggggctcgggtttgcctgagcattacgtccacaggcaccggaacactttctgcccataacaaggacggcagcctccacatcgtgctgccctccgaaaatgggaccaaggatcagtgccagatcctgcatttcaccgtccctgaggtggaagaggaatttatgtattcttgtgacggagacgagagacccctcctggttaaaggcacacttattgccatcgatcctttcgacgatcggcgcgaggctgggggagaaagcacggtggtcaaccccaagtccggcagctggaactttttcgactggttctctggcctgatgtcctggtttgggggacctctcaaaaccattctgctgatctgcctttacgtggtgctcagcattggcctgttctttctgctcatctacctggggagaacaggactttctaagatgtggctggccgctaccaaaaaggcctcctga

SEQ ID NO: 14538 - RNA, 3204 nt, synthetic construct
  misc_feature 1..3204: note = derived and/or modified CDS sequence (opt5) from RVFV(2007000324)__JF326195.1__Gn-Gc
  source 1..3204: mol_type = other RNA
atggccggcatcgctatgacagtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttattttcgtgtttagctctaccgccatcatttgcctggctgtcctgtacagagtgctcaagtgtctgaaaatcgcgccccggaaggtgcttaaccctctgatgtggattacagccttcatccgctgggtttataaaaagatggtcgccagagtggctgataatatcaaccaggtgaatcgggaaattggatggatggagggcgggcagctcgccctgggcaaccccgctccgatccctcgccacgcccccattcctagatactccacctaccttatgctgctcctgatcgtcagctatgcgtccgcctgctctgaactgattcaggctagctcccggatcacaacctgttctacggagggagtgaacacaaagtgccgcctcagcggcaccgccctgatcagagctgggtccgttggagccgaagcctgtcttatgctgaaaggcgtgaaggaggaccaaaccaaatttctcaagattaaaacagtcagctctgagctgtcctgccgggaagggcagagctactggaccggatctttctcccccaagtgtctgagctctagacgctgccatcttgtgggcgagtgtcacgttaatcggtgcctcagctggagagataacgaaacatccgctgagtttagcttcgtgggggaatctacgaccatgcgcgagaataaatgctttgagcagtgtggcggatggggctgcgggtgtttcaacgtcaatccttcctgcctgtttgtgcatacatatctgcagagcgttcggaaggaagcgctcagagtgttcaactgtatcgactgggtccacaagctgacccttgagattacagactttgatggatccgtgtctaccatcgacctgggcgccagctcctctcgcttcacgaattgggggagcgtgtccctctctctggatgctgaaggaattagcggctccaacagcttttctttcatcgagtcccccgggaaaggctacgccattgtcgacgagccgttcagcgaaatccctcggcaaggatttctgggcgagatcagatgcaattctgaatccagcgttctttctgcccacgagtcctgtctccgcgctcccaacctggtgagctataagcccatgattgatcagctggaatgcaccacaaatctcatcgaccctttcgtggtctttgagcgggggtccctgccgcagaccagaaacgataaaacattcgccgcgagcaagggaaatcgcggcgtgcaggctttttctaaagggagcgttcaagccgaccttaccctgatgttcgataactttgaggtggacttcgtcggagccgctgtgtcctgtgatgccgcgtttctcaatctgacgggctgctactcttgtaacgctggggcccgggtttgcctgagcattacatccaccggcacaggaaccctttctgcccataacaaggacggcagcctccacatcgtgctgccctccgaaaatgggaccaaggatcagtgccagattctgcatttcacagtccctgaggtggaagaggaatttatgtattcttgtgacggagacgagagacccctcctggttaaaggcacgcttatcgctatcgatcctttcgacgatcggcgcgaggccgggggagaaagcaccgtggtcaaccccaagtccggcagctggaactttttcgactggttctctggcctgatgtcctggtttgggggacctctcaaaacaattctgctgatctgcctttacgtggctctcagcattggcctgttctttctgctcatctacctggggagaaccggactttctaagatgtggctggccgcgaccaaaaaggcctcctga

SEQ ID NO: 14539 - RNA, 3204 nt, synthetic construct
  misc_feature 1..3204: note = derived and/or modified CDS sequence (opt5) from RVFV(ZM-657)__DQ380204.1__Gn-Gc
  source 1..3204: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaaagcctactgtagccacgctaatgggtccggaatcgttcaaatccaggtgtctggcgtgtggaagaaacctctttgcgtcgggtatgaacgcgtggttgtgaagagagagctgagcgccaaacccattcagcgggtcgaaccttgtacgacatgcatcaccaagtgtgagccccacggactcgtggttcgctccacaggctttaagattagctctgccgtggcttgcgcctccggggtctgtgtgaccggaagccaatctcccagcaccgagatcacactgaaataccctggcatttcccagtctagcggcggggatatcggagtccatatggcgcacgacgatcagtccgtgagctctaagattgttgctcattgcccgccccaggacccttgtcttgtgcacggctgcatcgtctgcgcccatgggctgatcaactatcaatgtcacacggccctctccgctttcgtggttgtgttcgtctttagctctattgccatcatttgcctggctatcctgtacagagtgctcaaatgtctgaagattgcgccccggaaagtgcttaatcctctgatgtggatcaccgccttcatccgctggatttataagaagatggttgccagagtcgctgataacatcaatcaggtgaaccgggaaattggatggatggagggcgggcagctcgtgctgggcaatcccgccccgatccctcgccacgctcccattcctagatactccacataccttatgctgctcctgatcgtcagctatgcctccgcgtgctctgaactgatccaggccagctcccggattaccacatgttctaccgagggagtgaacacgaaatgccgcctcagcggcacagctctgatcagagccgggtccgttggagctgaagcctgtcttatgctgaagggcgtgaaagaggaccaaaccaagtttctcaaaattaagaccgtcagctctgagctgtcctgccgggaagggcagagctactggacaggatctttctcccccaaatgtctgagctctagacgctgccatcttgtgggcgagtgtcacgttaaccggtgcctcagctggagagataatgaaacctccgccgagtttagcttcgtgggggaatctacaacgatgcgcgagaacaagtgctttgagcagtgtggcggatggggctgcgggtgtttcaatgtcaacccttcctgcctgtttgtgcatacctatctgcagagcgttcggaaggaagctctcagagtgttcaattgtatcgactgggtccacaaactgacacttgagattaccgactttgatggatccgtgtctacaatcgacctgggcgcgagctcctctcgcttcaccaactgggggagcgtgtccctctctctggatgccgaaggaattagcggctccaatagcttttctttcatcgagtcccccgggaagggctacgctatcgtcgacgagccgttcagcgaaattcctcggcaaggatttctgggcgagatcagatgcaactctgaatccagcgttctttctgcccacgagtcctgtctccgcgcccccaatctgattagctataaacccatgatcgatcagctggaatgcacgaccaacctcattgaccctttcgtggtgtttgagcgggggtccctgccgcagacaagaaatgataagaccttcgctgccagcaaaggaaaccgcggcgtccaggcgttttctaaggggagcgtgcaagctgaccttacactgatgttcgataattttgaggttgacttcgtgggagccgccgtctcctgtgatgctgcctttctcaacctgaccggctgctactcttgtaatgcgggggctcgggtgtgcctgagcatcacgtccacaggcaccggatctcttagcgcccataacaaggacggctccctccacatcgttctgccctctgaaaacgggacaaaagatcagtgccagattctgcatttcaccgtgcctgaggtcgaagaggaatttatgtatagctgtgacggagacgagagacccctcctggtgaagggcacccttatcgccattgatcctttcgacgatcggcgcgaggctgggggagaatccacagttgtgaatcccaaaagcggctcttggaactttttcgactggttctccggcctgatgagctggtttgggggacctctcaagacgatcctgctgatttgcctttacgtcgccctctctatcggcctgttctttctgctcatctacctggggagaaccggactttccaaaatgtggctggctgccacaaagaaggcgagctga

SEQ ID NO: 14540 - RNA, 3204 nt, synthetic construct
  misc_feature 1..3204: note = derived and/or modified CDS sequence (opt5) from RVFV(T-46 (228113))__DQ380199.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaaaagactctggccagaccaagcgggaactgaaatcctttgatatcagccagtgcccgaagattgggggacatggctctaagaaatgcacaggcgacgctgccttctgttccgcctacgagtgcaccgctcagtatgcgaatgcctactgtagccacgctaacgggtccggaatcgttcaaatccaggtgtctggcgtgtggaagaaacctctttgcgtcgggtatgaacgcgtggttgtgaagagagagctgagcgccaaacccattcagcgggtcgaaccttgtacgacatgcatcaccaagtgtgagccccacggactcgtggttcgctccacaggctttaagattagctctgccgtggcttgcgcctccggggtctgtgtgaccggaagccaatctcccagcaccgagatcacactgaaataccctggcatttcccagtctagcggcggggatatcggagtccatatggcgcacgacgatcagtccgtgagctctaagattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctgtgctgtacagagtgctcaaatgtctgaagatcgcgccccggaaagttcttaaccctctgatgtggattaccgccttcatccgctggatctataagaagatggtcgccagagtggctgataatattaaccaggtgaatcgggaaatcggatggatggagggcgggcagctcgtcctgggcaaccccgccccgattcctcgccacgctcccatccctagatactccacataccttatgctgctcctgattgtgagctatgcctccgcgtgctctgaactgatccaggccagctcccggatcaccacatgttctaccgagggagttaacacgaaatgccgcctcagcggcacagctctgattagagccgggtccgtgggagctgaagcctgtcttatgctgaagggcgtcaaagaggaccaaaccaagtttctcaaaatcaagaccgtgagctctgagctgtcctgccgggaagggcagagctactggacaggatctttctcccccaaatgtctgagctctagacgctgccatcttgttggcgagtgtcacgtgaatcggtgcctcagctggagagataacgaaacctccgccgagtttagcttcgtcggggaatctacaacgatgcgcgagaataagtgctttgagcagtgtggcggatggggctgcgggtgtttcaacgtgaatccttcctgcctgtttgttcatacctatctgcagagcgtgcggaaggaagctctcagagtcttcaactgtattgactgggtgcacaaactgacacttgagatcaccgactttgatggatccgtgtctacaattgacctgggcgcgagctcctctcgcttcaccaattgggggagcgtctccctctctctggatgccgaaggaatcagcggctccaacagcttttctttcattgagtcccccgggaagggctacgctatcgttgacgagccgttcagcgaaatccctcggcaaggatttctgggcgagattagatgcaattctgaatccagcgtgctttctgcccacgagtcctgtctccgcgcccccaacctgatcagctataaacccatgattgatcagctggaatgcacgaccaatctcatcgaccctttcgtggtctttgagcgggggtccctgccgcagacaagaaacgataagaccttcgctgccagcaaaggaaatcgcggcgtgcaggcgttttctaaggggagcgttcaagctgaccttacactgatgttcgataactttgaggtggacttcgtcggagccgccgtgtcctgtgatgctgcctttctcaatctgaccggctgctactcttgtaacgcgggggctcgggtttgcctgagcattacgtccacaggcaccggatctcttagcgcccataacaaggacggctccctccacatcgtgctgccctctgaaaatgggacaaaagatcagtgccagatcctgcatttcaccgtccctgaggtggaagaggaatttatgtatagctgtgacggagacgagagacccctcctggttaagggcacccttattgccatcgatcctttcgacgatcggcgcgaggctgggggagaatccacagtggtcaaccccaaaagcggctcttggaactttttcgactggttctccggcctgatgagctggtttgggggacctctcaagacgattctgctgatctgcctttacgtggccctctctattggcctgttctttctgctcatctacctggggagaaccggactttccaaaatgtggctggctgccacaaagaaggcgagctga

SEQ ID NO: 14541 - RNA, 3204 nt, synthetic construct
  misc_feature 1..3204: note = derived and/or modified CDS sequence (opt5) from RVFV(MP12)__Z30318.1__Gn-Gc
  source 1..3204: mol_type = other RNA
atggccggcatcgctatgacagtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctcctgtccgcccatggcaacccttgtatgaaagagaagctggttatgaagacacactgcccgaatgattatcagtctgctcaccatctcaacaatgacgggaaaatggccagcgtgaagtgtccccctaaatacgaactgaccgaggattgcaacttttgtagacagatgacaggagcgtcccttaagaaaggctcttatcccctgcaggacctcttctgccaaagctccgaggatgacggcagcaagctgaagaccaaaatgaagggggtctgtgaagtgggagttcaggcccttaaaaagtgcgatggccagctgtctacggctcacgaggtggtcccttttgccgtgttcaaaaattccaagaaagtgtacctcgacaagctggacctgaagaccgaagagaacctcctgcccgatagctttgtctgtttcgagcataaagggcagtataagggaacaatggactctggccaaaccaaacgggaacttaagtcctttgatatcagccagtgcccgaaaattgggggacacggctctaagaagtgcacaggcgacgctgccttctgttccgcctacgagtgcaccgctcagtacgcgaatgcctattgtagccacgctaacgggtccggaatcgttcagatccaagtgtctggcgtgtggaaaaagcctctgtgcgtcgggtacgaacgcgtggttgtgaaaagagagctcagcgccaagcccattcagcgggtcgaaccttgtacgacatgcatcaccaaatgtgagccccatggactggtggttcgctccacaggctttaagattagctctgccgtggcttgcgcctccggggtctgtgtgaccggaagccagtctcccagcaccgagatcacacttaagtatcctggcatttcccaatctagcggcggggatatcggagtccacatggcgcatgacgatcagtccgtgagctctaaaattgttgctcactgcccgccccaggacccttgtctggtgcatgattgcatcgtctgcgcccacggcctcatcaattaccagtgtcacacggccctgtccgctttcgtggttgtgttcgtctttagctctattgccatcatttgcctggctatcctctatagagtgctgaagtgtcttaaaattgcgccccggaaggtgctgaaccctctcatgtggatcaccgccttcatccgctggatttacaaaaagatggttgccagagtcgctcataatatcaaccaagtgaatcgggaaattgggtggatggagggaggccagctggtgcttgggaaccccgccccgatccctcgccacgctcccattcctagatattccacatacctgatgctcctgctgatcgtcagctacgcctccgcgtgctctgaactcatccaggccagctcccggattaccacatgttctaccgagggcgtgaacacgaagtgccgcctgagcggaacagctcttatcagagccggctccgttggggctgaagcctgtctgatgctcaaaggagtgaaggaggaccagaccaaatttctgaagctgaaaaccgtcagctctgagctttcctgccgggaaggccaaagctattggacagggtctttctcccccaagtgtctcagctctagacgctgccatctggtgggagagtgtcacgttaatcggtgcctgagctggagagataacgaaacctccgccgagtttagcttcgtgggcgaatctacaacgatgcgcgagaataaatgctttgagcagtgtgggggctggggatgcggctgtttcaacgtcaatccttcctgcctctttgtgcacacctacctgcagagcgttcggaaggaagctcttagagtgttcaactgtattgactgggtccataagctgacactcgagatcaccgactttgatgggtccgtgtctacaattgacctgggagcgagctcctctcgcttcaccaattggggcagcgtgtccctgtctcttgatgccgaagggatcagcggatccaacagcttttctttcattgagtcccccggcaaagggtatgctatcgtcgacgagccgttcagcgaaatccctcggcagggctttctcggagagattagatgcaattctgaatccagcgttctgtctgcccacgagtcctgtctgcgcgcccccaacctcatcagctacaagcccatgattgatcaactggaatgcacgaccaatcttatcgaccctttcgtggtgtttgagcggggctccctgccgcagacaagaaacgataaaaccttcgctgccagcaaggggaatcgcggagtccaggcgttttctaaaggcagcgtgcaggctgacctcacactgatgttcgataactttgaggttgacttcgtgggggccgccgtctcctgtgatgctgcctttctgaatcttaccggatgctattcttgtaacgcgggcgctcgggtgtgcctcagcattacgtccacagggaccggctctctgagcgcccataacaaggacggatccctgcacatcgttctcccctctgaaaatggcacaaaggatcaatgccagatcctgcatttcaccgtgcctgaggtcgaagaggaatttatgtacagctgtgacggggacgagagaccccttctggtgaaaggaaccctcattgccatcgatcctttcgacgatcggcgcgaggctggcggggaatccacagttgtgaaccccaagagcggatcttggaactttttcgactggttctccggcctgatgagctggtttggcgggcctctgaaaacgattcttctcatctgcctgtatgtcgccctgtctattggactcttctttctgcttatctacctgggcgggaccggactctccaagatgtggctggctgccaccaaaaaggcgagctga

SEQ ID NO: 14542 - RNA, 3204 nt, synthetic construct
  misc_feature 1..3204: note = derived and/or modified CDS sequence (opt5) from RVFV(200803166)__JF311381.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcaagaaaggaaagtttcccctgttccaatcttacgcccaccatcgcacacttctggaggcggtgcacgacaccatcattgccaaagctgatcctcccagctgcgacctccagtccgcccatggcaacccttgtatgaaggaaaagctggttatgaaaacacactgcccgaatgattatcagtctgctcactacctgaacaatgacgggaagatggccagcgtgaaatgtccccctaagtatgagctcaccgaagattgcaacttttgtagacagatgacaggagcgtccctgaaaaagggctcttacccccttcaagacctgttctgccagagctccgaggatgacggcagcaagctcaaaaccaagatgaaaggggtctgtgaggtgggagttcaggccctgaagaaatgcgatggccagctttctacggctcatgaagtggtcccttttgccgtgttcaagaatagcaaaaaggtgtatctggacaagctcgacctgaaaaccgaggaaaacctgctccccgatagctttgtctgtttcgagcacaaggggcaatacaaaggaacaatggactctggccagaccaagcgggagctgaaatcctttgatatcagccagtgcccgaagattgggggacatggctctaagaaatgcacaggcgacgctgccttctgttccgcctacgaatgcaccgctcagtatgcgaatgcctactgtagccacgctaacgggtccggaatcgttcaaatccaggtgtctggcgtgtggaagaaacctctttgcgtcgggtatgagcgcgtggttgtgaagagagaactgagcgccaaacccattcagcgggtcgagccttgtacgacatgcatcaccaagtgtgaaccccacggactcgtggttcgctccacaggctttaagattagctctgccgtggcttgcgcctccggggtctgtgtgaccggaagccaatctcccagcaccgagatcacactgaaataccctggcatttcccagtctagcggcggggatatcggagtccatatggcgcacgacgatcagtccgtgagctctaagattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgtacagagtgctcaaatgtctgaagattgcgccccggaaagtgcttaaccctctgatgtggatcaccgccttcatccgctgggtttataagaagatggtcgccagagtggctgataatattaaccaggtgaatcgggagatcggatggatggaaggcgggcagctcgtcctgggcaaccccgccccgattcctcgccacgctcccatccctagatactccacataccttatgctgctcctgattgtgagctatgccaccgcgtgctccgagctgatccaggcctctagccggatcacaacctgttccacggaaggagttaacacaaaatgccgcctctctggcaccgctctgattagagccgggagcgtgggagctgaggcctgtcttatgctgaagggcgtcaaagaagaccaaaccaagtttctcaaaatcaagacagtgtccagcgagctgtcttgccgggaggggcagtcctactggaccggatccttctctcccaaatgtctgtccagcagacgctgccatcttgttggcgaatgtcacgtgaatcggtgcctctcttggagagataacgagacaagcgccgaattttccttcgtcggggagagcacgaccatgcgcgaaaataagtgctttgagcagtgtggcggatggggctgcgggtgtttcaacgtgaatccttcttgcctgtttgttcatacatatctgcagtccgtgcggaaggaggctctcagagtcttcaactgtattgactgggtgcacaaactgacccttgaaatcacagactttgatggaagcgtgtccaccattgacctgggcgcgtctagctcccgcttcacgaattgggggtctgtcagcctctccctggatgccgagggaatctctggcagcaactcctttagcttcattgaatctcccgggaagggctacgctatcgttgacgagccgttctccgagatccctcggcaaggatttctgggcgaaattagatgcaatagcgagtcttccgtgcttagcgcccacgaatcttgtctccgcgcccccaacctgatctcctataaacccatgattgatcagctggagtgcaccacaaatctcatcgaccctttcgtggtctttgaacgggggagcctgccgcagaccagaaacgataagacattcgctgcctccaaaggaaatcgcggcgtgcaggcgtttagcaaggggtctgttcaagctgaccttaccctgatgttcgataactttgaggtggacttcgtcggagccgccgtgagctgtgatgctgcctttctcaatctgacgggctgctactcctgtaacgcgggggctcgggtttgcctgtctattacaagcaccggcacaggaaccctttccgcccataacaaggacggctctctccacgtggtcctgcccagcgagaatgggaccaaagatcagtgccagatcctgcatttcacagtgcctgaagttgaggaagagtttatgtattcctgtgacggagacgaaagacccctcctggtgaagggcacgcttatcgccattgatcctttcgacgatcggcgcgaggctgggggagagtctaccgtcgtgaaccccaaaagcggctcctggaactttttcgactggttcagcggcctgatgtcttggtttgggggacctctcaagacaatcctgctgatttgcctttacgtggccctctccatcggcctgttctttctgctcatttacctggggagaaccggacttagcaaaatgtggctggctgccacaaagaaggcgtcttga

SEQ ID NO: 14543 - RNA, 3204 nt, synthetic construct
  misc_feature 1..3204: note = derived and/or modified CDS sequence (opt5) from RVFV(200803162)__JF311377.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcgccaaatgtgagccccacggactcgtggttcgctccaccggctttaagattagctctgctgtggcctgcgcgtccggggtctgtgtgacaggaagccaatctcccagcaccgagatcaccctgaagtaccctggcatttcccagtctagcggcggggatatcggagtccatatggctcacgacgatcagtccgtgagctctaaaattgttgcccattgcccgccccaggacccttgtcttgtgcacgattgcatcgtctgcgcccatggcctgatcaattatcaatgtcacacagctctctccgccttcgtggttattttcgtgtttagctctacggctatcatttgcctggccgtcctgtacagagtgctcaagtgtctgaaaatcgcgccccggaaggtgcttaaccctctgatgtggattaccgccttcatccgctgggtttataaaaagatggtcgctagagtggccgacaatatcaaccaggtgaatcgggaaattgggtggatggagggaggccagctcgctctgcgcaaccccgccccgatccctagacacgcgcccattcctcggtactccacataccttatgctgctcctgatcgtcagctatgcctccgcttgctctgaactgattcaggccagctcccgcatcaccacatgttctaccgagggggtgaacacgaagtgcagactcagcggcacagctctgatccgggccggatccgttggcgccgaggcttgtcttatgctgaaaggggtgaaggaagatcaaaccaaatttctcaagattaaaaccgtcagctctgagctgtcctgcagagaaggacagagctactggacaggctctttctcccccaagtgtctgagctctcgccggtgccatcttgtgggggagtgtcacgttaatagatgcctcagctggcgcgacaacgaaacctccgcggagtttagcttcgtgggagaatctacaacgatgcgggagaataaatgctttgagcagtgtggcgggtggggctgcggatgtttcaacgtcaatccttcctgcctgtttgtgcatacctatctgcagagcgttagaaaggaagccctccgcgtgttcaactgtatcgactgggtccacaagctgacacttgagattaccgattttgacggctccgtgtctacaatcgatctgggggctagctcctctcggttcaccaattggggaagcgtgtccctctctctggacgccgaaggcattagcgggtccaacagcttttctttcatcgagtcccccggaaaaggctacgccattgtcgatgagccgttcagcgaaatccctagacaagggtttctgggcgagatccgctgcaattctgaatccagcgttctttctgctcacgagtcctgtctccgggcccccaacctggtgagctataagcccatgattgaccagctggaatgcacgaccaatctcatcgatcctttcgtggtctttgagagaggatccctgccgcagacacgcaacgacaaaaccttcgcggctagcaagggcaatagaggggtgcaggccttttctaaaggaagcgttcaagccgatcttacactgatgttcgacaactttgaggtggatttcgtcggcgctgccgtgtcctgtgacgcggcttttctcaatctgaccgggtgctactcttgtaacgccggagcccgggtttgcctgagcattacgtccacaggcaccgggacactttctgctcataacaaggatggcagcctccacatcgtgctgccctccgaaaatggaaccaaggaccagtgccagattctgcatttcaccgtccctgaggtggaagaggaatttatgtattcttgtgacggcgatgagcggcccctcctggttaaagggacacttatcgccatcgaccctttcgatgaccgcagagaggctggaggcgaaagcacggtggtcaaccccaagtccgggagctggaactttttcgattggttctctggactgatgtcctggtttggcggccctctcaaaaccattctgctgatctgcctttacgtggccctcagcattgggctgttctttctgctcatctacctgggacggacaggcctttctaagatgtggctggcggccaccaaaaaggcttcctga

SEQ ID NO: 14544 - RNA, 3204 nt, synthetic construct
  misc_feature 1..3204: note = derived and/or modified CDS sequence (opt5) from RVFV(Hv-B375)__DQ380218.1__Gn-Gc
  source 1..3204: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaaaacgaactcaccgaggattgcaatttttgtagacagatgacaggagcgtccctgaagaaaggctcttatccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaactccaagaaagtgtacctggacaagctcgacctgaagaccgaagagaatctgctccccgatagctttgtctgtttcgagcacaaagggcaatataagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtacgcgaacgcctattgtagccacgctaatgggtccggaatcgttcaaatccaggtgtctggcgtgtggaaaaagcctctttgcgtcgggtacgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtatcctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaactaccaatgtcacacggccctctccgctttcgtggttgtgttcgtctttagctctattgccatcatttgcctggctatcctgtatagagtgctcaagtgtctgaaaattgcgccccggaaggtgcttaatcctctgatgtggatcaccgccttcatccgctgggtttacaaaaagatggtcgccagagtggctgataacattaatcaggtgaaccgggaaatcggatggatggagggcgggcagctcgtcctgggcaaccccgccccgattcctcgccacgctcccatccctagatattccacataccttatgctgctcctgattgtgagctacgcctccgcgtgctctgaactgatccaggccagctcccggatcaccacatgttctaccgagggagttaatacgaagtgccgcctcagcggcacagctctgattagagccgggtccgtgggagctgaagcctgtcttatgctgaaaggcgtcaaggaggaccaaaccaaatttctcaagatcaaaaccgtgagctctgagctgtcctgccgggaagggcagagctattggacaggatctttctcccccaagtgtctgagctctagacgctgccatcttgttggcgagtgtcacgtgaaccggtgcctcagctggagagataatgaaacctccgccgagtttagcttcgtcggggaatctacaacgatgcgcgagaacaaatgctttgagcagtgtggcggatggggctgcgggtgtttcaatgtgaacccttcctgcctgtttgttcatacctacctgcagagcgtgcggaaggaagctctcagagtcttcaattgtattgactgggtgcacaagctgacacttgagatcaccgactttgatggatccgtgtctacaattgacctgggcgcgagctcctctcgcttcaccaactgggggagcgtctccctctctctggatgccgaaggaatcagcggctccaatagcttttctttcattgagtcccccgggaaaggctatgctatcgttgacgagccgttcagcgaaatccctcggcaaggatttctgggcgagattagatgcaactctgaatccagcgtgctttctgcccacgagtcctgtctccgcgcccccaatctgatcagctacaagcccatgattgatcagctggaatgcacgaccaacctcatcgaccctttcgtggtctttgagcgggggtccctgccgcagacaagaaatgataaaaccttcgctgccagcaagggaaaccgcggcgtgcaggcgttttctaaagggagcgttcaagctgaccttacactgatgttcgataattttgaggtggacttcgtcggagccgccgtgtcctgtgatgctgcctttctcaacctgaccggctgctattcttgtaacgcgggggctcgggtttgcctgagcattacgtccacaggcaccggaacactttctgcccataataaggacggcagcctccacatcgtgctgccctccgaaaacgggaccaaggatcagtgccagatcctgcatttcaccgtccctgaggtggaagaggaatttatgtactcttgtgacggagacgagagacccctcctggttaaaggcacacttattgccatcgatcctttcgacgatcggcgcgaggctgggggagaaagcacggtggtcaatcccaagtccggcagctggaactttttcgactggttctctggcctgatgtcctggtttgggggacctctcaaaaccattctgctgatctgcctttatgtggccctcagcattggcctgttctttctgctcatctacctggggagaacaggactttctaagatgtggctggctgccaccaaaaaggcgtcctga

SEQ ID NO: 14545 - RNA, 3204 nt, synthetic construct
  misc_feature 1..3204: note = derived and/or modified CDS sequence (opt5) from RVFV(1260/78)__DQ380214.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgcacagagtgctcaagtgtctgaaaattgcgccccggaaggtgcttaaccctctgatgtggatcaccgccttcatccgctgggtttacaaaaagatggtcgccagagtggctgataatattaaccaggtgaatcgggaaatcggatggatggagggcgggcagctcgtcctgggcaaccccgccccgattcctcgccatgctcccatccctagatattccacataccttatgctgctcctgattgtgagctacgcctccgcgtgctctgaactgatccaggccagctcccggatcaccacatgttctaccgagggagttaacacgaagtgccgcctcagcggcacagctctgattagagccgggtccgtgggagctgaagcctgtcttatgctgaaaggcgtcaaggacgatcaaaccaaatttctcaagatcaaaaccgtgagctctgagctgtcctgccgggaggggcagagctattggacaggatctttctcccccaagtgtctgagctctagacgctgccaccttgttggcgaatgtcatgtgaatcggtgcctcagctggagagacaacgagacctccgccgaatttagcttcgtcggggagtctacaacgatgcgcgaaaataaatgctttgagcagtgtggcggatggggctgcgggtgtttcaacgtgaatccttcctgcctgtttgttcacacctacctgcagagcgtgcggaaggaggctctcagagtcttcaactgtattgactgggtgcacaagctgacacttgaaatcaccgattttgacggatccgtgtctacaattgatctgggcgcgagctcctctcgcttcaccaattgggggagcgtctccctctctctggacgccgagggaatcagcggctccaacagcttttctttcattgaatcccccgggaaaggctatgctatcgttgatgagccgttcagcgagatccctcggcaaggatttctgggcgaaattagatgcaattctgagtccagcgtgctttctgcccatgaatcctgtctccgcgcccccaacctgatcagctacaagcccatgattgaccagctggagtgcacgaccaatctcatcgatcctttcgtggtctttgaacgggggtccctgccgcagacaagaaacgacaaaaccttcgctgccagcaagggaaatcgcggcgtgcaggcgttttctaaagggagcgttcaagctgatcttacactgatgttcgacaactttgaggtggatttcgtcggagccgccgtgtcctgtgacgctgcctttctcaatctgaccggctgctattcttgtaacgcgggggctcgggtttgcctgagcattacgtccacaggcaccggaacactttctgcccacaacaaggatggcagcctccatatcgtgctgccctccgagaatgggaccaaggaccagtgccagatcctgcacttcaccgtccctgaagtggaggaagagtttatgtactcttgtgacggagatgaaagacccctcctggttaaaggcacacttattgccatcgaccctttcgatgaccggcgcgaggctgggggagagagcacggtggtcaaccccaagtccggcagctggaactttttcgattggttctctggcctgatgtcctggtttgggggacctctcaaaaccattctgctgatctgcctttatgtggccctcagcattggcctgttctttctgctcatctacctggggagaacaggactttctaagatgtggctggctgccaccaaaaaggcgtcctga

SEQ ID NO: 14546 - RNA, 3204 nt, synthetic construct
  misc_feature 1..3204: note = derived and/or modified CDS sequence (opt5) from RVFV(ZH-501-777)__DQ380202.1__Gn-Gc
  source 1..3204: mol_type = other RNA
atggccggcatcgctatgacagtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggacccgggccagaccaaacgggaactgaagtcttttgatatctcccagtgccctaaaattgggggacatggcagcaagaagtgcacaggcgacgctgccttctgttctgcctacgagtgcaccgctcagtatgcgaatgcctactgttcccacgctaacgggagcggaatcgttcaaatccaggtgtccggcgtgtggaaaaagcccctttgcgtcgggtatgaacgcgtggttgtgaaaagagagctgtctgccaagcctattcagcgggtcgaaccctgtacgacatgcatcaccaaatgtgagccccacggactcgtggttcgcagcacaggctttaagatttccagcgccgtggcttgcgcctctggggtctgtgtgaccggatcccaaagcccttctaccgagatcacactgaagtacccgggcattagccagtcctctggcggggatatcggagtccatatggcgcacgacgatcagagcgtgtccagcaaaattgttgctcattgtccccctcaggacccctgccttgtgcacggctgcatcgtctgcgcccatgggctgatcaattatcaatgtcacacggccctctctgctttcgtggttgtgttcgtcttttccagcattgccatcatttgcctggctgtgctgtacagagtgctcaagtgtctgaaaatcgcccctcggaaggttcttaaccccctgatgtggattaccgcgttcatccgctggatctataaaaagatggtcgccagagtggctgataatattaaccaggtgaatcgggaaatcggatggatggagggcgggcagctcgtcctgggcaacccggcccctattccccgccacgctcctatccccagatactctacataccttatgctgctcctgattgtgtcctatgccagcgcgtgctccgaactgatccaggcctctagccggatcaccacatgttccaccgagggagttaacacgaagtgccgcctctctggcacagctctgattagagccgggagcgtgggagctgaagcctgtcttatgctgaaaggcgtcaaggaggaccaaaccaaatttctcaagatcaaaaccgtgtccagcgagctgtcttgccgggaagggcagtcctactggacaggcagcttctctcctaagtgtctgtccagcagacgctgccatcttgttggagagtgtcacgtgaatcggtgcctctcttggagagataacgaaaccagcgccgagttttccttcgtcggggaaagcacaacgatgcgcgagaataaatgctttgagcagtgtggcggatggggctgcgggtgtttcaacgtgaatccctcttgcctgtttgttcatacctatctgcagtccgtgcggaaggaagctctcagagtcttcaactgtattgactgggtgcacaagctgacacttgagatcaccgactttgatggaagcgtgtccacaattgacctgggcgcgtctagctcccgcttcaccaattgggggtctgtcagcctctccctggatgccgaaggaatctctggcagcaactcctttagcttcattgagtctccggggaaaggctacgctatcgttgacgagcctttctccgaaatcccccggcaaggatttctgggcgagattagatgcaatagcgaatcttccgtgcttagcgcccacgagtcttgtctccgcgcccccaacctgatctcctataagcctatgattgatcagctggaatgcacgaccaatctcatcgacccgttcgtggtctttgagcgggggagcctgccccagacaagaaacgataaaaccttcgctgcctccaagggaaatcgcggcgtgcaggcgtttagcaaagggtctgttcaagctgaccttacactgatgttcgataactttgaggtggacttcgtcggagccgccgtgagctgtgatgctgcctttctcaatctgaccggctgctactcctgtaacgcgggggctcgggtttgcctgtctattacgagcacaggcaccggatccctttctgcccataacaaggacggcagcctccacatcgtgctgccttccgaaaatgggacaaaggatcagtgccagatcctgcatttcaccgtccccgaggtggaagaggaatttatgtattcttgtgacggagacgagagacctctcctggttaaaggcacccttattgccatcgatcccttcgacgatcggcgcgaggctgggggagaaagcacagtggtcaaccctaagtccggcagctggaactttttcgactggttctctggcctgatgtcctggtttgggggacccctcaaaacgattctgctgatctgcctttacgtggccctcagcattggcctgttctttctgctcatctacctggggagaaccggactttctaagatgtggctggctgccaccaaaaaggcgtcctga

SEQ ID NO: 14547 - RNA, 3204 nt, synthetic construct
  misc_feature 1..3204: note = derived and/or modified CDS sequence (opt5) from RVFV(OS-3)__DQ380184.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggagttgtgcaaatccaggtgtctggcgtctggaaaaagcctctttgcgtggggtatgaacgcgttgtggtcaaaagagagctgagcgccaagcccatccagcgggtggaaccttgtacgacatgcattaccaaatgtgagccccacggactcgttgtgcgctccacaggctttaagatcagctctgccgtcgcttgcgcctccggggtgtgtgtcaccggaagccaatctcccagcaccgagattacactgaagtaccctggcatctcccagtctagcggcggggatattggagtgcatatggcgcacgacgatcagtccgttagctctaaaatcgtggctcattgcccgccccaggacccttgtcttgtccacggctgcattgtgtgcgcccatgggctgatcaattatcaatgtcacacggccctctccgctttcgttgtggtcttcgtgtttagctctgtggccatcatttgcctggctatcctgtacaaggttctcaaatgtctgaagattgcccccagaaaagtccttaaccctctgatgtggatcaccgcgttcattcggtgggtgtataagaagatggtggcccgcgtcgctgataatatcaaccaggtgaatagagaaatcggatggatggagggcgggcagctcgccctgggcaaccccgctccgattcctcggcacgcccccatccctcgctactccacataccttatgctgctcctgattgttagctatgcgtccgcctgctctgaactgatccaggctagctccagaattaccacatgttctaccgagggagtgaacacgaaatgccggctcagcggcacagccctgatccgcgctgggtccgtcggagccgaagcctgtcttatgctgaagggcgtgaaagaggaccaaaccaagtttctcaaaatcaagaccgttagctctgagctgtcctgcagagaagggcagagctactggacaggatctttctcccccaaatgtctgagctctcggagatgccatcttgtgggcgagtgtcacgtcaatcgctgcctcagctggcgggataacgaaacctccgctgagtttagcttcgtgggggaatctacaacgatgagagagaataagtgctttgagcagtgtggcggatggggctgcgggtgtttcaacgttaatccttcctgcctgtttgtgcatacctatctgcagagcgtccgcaaggaagcgctccgggtgttcaactgtattgactgggtgcacaaactgacacttgagatcaccgactttgatggatccgtctctacaattgacctgggcgccagctcctctagattcaccaattgggggagcgtttccctctctctggatgctgaaggaatcagcggctccaacagcttttctttcattgagtcccccgggaagggctacgccatcgtggacgagccgttcagcgaaattcctcgccaaggatttctgggcgagatccggtgcaattctgaatccagcgtgctttctgcccacgagtcctgtctcagagctcccaacctgatcagctataaacccatgattgatcagctggaatgcacgaccaatctcatcgaccctttcgtcgtgtttgagcgcgggtccctgccgcagacacggaacgataagaccttcgccgcgagcaaaggaaatagaggcgttcaggctttttctaaggggagcgtgcaagccgaccttacactgatgttcgataactttgaggtcgacttcgtgggagccgctgtttcctgtgatgccgcgtttctcaatctgaccggctgctactcttgtaacgctggggcccgcgtgtgcctgagcattacgtccacaggcaccggaacactttctgcccataacaaggacggcagcctccacatcgtcctgccctccgaaaatgggaccaaagatcagtgccagattctgcatttcaccgtgcctgaggttgaagaggaatttatgtattcttgtgacggagacgagcggcccctcctggtgaagggcacacttatcgctatcgatcctttcgacgatagacgggaggccgggggagaaagcacggtcgtgaaccccaaatccggcagctggaactttttcgactggttctctggcctgatgtcctggtttgggggacctctcaagaccattctgctgatctgcctttacgtggctctcagcattggcctgttctttctgctcatctacctggggcgcacaggactttctaaaatgtggctggccgcgaccaagaaggcctcctga

SEQ ID NO: 14548 - RNA, 3204 nt, synthetic construct
  misc_feature 1..3204: note = derived and/or modified CDS sequence (opt5) from RVFV(SAUDI 200010901)__KU978778.1__Gn-Gc
  source 1..3204: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgccttttgtagccacgctaacgggtccggaatcgttcaaatccaggtgtctggcgtgtggaaaaagcctctttgcgtcgggtacgaacgcgtggttgtgaaaagagagctgagcgccaagcccattcagcgggtcgaaccttgtacgacatgcatcaccaaatgtgagccccacggactcgtggttcgctccacaggcttcaagattagctctgccgtggcttgcgcctccggggtctgtgtgaccggaagccaatctcccagcaccgagatcacactgaagtatcctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattaccaatgtcacacggccctctccgctttcgtggttgtgtttgtcttcagctctattgccatcatttgcctggctatcctgtatagagtgctcaagtgtctgaaaattgcgccccggaaggtgcttaaccctctgatgtggatcaccgcctttatccgctgggtttacaaaaagatggtcgccagagtggctgataatattaaccaggtgaatcgggaaatcggatggatggagggcgggcagctcgtcctgggcaaccccgccccgattcctcgccacgctcccatccctagatattccacataccttatgctgctcctgattatcagctacgcctccgcgtgctctgaactgatccaggccagctcccggattaccacatgttctaccgagggagtgaacacgaagtgccgcctcagcggcacagctctgatcagagccgggtccgttggagctgaagcctgtcttatgctgaaaggcgtgaaggaggaccaaaccaaattcctcaagattaaaaccgtcagctctgagctgtcctgccgggaagggcagagctattggacaggatctttttcccccaagtgtctgagctctagacgctgccatcttgtgggcgagtgtcacgttaatcggtgcctcagctggagagataacgaaacctccgccgagttcagctttgtgggggaatctacaacgatgcgcgagaataaatgcttcgagcagtgtggcggatggggctgcgggtgttttaacgtcaatccttcctgcctgttcgtgcatacctacctgcagagcgttcggaaggaagctctcagagtgtttaactgtatcgactgggtccacaagctgacacttgagattaccgacttcgatggatccgtgtctacaatcgacctgggcgcgagctcctctcgctttaccaattgggggagcgtgtccctctctctggatgccgaaggaattagcggctccaacagcttctctttcatcgagtcccccgggaaaggctatgctatcgtcgacgagccgtttagcgaaattcctcggcaaggattcctgggcgagatcagatgcaattctgaatccagcgttctttctgcccacgagtcctgtctccgcgcccccaacctgattagctacaagcccatgatcgatcagctggaatgcacgaccaatctcattgacccttttgtggtgttcgagcgggggtccctgccgcagacaagaaacgagaaaacctttgctgccagcaagggaaatcgcggcgtccaggcgttctctaaagggagcgtgcaagctgatcttacactgatgtttgacaacttcgaagttgattttgtgggagccgccgtctcctgtgacgctgccttcctcaatctgaccggctgctattcttgtaacgcgggggctcgggtgtgcctgagcatcacgtccacaggcaccggaacactttctgcccataacaaggatggcagcctccacatcgttctgccctccgagaatgggaccaaggaccagtgccagattctgcattttaccgtgcctgaagtcgaggaagagttcatgtactcttgtgatggagacgagagacccctcctggtgaaaggcacacttatcgccattgacccttttgatgaccggcgcgaagctgggggagagagcacggttgtgaaccccaagtccggcagctggaatttcttcgattggttttctggcctgatgtcctggttcgggggacctctcaaaaccatcctgctgatttgcctttatgtcgccctcagcatcggcctgtttttcctgctcatctacctggggagaacaggactttctaagatgtggctggctgccaccaaaaaggcgtcctga

SEQ ID NO: 14549 - RNA, 3204 nt, synthetic construct
  misc_feature 1..3204: note = derived and/or modified CDS sequence (opt5) from RVFV(2007001811)__EU574040.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgtacagagtgctcaagtgtctgaaaattgcgccccggaaggtgcttaaccctctgatgtggatcaccgccttcatccgctgggtttataaaaagatggtcgccagagtggctgataatattaaccaggtgaatcgggaaatcggatggatggagggcgggcagctcgtcctgggcaaccccgccccgattcctcgccacgctcccatccctagatactccacataccttatgctgctcctgattgtgagctatgcctccgcgtgctctgaactgatccaggccagctcccggatcaccacatgttctaccgagggagttaacacgaagtgccgcctcagcggcacagctctgattagagccgggtccgtgggagctgaagcctgtcttatgctgaaaggcgtcaaggaggaccaaaccaaatttctcatgatcaagaccgtgagctctgagctgtcctgccgggaagggcagagctactggacaggatctttctcccccaaatgtctgagctctagacgctgccatcttgttggcgagtgtcacgtgaatcggtgcctcagctggagagataacgaaacctccgccgagtttagcttcgtcggggaatctacaacgatgcgcgagaataagtgctttgagcagtgtggcggatggggctgcgggtgtttcaacgtgaatccttcctgcctgtttgttcatacctatctgcagagcgtgcggaaagaagctctcagagtcttcaactgtattgactgggtgcacaagctgacacttgagatcaccgactttgatggatccgtgtctacaattgacctgggcgcgagctcctctcgcttcaccaattgggggagcgtctccctctctctggatgccgaaggaatcagcggctccaacagcttttctttcattgagtcccccgggaagggctacgctatcgttgacgagccgttcagcgaaatccctcggcaaggatttctgggcgagattagatgcaattctgaatccagcgtgctttctgcccacgagtcctgtctccgcgcccccaacctgatcagctataaacccatgattgatcagctggaatgcacgaccaatctcatcgaccctttcgtggtctttgagcgggggtccctgccgcagacaagaaacgagaagaccttcgctgccagcaaaggaaatcgcggcgtgcaggcgttttctaaggggagcgttcaagctgatcttacactgatgttcgacaactttgaagtggatttcgtcggagccgccgtgtcctgtgacgctgcctttctcaatctgaccggctgctactcttgtaacgcgggggctcgggtttgcctgagcattacgtccacaggcaccggaacactttctgcccataacaaagatggcagcctccacatcgtgctgccctccgagaatgggaccaaggaccagtgccagatcctgcatttcaccgtccctgaagtggaggaagagtttatgtattcttgtgatggagacgagagacccctcctggttaagggcacacttattgccatcgaccctttcgatgaccggcgcgaagctgggggagagagcacggtggtcaaccccaaatccggcagctggaactttttcgattggttctctggcctgatgtcctggtttgggggacctctcaagaccattctgctgatctgcctttacgtggccctcagcattggcctgttctttctgctcatctacctggggagaacaggactttctaaaatgtggctggctgccaccaagaaagcgtcctga

SEQ ID NO: 14550 - RNA, 3204 nt, synthetic construct
  misc_feature 1..3204: note = derived and/or modified CDS sequence (opt5) from RVFV(2007000253)__JF326192.1__Gn-Gc
  source 1..3204: mol_type = other RNA
atggccggcatcgctatgacagtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttattttcgtgtttagctctaccgccatcatttgcctggctgtcctgtacagagtgctcaagtgtctgaaaatcgctccccggaaggtgcttaaccctctgatgtggattacagcgttcatccgctgggtttataaaaagatggtcgccagagtggctgataatatcaaccaggtgaatcgggaaattggatggatggagggcgggcagctcgccctgggcaaccccgctccgatccctcgccacgcccccattcctagatactccacctaccttatgctgctcctgatcgtcagctatgcgtccgcctgctctgaactgattcaggctagctcccggatcacaacctgttctacggagggagtgaacacaaagtgccgcctcagcggcaccgccctgatcagagctgggtccgccggagccgaagcctgtcttatgctgaaaggcgttaaggaggaccaaaccaaatttctcaagattaaaacagtgagctctgagctgtcctgccgggaagggcagagctactggaccggatctttctcccccaagtgtctgagctctagacgctgccatcttgtcggcgagtgtcacgtgaatcggtgcctcagctggagagataacgaaacatccgcggagtttagcttcgttggggaatctacgaccatgcgcgagaataaatgctttgagcagtgtggcggatggggctgcgggtgtttcaacgtgaatccttcctgcctgtttgtccatacatatctgcagagcgtgcggaaggaagccctcagagttttcaactgtatcgactgggtgcacaagctgacccttgagattacagactttgatggatccgtctctaccatcgacctgggcgctagctcctctcgcttcacgaattgggggagcgtgtccctctctctggatgccgaaggaattagcggctccaacagcttttctttcatcgagtcccccgggaaaggctacgccattgtggacgagccgttcagcgaaatccctcggcaaggatttctgggcgagatcagatgcaattctgaatccagcgtcctttctgctcacgagtcctgtctccgcgcccccaacctggttagctataagcccatgattgatcagctggaatgcaccacaaatctcatcgaccctttcgtggtgtttgagcgggggtccctgccgcagaccagaaacgataaaacattcgcggctagcaagggaaatcgcggcgtccaggccttttctaaagggagcgtgcaagccgaccttaccctgatgttcgataactttgaggttgacttcgtgggagctgccgtctcctgtgatgcggcttttctcaatctgacgggctgctactcttgtaacgccggggcccgggtgtgcctgagcattacatccaccggcacaggaaccctttctgctcataacaaggacggcagcctccacatcgttctgccctccgaaaatgggaccaaggatcagtgccagattctgcatttcacagtgcctgaggtcgaagaggaatttatgtattcttgtgacggagacgagagacccctcctggtgaaaggcacgcttatcgccatcgatcctttcgacgatcggcgcgaggctgggggagaaagcaccgttgtgaaccccaagtccggcagctggaactttttcgactggttctctggcctgatgtcctggtttgggggacctctcaaaacaattctgctgatctgcctttacgtcgccctcagcattggcctgttctttctgctcatctacctggggagaaccggactttctaagatgtggctggcggccaccaaaaaggcttcctga

SEQ ID NO: 14551 - RNA, 3204 nt, synthetic construct
  misc_feature 1..3204: note = derived and/or modified CDS sequence (opt5) from RVFV(2007001292)__EU574046.1__Gn-Gc
  source 1..3204: mol_type = other RNA
atggccggcatcgctatgacagtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttattttcgtgtttagctctaccgccatcatttgcctggctgtcctgtacagagtgctcaagtgtctgaaaatcgcgccccggaaggtgcttaaccctctgatgtggattacagccttcatccgctgggtttataaaaagatggtcgccagagtggctgataatatcaaccaggtgaatcgggaaattggatggatggagggcgggcagctcgccctgggcaaccccgctccgatccctcgccacgcccccattcctagatactccacctaccttatgctgctcctgatcgtcagctatgcgtccgcctgctctgaactgattcaggctagctcccggatcacaacctgttctacggagggagtgaacacaaagtgccgcctcagcggcaccgccctgatcagagctgggtccgttggagccgaagcctgtcttatgctgaaaggcgtgaaggaggaccaaaccaaatttctcaagattaaaacagtcagctctgagctgtcctgccgggaagggcagagctactggaccggatctttctcccccaagtgtctgagctctagacgctgccatcttgtgggcgagtgtcacgttaatcggtgcctcagctggagagataacgaaacatccgctgagtttagcttcgtgggggaatctacgaccatgcgcgagaataaatgctttgagcagtgtggcggatggggctgcgggtgtttcaacgtcaatccttcctgcctgtttgtgcatacatatctgcagagcgttcggaaggaagcgctcagagtgttcaactgtatcgactgggtccacaagctgacccttgagattacagactttgatggatccgtgtctaccatcgacctgggcgccagctcctctcgcttcacgaattgggggagcgtgtccctctctctggatgctgaaggaattagcggctccaacagcttttctttcatcgagtcccccgggaaaggctacgccattgtcgacgagccgttcagcgaaatccctcggcaaggatttctgggcgagatcagatgcaattctgaatccagcgttctttctgcccacgagtcctgtctccgcgctcccaacctggtgagctataagcccatgattgatcagctggaatgcaccacaaatctcatcgaccctttcgtggtctttgagcgggggtccctgccgcagaccagaaacgataaaacattcgccgcgagcaagggaaatcgcggcgtgcaggctttttctaaagggagcgttcaagccgaccttaccctgatgttcgataactttgaggtggacttcgtcggagccgctgtgtcctgtgatgccgcgtttctcaatctgacgggctgctactcttgtaacgctggggcccgggtttgcctgagcattacatccaccggcacaggaaccctttctgcccataacaaggacggcagcctccacatcgtgctgccctccgaaaatgggaccaaggatcagtgccagattctgcatttcacagtccctgaggtggaagaggaatttatgtattcttgtgacggagacgagagacccctcctggttaaaggcacgcttatcgctatcgatcctttcgacgatcggcgcgaggccgggggagaaagcaccgtggtcaaccccaagtccggcagctggaatctgtttgactggttctctggcctcatgtcctggttcgggggacctctgaaaacaattctgcttatctgcctctacgtggctctgagcattggcctgtttttcctcctgatctaccttgggagaaccggactgtctaagatgtggctcgccgcgaccaaaaaggcctcctga

SEQ ID NO: 14552 - RNA, 3204 nt, synthetic construct
  misc_feature 1..3204: note = derived and/or modified CDS sequence (opt5) from RVFV(2007002476)__EU574036.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttattttcgtgtttagctctaccgccatcatttgcctggctgtcctgtacagagtgctcaagtgtctgaaaatcgcgccccggaaggtgcttaaccctctgatgtggattacagccttcatcaaatgggtttataagaagatggtcgcccgcgtggctgataatatcaaccaggtgaatagagaaattggatggatggagggcgggcagctcgccctgggcaaccccgctccgatccctcggcacgcccccattcctcgctactccacctaccttatgctgctcctgatcgtcagctatgcgtccgcctgctctgaactgattcaggctagctccagaatcacaacctgttctacggagggagtgaacacaaaatgccggctcagcggcaccgccctgatccgcgctgggtccgttggagccgaagcctgtcttatgctgaagggcgtgaaagaggaccaaaccaagtttctcaaaattaagacagtcagctctgagctgtcctgcagagaagggcagagctactggaccggatctttctcccccaaatgtctgagctctcggagatgccatcttgtgggcgagtgtcacgttaatcgctgcctcagctggcgggataacgaaacatccgctgagtttagcttcgtgggggaatctacgaccatgagagagaataagtgctttgagcagtgtggcggatggggctgcgggtgtttcaacgtcaatccttcctgcctgtttgtgcatacatatctgcagagcgttcgcaaggaagcgctccgggtgttcaactgtatcgactgggtccacaaactgacccttgagattacagactttgatggatccgtgtctaccatcgacctgggcgccagctcctctagattcacgaattgggggagcgtgtccctctctctggatgctgaaggaattagcggctccaacagcttttctttcatcgagtcccccgggaagggctacgccattgtcgacgagccgttcagcgaaatccctcgccaaggatttctgggcgagatccggtgcaattctgaatccagcgttctttctgcccacgagtcctgtctcagagctcccaacctggtgagctataaacccatgattgatcagctggaatgcaccacaaatctcatcgaccctttcgtggtctttgagcgcgggtccctgccgcagacccggaacgataagacattcgccgcgagcaaaggaaatagaggcgtgcaggctttttctaaggggagcgttcaagccgaccttaccctgatgttcgataactttgaggtggacttcgtcggagccgctgtgtcctgtgatgccgcgtttctcaatctgacgggctgctactcttgtaacgctggggcccgcgtttgcctgagcattacatccaccggcacaggaaccctttctgcccataacaaggacggcagcctccacatcgtgctgccctccgaaaatgggaccaaagatcagtgccagattctgcatttcacagtccctgaggtggaagaggaatttatgtattcttgtgacggagacgagcggcccctcctggttaagggcacgcttatcgctatcgatcctttcgacgatagacgggaggccgggggagaaagcaccgtggtcaaccccaaatccggcagctggaactttttcgactggttctctggcctgatgtcctggtttgggggacctctcaagacaattctgctgatctgcctttacgtggctctcagcattggcctgttctttctgctcatctacctggggcgcaccggactttctaaaatgtggctggccgcgacaaagaaggcctcctga

SEQ ID NO: 14553 - RNA, 3204 nt, synthetic construct
  misc_feature 1..3204: note = derived and/or modified CDS sequence (opt5) from RVFV(73HB1230)__DQ380221.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaaaaggaactgaaatcctttgatatcagccagtgcccgaagattgggggacatggctctaagaaatgcacaggcgacgctgccttctgttccgcctacgagtgcaccgctcagtatgcgaatgcctactgtagccacgctaacgggtccggaatcgttcaaatccaggtgtctggcgtgtggaagaaacctctttgcgtcgggtatgaacgggtggttgtgaagcgcgagctgagcgccaaacccattcagagagtcgaaccttgtacgacatgcatcaccaagtgtgagccccacggactcgtggttcggtccacaggctttaagattagctctgccgtggcttgcgcctccggggtctgtgtgaccggaagccaatctcccagcaccgagatcacactgaaataccctggcatttcccagtctagcggcggggatatcggagtccatatggcgcacgacgatcagtccgtgagctctaagattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgtaccgcgtgctcaaatgtctgaagattgcccccagaaaagtgcttaaccctctgatgtggatcaccgcgttcatccggtgggtttataagaagatggtcgcccgcgtggctgataatattaaccaggtgaatagagaaatcggatggatggagggcgggcagctcgtcctgggcaaccccgccccgattcctcggcacgctcccatccctcgctactccacataccttatgctgctcctgattgtgagctatgcctccgcgtgctctgaactgatccaggccagctccagaatcaccacatgttctaccgagggagttaacacgaaatgccggctcagcggcacagctctgattcgcgccgggtccgtgggagctgaagcctgtcttatgctgaagggcgtcaaagaggaccaaaccaagtttctcaaaatcaagaccgtgagctctgagctgtcctgcagagaagggcagagctactggacaggatctttctcccccaaatgtctgagctctcggagatgccatcttgttggcgagtgtcacgtgaatcgctgcctcagctggcgggataacgaaacctccgccgagtttagcttcgtcggggaatctacaattatgagagagaataagtgctttgagcagtgtggcggatggggctgcgggtgtttcaacgtgaatccttcctgcctgtttgttcatacgtatctgcagagcgtgcgcaaggaagctctccgggtcttcaactgtatcgactgggtgcacaaactgacccttgagattacagactttgatggatccgtgtctaccatcgacctgggcgcgagctcctctagattcacaaattgggggagcgtctccctctctctggatgccgaaggaattagcggctccaacagcttttctttcatcgagtcccccgggaagggctacgctatcgttgacgagccgttcagcgaaattcctcgccaaggatttctgggcgagatccggtgcaattctgaatccagcgtgctttctgcccacgagtcctgtctcagagcccccaacctgattagctataaacccatgatcgatcagctggaatgcaccacgaatctcattgaccctttcgtggtctttgagcgcgggtccctgccgcagacccggaacgataagacattcgctgccagcaaaggaaatagaggcgtgcaggcgttttctaaggggagcgttcaagctgaccttaccctgatgttcgataactttgaggtggacttcgtcggagccgccgtgtcctgtgatgctgcctttctcaatctgacaggctgctactcttgtaacgcgggggctcgcgtttgcctgagcatcacctccacgggcacaggaaccctttctgcccataacaaggacggcagcctccacatcgtgctgccctccgaaaatgggacaaaagatcagtgccagattctgcatttcaccgtccctgaggtggaagaggaatttatgtattcttgtgacggagacgagcggcccctcctggttaagggcacccttatcgccattgatcctttcgacgatagacgggaggctgggggagaaagcacagtggtcaaccccaaatccggcagctggaactttttcgactggttctctggcctgatgtcctggtttgggggacctctcaagacgatcctgctgatttgcctttacgtggccctcagcatcggcctgttctttctgctcatctacctggggcgcaccggactttctaaaatgtggctggctgccacaaagaaggcgtcctga

SEQ ID NO: 14554 - RNA, 3204 nt, synthetic construct
  misc_feature 1..3204: note = derived and/or modified CDS sequence (opt5) from RVFV(ZINGA J83 R1)__KU978776.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagactgatgacaggagcgtcccttaagaaaggctcttaccccctgcaggacctcttctgccaaagctccgaggatgacggcagcaagctgaagaccaaaatgaagggggtctgtgaagtgggagttcaggcccttaaaaagtgcgatggccagctgtctacggctcatgaggtggtcccttttgccgtgttcaaaaattccaagaaagtgtatctcgacaagctggacctgaagaccgaagagaacctcctgcccgatagctttgtctgtttcgagcacaaagggcagtacaagggaacaatggactctggccaaaccaaacgggaacttaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcagatccaagtgtctggcgtgtggaaaaagcctctgtgcgtcgggtatgaacgcgtggttgtgaaaagagagctcagcgccaagcccattcagcgggtcgaaccttgtacgacatgcatcaccaaatgtgagccccacggactggtggttcgctccacaggctttaagattagctctgccgtggcttgcgcctccggggtctgtgtgaccggaagccagtctcccagcaccgagatcacacttaagtaccctggcatttcccaatctagcggcggggatatcggagtccatatggcgcacgacgatcagtccgtgagctctaaaattgttgctcattgcccgccccaggacccttgtctggtgcacggctgcatcgtctgcgcccatgggctcatcaattatcagtgtcacacggccctgtccgctttcgtggttgtgttcgtctttagctctattgccatcatttgcctggctatcctctacagagtgctgaagtgtcttaaaattgctccccggaaggtgctgaaccctctcatgtggatcaccgcgttcatccgctgggtttatagaaaaatggtcgcccgggtggctgataatattaaccaagtgaatcgcgaaatcggatggatggagggcgggcagctggtccttggcaaccccgccccgattcctagacacgtgcccatccctcggtactccacatacctgatgctcctgctgattgttagctatgcttccgcctgctctgaactcatccaggcgagctcccgcatcaccacatgttctaccgagggagtgaacacgaagtgcagactgagcggcacagcccttattcgggctgggtccgtcggagccgaagcctgtctgatgctcaagggcgtgaaagaggaccagaccaagtttctgaaaatcaagaccgttagctctgagctgtcctgcagagaagggcaaagctactggacaggatctttctcccccaaatgtcttagctctcgccggtgccatctcgtgggcgagtgtcacgtcaatagatgcctgagctggcgcgataacgaaacctccgccgagtttagcttcgtgggggaatctacaacgatgcgggagaataagtgctttgagcagtgtggcggatggggctgcgggtgtttcaacgttaatccttcctgcctgtttgtgcatacctatctccagagcgtcagaaaagaagccctgcgcgtgttcaactgtattgactgggtgcacaaacttacactggagatcaccgactttgatggatccgtctctacaattgacctcggcgctagctcctctcggttcaccaattgggggagcgtttccctgtctctggatgcggaaggaatcagcggctccaacagcttttctttcattgagtcccccgggaagggctacgccatcgtggacgagccgttcagcgaaatccctagacagggatttcttggcgagattcgctgcaattctgaatccagcgtgctctctgctcacgagtcctgtctgcgggcccccaacctgatcagctataagcccatgattgatcaactcgaatgcacgaccaatctgatcgaccctttcgtcgtgtttgagagagggtcccttccgcagacacgcaacgataagaccttcgccgctagcaaaggaaatcggggcgttcaggccttttctaaggggagcgtgcaggcggacctgacactcatgttcgataactttgaggtcgacttcgtgggagctgccgtttcctgtgatgccgcttttctgaatctgaccggctgctactcttgtaacgccggggcgagagtgtgccttagcattacgtccacaggcaccggaacactctctgctcataacaaagacggcagcctgcacatcgtcctgccctccgaaaatgggaccaaggatcaatgccagatcctccatttcaccgtgcctgaggttgaagaggaatttatgtattcttgtgacggagacgagcggcccctgcttgtgcgcggcacactgattgccatcgatcctttcgacgatagacgggaggccgggggagaaagcacggtcgtgaaccccaagtccggcagctggaactttttcgactggttctctggcctcatgtcctggtttgggggacctctgaaaaccattctgcttatctgcctctacgtggctctgagcattggcctgttctttctcctgatctaccttgggagaacaggactgtctaagatgtggctcgccgctaccaaaaaggcctcctga

SEQ ID NO: 14555 - RNA, 3204 nt, synthetic construct
  misc_feature 1..3204: note = derived and/or modified CDS sequence (opt5) from RVFV(2008/00101)__HE687306.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttattttcgtgtttagctctaccgccatcatttgcctggctgtcctgtacagagtgctcaagtgtctgaaaatcgcgccccggaaggtgcttaaccctctgatgtggattacagccttcatccgctgggtttataaaaagatggtcgccagagtggctgataatatcaaccaggtgaatcgggaaattggatggatggagggcgggcagctcgccctgggcaaccccgctccgatccctcgccacgcccccattcctagatactccacctaccttatgctgctcctgatcgtcagctatgcgtccgcctgctctgaactgattcaggctagctcccggatcacaacctgttctacggagggagtgaacacaaagtgccgcctcagcggcaccgccctgatcagagctgggtccgttggagccgaagcctgtcttatgctgaaaggcgtgaaggaggaccaaaccaaatttctcaagattaaaacagtcagctctgagctgtcctgccgggaagggcagagctactggaccggatctttctcccccaagtgtctgagctctagacgctgccatcttgtgggcgagtgtcacgttaatcggtgcctcagctggagagataacgaaacatccgctgagtttagcttcgtgggggaatctacgaccatgcgcgagaataaatgctttgagcagtgtggcggatggggctgcgggtgtttcaacgtcaatccttcctgcctgtttgtgcatacatatctgcagagcgttcggaaggaagcgctcagagtgttcaactgtatcgactgggtccacaagctgacccttgagattacagactttgatggatccgtgtctaccatcgacctgggcgccagctcctctcgcttcacgaattgggggagcgtgtccctctctctggatgctgaaggaattagcggctccaacagcttttctttcatcgagtcccccgggaaaggctacgccattgtcgacgagccgttcagcgaaatccctcggcaaggatttctgggcgagatcagatgcaattctgaatccagcgttctttctgcccacgagtcctgtctccgcgctcccaacctggtgagctataagcccatgattgatcagctggaatgcaccacaaatctcatcgaccctttcgtggtctttgagcgggggtccctgccgcagaccagaaacgataaaacattcgccgcgagcaagggaaatcgcggcgtgcaggctttttctaaagggagcgttcaagccgaccttaccctgatgttcgataactttgaggtggacttcgtcggagccgctgtgtcctgtgatgccgcgtttctcaatctgacgggctgctactcttgtaacgctggggcccgggtttgcctgagcattacatccaccggcacaggaaccctttctgcccataacaaggacggcagcctccacatcgtgctgccctccgaaaatgggaccaaggatcagtgccagattctgcatttcacagtccctgaggtggaagaggaatttatgtattcttgtgacggagacgagagacccctcctggttaaaggcacgcttatcgctatcgatcctttcgacgatcggcgcgaggccgggggagaaagcaccgtggtcaaccccaagtccggcagctggaactttttcgactggttctctggcctgatgtcctggtttgggggacctctcaaaacaaccctgctgatttgcctttacgtggctctcagcatcggcctgttctttctgctcatttacctggggagaacaggactttctaagatgtggctggccgcgaccaaaaaggcctcctga

SEQ ID NO: 14556 - RNA, 3204 nt, synthetic construct
  misc_feature 1..3204: note = derived and/or modified CDS sequence (opt5) from RVFV(2007002445)__EU574037.1__Gn-Gc
  source 1..3204: mol_type = other RNA
atggccggcatcgctatgacagtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttattttcgtgtttagctctaccgccatcatttgcctggctgtcctgtacagagtgctcaagtgtctgaaaatcgcgccccggaaggtgcttaaccctctgatgtggattacagccttcatccgctgggtttataaaaagatggtcgccagagtggctgataatatcaaccaggtgaatcgggaaattggatggatggagggcgggcagctcgccctgggcaaccccgctccgatccctcgccacgcccccattcctagatactccacctaccttatgctgctcctgatcgtcagctatgcgtccgcctgctctgaactgattcaggctagctcccggatcacaacctgttctacggagggagtgaacacaaagtgccgcctcagcggcaccgccctgatcagagctgggtccgttggagccgaagcctgtcttatgctgaaaggcgtgaaggaggaccaaaccaaatttctcaagattaaaacagtcagctctgagctgtcctgccgggaagggcagagctactggaccggatctttctcccccaagtgtctgagctctagacgctgccatcttgtgggcgagtgtcacgttaatcggtgcctcagctggagagataacgaaacatccgctgagtttagcttcgtgggggaatctacgaccatgcgcgagaataaatgctttgagcagtgtggcggatggggctgcgggtgtttcaacgtcaatccttcctgcctgtttgtgcatacatatctgcagagcgttcggaaggaagcgctcagagtgttcaactgtatcgactgggtccacaagctgacccttgagattacagactttgatggatccgtgtctaccatcgacctgggcgccagctcctctcgcttcacgaattgggggagcgtgtccctctctctggatgctgaaggaattagcggctccaacagcttttctttcatcgagtcccccgggaaaggctacgccattgtcgacgagccgttcagcgaaatccctcggcaaggatttctgggcgagatcagatgcaattctgaatccagcgttctttctgcccacgagtcctgtctccgcgctcccaacctggtgagctataagcccatgattgatcagctggaatgcaccacaaatctcatcgaccctttcgtggtctttgagcgggggtccctgccgcagaccagaaacgagaaaacattcgccgcgagcaagggaaatcgcggcgtgcaggctttttctaaagggagcattcaagccgatcttaccctgatgttcgacaactttgaagttgatttcgtgggagccgctgtctcctgtgacgccgcgtttctcaatctgacgggctgctactcttgtaacgctggggcccgggtgtgcctgagcatcacatccaccggcacaggaaccctttctgcccataacaaggatggcagcctccacattgttctgccctccgagaatgggaccaaggaccagtgccagatcctgcatttcacagtgcctgaagtcgaggaagagtttatgtattcttgtgatggagacgagagacccctcctggtgaaaggcacgcttatcgctattgaccctttcgatgaccggcgcgaagccgggggagagagcaccgttgtgaaccccaagtccggcagctggaactttttcgattggttctctggcctgatgtcctggtttgggggacctctcaaaacaatcctgctgatttgcctttacgtcgctctcagcatcggcctgttctttctgctcatttacctggggagaaccggactttctaagatgtggctggccgcgaccaaaaaggcctcctga

SEQ ID NO: 14557 - RNA, 3204 nt, synthetic construct
  misc_feature 1..3204: note = derived and/or modified CDS sequence (opt5) from RVFV(ZC-3349)__DQ380207.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcaggctgtgtccagcaaaattgttgcccattgcccgccccaggacccttgtcttgtgcacggctgcatcgtctgcgcccatgggctgatcaattatcaatgtcacacggctctctctgccttcgtggttgtgttcgtcttttccagcattgctatcatttgcctggccatcctgtacagagtgctcaagtgtctgaaaattgcgccccggaaggtgcttaaccctctgatgtggatcaccgccttcatccgctggatttataaaaagatggttgctagagtcgccgataatatcaaccacgtgaatcgggaaattggatggatggagggcgggcagctcgtgctgggcaaccccgctccgatccctcgccatgcccccattcctagatactctacataccttatgctgctcctgatcgtctcctatgcgagcgcctgctccgaactgatccaggcttctagccggattaccacatgttccaccgagggagtgaacacgaagtgccgcctctctggcacagccctgatcagagctgggagcgttggagccgaagcctgtcttatgctgaaaggcgtgaaggaggaccagaccaaatttctcaagattaaaaccgtctccagcgagctgtcttgccgggaagggcaatcctactggacaggcagcttctctcccaagtgtctgtccagcagacgctgccaccttgtgggagagtgtcatgttaatcggtgcctctcttggagagataacgaaaccagcgctgagttttccttcgtgggggaaagcacaacgatgcgcgagaataaatgctttgagcagtgtggcggatggggctgcgggtgtttcaacgtcaatccttcttgcctgtttgtgcacacctatctgcagtccgttcggaaggaagcgctcagagtgttcaactgtatcgactgggtccacaagctgacacttgagattaccgactttgatggaagcgtgtccacaatcgacctgggcgcctctagctcccgcttcaccaattgggggtctgtgagcctctccctggatgctgaaggaatttctggcagcaactcctttagcttcatcgagtctcccgggaaaggctacgccatcgtcgacgagccgttctccgaaattcctcggcagggatttctgggcgagatcagatgcaatagcgaatcttccgttcttagcgcccatgagtcttgtctcaaggctcccaacctgatttcctataaacccatgatcgatcaactggaatgcacgaccaatctcattgaccctttcgtggtgtttgagcgcgggagcctgccgcagacacggaacgataagaccttcgccgcgtccaaaggaaatagaggcgtccaggcttttagcaaggggtctgtgcaggccgaccttacactgatgttcgataactttgaggttgacttcgtgggagccgctgtcagctgtgatgccgcgtttctcaatctgaccggctgctactcctgtaacgctggggcccgcgtgtgcctgtctatcacgagcacaggcaccggatccctttctgcccacaacaaggacggcagcctccatatcgttctgccctccgaaaatgggacaaaagatcaatgccagattctgcacttcaccgtgcctgaggtcgaagaggaatttatgtattcttgtgacggagacgagcggcccctcctggtgaagggcacccttatcgctattgatcctttcgacgatagacgggaggccgggggagaaagcacagttgtgaaccccaaatccggcagctggaactttttcgactggttctctggcctgatgtcctggtttgggggacctctcaagacgatcctgctgatttgcctttacgtcgctctcagcatcggcctgttctttctgctcatctacctggggcgcaccggactttctaaaatgtggctggccgcgacaaagaaggcctcctga

SEQ ID NO: 14558 - RNA, 3204 nt, synthetic construct
  misc_feature 1..3204: note = derived and/or modified CDS sequence (opt5) from RVFV(Kenya 9800523)__DQ380196.1__Gn-Gc
  source 1..3204: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgccttttgtagccacgctaacgggtccggaatcgttcaaatccaggtgtctggcgtgtggaaaaagcctctttgcgtcgggtacgaacgcgtggttgtgaaaagagagctgagcgccaagcccattcagcgggtcgaaccttgtacgacatgcatcaccaaatgtgagccccacggactcgtggttcgctccacaggcttcaagattagctctgccgtggcttgcgcctccggggtctgtgtgaccggaagccaatctcccagcaccgagatcacactgaagtatcctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattaccaatgtcacacggccctctccgctttcgtggttgtgtttgtcttcagctctattgccatcatttgcctggctatcctgtatagagtgctcaagtgtctgaaaattgcgccccggaaggtgcttaaccctctgatgtggatcaccgcctttatccgctgggtttacaaaaagatggtcgccagagtggctgataatattaaccaggtgaatcgggaaatcggatggatggagggcgggcagctcgtcctgggcaaccccgccccgattcctcgccacgctcccatccctagatattccacataccttatgctgctcctgattgtgagctacgcctccgcgtgctctgaactgatccaggccagctcccggatcaccacatgttctaccgagggagttaacacgaagtgccgcctcagcggcacagctctgattagagccgggtccgtgggagctgaagcctgtcttatgctgaaaggcgtcaaggaggaccaaaccaaattcctcaagatcaaaaccgtgagctctgagctgtcctgccgggaagggcagagctattggacaggatctttttcccccaagtgtctgagctctagacgctgccatcttgttggcgagtgtcacgtgaatcggtgcctcagctggagagataacgaaacctccgccgagttcagctttgtcggggaatctacaacgatgcgcgagaataaatgcttcgagcagtgtggcggatggggctgcgggtgttttaacgtgaatccttcctgcctgttcgttcatacctacctgcagagcgtgcggaaggaagctctcagagtctttaactgtattgactgggtgcacaagctgacacttgagatcaccgacttcgatggatccgtgtctacaattgacctgggcgcgagctcctctcgctttaccaattgggggagcgtctccctctctctggatgccgaaggaatcagcggctccaacagcttctctttcattgagtcccccgggaaaggctatgctatcgttgacgagccgtttagcgaaatccctcggcaaggattcctgggcgagattagatgcaattctgaatccagcgtgcttaacgcccacgagtcttgtctccgcgcccccaatctgatctcctacaagcccatgattgatcagctggaatgcacgaccaacctcatcgacccttttgtggtcttcgagcgggggagcctgccgcagacaagaaatgataaaacctttgctgcctccaagggaaaccgcggcgtgcaggcgttcagcaaagggtctgttcaagctgaccttacactgatgtttgataatttcgaggtggactttgtcggagccgccgtgagctgtgatgctgccttcctcaacctgaccggctgctattcctgtaacgcgggggctcgggtttgcctgtctattacgagcacaggcaccggaacactttccgcccataataaggaaggctctctccacatcgtgctgcccagcgagaacgggaccaaggaccagtgccagatcctgcattttaccgtccctgaagtggaggaagagttcatgtactcctgtgatggagacgagagacccctcctggttaaaggcacacttattgccatcgacccttttgatgaccggcgcgaagctgggggagagtctacggtggtcaatcccaagagcggctcctggaacttcttcgattggtttagcggcctgatgtcttggttcgggggacctctcaaaaccattctgctgatctgcctttatgtggccctctccattggcctgtttttcctgctcatctacctggggagaacaggacttagcaagatgtggctggctgccaccaaaaaggcgtcttga

SEQ ID NO: 14559 - RNA, 3204 nt, synthetic construct
  misc_feature 1..3204: note = derived and/or modified CDS sequence (opt5) from RVFV(Entebbe)__DQ380191.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagatcaaacgggaactgaagtcctttgatattagccagtgcccgaaaatcgggggacatggctctaagaagtgcaccggcgacgctgccttctgttccgcctacgagtgcacagctcagtatgcgaatgcctactgtagccacgctaacgggtccggaatcgttcaaattcaggtgtctggcgtgtggaaaaagcctctttgcgtcgggtatgaacgcgtggttgtgaaaagagagctgagcgccaagcccatccagcgggtcgaaccttgtaccacgtgcattacaaaatgtgagccccacggactcgtggttcgctccaccggctttaagatcagctctgccgtggcttgcgcctccggggtctgtgtgacaggaagccaatctcccagcaccgagattaccctgaagtaccctggcatctcccagtctagcggcggggatattggagtccatatggcgcacgacgatcagtccgtgagctctaaaatcgttgctcattgcccgccccaggacccttgtcttgtgcacggctgcatcgtctgcgcccatgggctgattaattatcaatgtcacacagccctctccgctttcgtggttgtgttcgtctttagctctgtggccatcatttgcctggctatcctgtacaaggtgctcaaatgtctgaagattgcccccagaaaagttcttaaccctctgatgtggatcacggcgttcatccggtgggtctataagaagatggtggcccgcgtggctgataatattaaccaggtcaatagagaaatcggatggatggagggcgggcagctcgtgctgggcaaccccgccccgattcctcggcacgctcccatccctcgctactccacctaccttatgctgctcctgattgttagctatgcctccgcgtgctctgaactgatccaggccagctccagaatcacaacctgttctacagagggagtgaacaccaaatgccggctcagcggcacggctctgattcgcgccgggtccgtcggagctgaagcctgtcttatgctgaagggcgtgaaagaggaccaaacaaagtttctcaaaatcaagaccgttagctctgagctgtcctgcagagaagggcagagctactggaccggatctttctcccccaaatgtctgagctctcggagatgccatcttgtgggcgagtgtcacgtcaatcgctgcctcagctggcgggataacgaaacatccgccgagtttagcttcgtgggggaatctaccacaatgagagagaataagtgctttgagcagtgtggcggatggggctgcgggtgtttcaacgttaatccttcctgcctgtttgtgcatacgtatctgcagagcgtccgcaaggaagctctccgggtgttcaactgtattgactgggtgcacaaactgacccttgagatcacagactttgatggatccgtctctaccgttgacctgggcgcgagctcctctagattcacaaattgggggagcgtgtccctctctctggatgccgaaggaattagcggctccaacagcttttctttcatcgagtcccccgggaagggctacgctattgtggacgagccgttcagcgaaatccctcgccaaggatttctgggcgagatccggtgcaattctgaatccagcgtcctttctgcccacgagtcctgtctcagagcccccaacctgattagctataaacccatgatcgatcagctggaatgcaccacgaatctcattgaccctttcgtggtttttgagcgcgggtccctgccgcagacccggaacgataagacattcgctgccagcaaaggaaatagaggcgtgcaggcgttttctaaggggagcgtccaagctgaccttaccctgatgttcgataactttgaggtggacttcgttggagccgccgtgtcctgtgatgctgcctttctcaatctgacaggctgctactcttgtaacgcgggggctcgcgtctgcctgagcatcacctccacgggcacaggaaccctttctgcccataacaaggacggcagcctccacattgtgctgccctccgaaaatgggacaaaagatcagtgccagatcctgcatttcaccgttcctgaggtggaagaggaatttatgtattcttgtgacggagacgagcggcccctcctggtcaagggcacccttatcgccattgatcctttcgacgatagacgggaggctgggggagaaagcacagtggtgaaccccaaatccggcagctggaactttttcgactggttctctggcctgatgtcctggtttgggggacctctcaagacgatcctgctgatttgcctttacgtcgccctcagcatcggcctgttctttctgctcatttacctggggcgcaccggactttctaaaatgtggctggctgccacaaagaaggcgtcctga

SEQ ID NO: 14560 - RNA, 3204 nt, synthetic construct
  misc_feature 1..3204: note = derived and/or modified CDS sequence (opt5) from RVFV(25010-24)__KM210509.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcattgtgcgctccacaggctttaagatcagctctgccgttgcttgcgcctccggggtgtgtgtcaccggaagccaatctcccagcaccgagattacactgaagtaccctggcatctcccagtctagcggcggggatattggagtgcatatggcgcacgacgatcagtccgtcagctctaaaatcgtggctcattgcccgccccaggacccttgtcttgttcacggctgcatcgtgtgcgcccatgggctgattaattatcaatgtcacacggccctctccgctttcgtcgtggttttcgtgtttagctctgtcgccatcatttgcctggctatcctgtacaaggtgctcaaatgtctgaagattgcccccaaaaaggtgcttaaccctctgatgtggatcaccgcgttcatcagatgggtttataagaaaatggtcgcccgggtggctgataatattaaccaggtgaatcgcgaaatcggatggatggagggcgggcagctcgccctgggcaaccccgctccgattcctagacacgcccccatccctcggtactccacataccttatgctgctcctgattgtcagctatgcgtccgcctgctctgaactgatccaggctagctcccgcatcaccacatgttctaccgagggagtgaacacgaagtgcagactcagcggcacagccctgattcgggctgggtccgttggagccgaagcctgtcttatgctgaaaggcgtgaaggacgatcaaaccaaatttctcaagatcaaaaccgtcagctctgagctgtcctgccgcgaggggcagagctactggacaggatctttctcccccaagtgtctgagctctagacggtgccatcttgtgggcgaatgtcacgttaatagatgcctcagctggcgcgacaacgagacctccgctgaatttagcttcgtgggggagtctacaacgatgcgggaaaataagtgctttgagcagtgtggcggatggggctgcgggtgtttcaacgtcaatccttcctgcctgtttgtgcatacctatctgcagagcgttagaaaagaggcgctccgcgtgttcaactgtattgactgggtccacaagctgacacttgaaatcaccgattttgacggatccgtgtctacaattgatctgggcgccagctcctctcggttcaccaattgggggagcgtgtccctctctctggacgctgagggaatcagcggctccaacagcttttctttcattgaatcccccgggaaaggctacgccatcgtcgatgagccgttcagcgagatccctagacaaggatttctgggcgaaattcgctgcaattctgagtccagcgttctttctgcccacgaatcctgtctccgggctcccaacctgatcagctataagcccatgattgaccagctggagtgcacgaccaatctcatcgatcctttcgtggtgtttgaaagagggtccctgccgcagacacgcaacgacaaaaccttcgccgcgagcaagggaaatcggggcgtccaggctttttctaaggggagcgtgcaagccgatcttacactgatgttcgacaactttgaggttgatttcgtgggagccgctgtctcctgtgacgccgcgtttctcaatctgaccggctgctactcttgtaacgctggggccagagtgtgcctgagcattacgtccacaggcaccggaacactttctgcccataacaaagatggcagcctccacatcgttctgccctccgagaatgggaccaaggaccagtgccagatcctgcatttcaccgtgcctgaagtcgaggaagagtttatgtattcttgtgacggagatgaacgccccctcctggtgaaaggcacacttattgctatcgaccctttcgatgaccggagagaggccgggggagagagcacggttgtgaaccccaagtccggcagctggaactttttcgattggttctctggcctgatgtcctggtttgggggacctctcaaaaccattctgctgatctgcctttacgtcgctctcagcattggcctgttctttctgctcatctacctggggcggacaggactttctaagatgtggctggccgcgaccaagaaagcctcctga

SEQ ID NO: 14561 - RNA, 3204 nt, synthetic construct
  misc_feature 1..3204: note = derived and/or modified CDS sequence (opt5) from RVFV(763/70)__DQ380188.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatggactcaccgaagattgcaacttttgtagacagatgacaggcgcgtccctgaagaaaggctcttacccccttcaagacctgttctgccagagctccgaggatgacgggagcaagctcaagaccaaaatgaagggagtctgtgaggtgggcgttcaggccctgaaaaagtgcgatgggcagctttctacggctcatgaagtggtcccttttgccgtgttcaaaaattccaagaaagtgtatctggacaagctcgacctgaagaccgaggaaaacctgctccccgatagctttgtctgtttcgagcacaaaggacaatacaagggcacaatggactctgggcagaccaaacgggagctgaagtcctttgatatcagccagtgcccgaaaattggaggccatggctctaagaagtgcacaggggacgctgccttctgttccgcctacgaatgcaccgctcagtatgcgaatgcctactgtagccacgctaacggatccggcatcgttcaaatccaggtgtctggggtgtggaaaaagcctctttgcgtcggatatgagcgcgtggttgtgaaaagagaactgagcgccaagcccattcagcgggtcgagccttgtacgacatgcatcaccaaatgtgaaccccacggcctcgtggttcgctccacagggtttaagattagctctgccgtggcttgcgcctccggagtctgtgtgaccggcagccaatctcccagcaccgagatcacactgaagtaccctggcatttcccagtctagcgggggagatatcggcgtccatatggcgcacgacgatcagtccgtgagctctaaaattgttgctcattgcccgccccaggacccttgtcttgtgcacgggtgcatcgtctgcgcccatggactgatcaattatcaatgtcacacggccctctccgctttcgtggttgtgttcgtctttagctctgtggccattatctgcctggctattctgtacaaggtgctcaaatgtctgaagatcgcccccagaaaagttcttaaccctctgatgtggattaccgcgttcatccggtgggtctataagaagatggtggcccgcgtggctgataatatcaaccaggtcaatagagagattggctggatggaagggggccagctcgccctgggaaaccccgctccgatccctcggcacgcccccattcctcgctactccacataccttatgctgctcctgatcgtgagctatgcgtccgcctgctctgagctgattcaggctagctccagaatcaccacatgttctaccgaaggcgttaacacgaaatgccggctcagcgggacagccctgatccgcgctggatccgtgggcgccgaggcctgtcttatgctgaagggggtcaaagaagaccaaaccaagtttctcaaaattaagaccgtgagctctgagctgtcctgcagagagggacagagctactggacaggctctttctcccccaaatgtctgagctctcggagatgccatcttgttggggaatgtcacgtgaatcgctgcctcagctggcgggataacgagacctccgctgaatttagcttcgtcggcgagtctacaacgatgagagaaaataagtgctttgagcagtgtggaggctgggggtgcggatgtttcaacgtgaatccttcctgcctgtttgttcatacctatctgcagagcgtgcgcaaggaggcgctccgggtcttcaactgtatcgactgggtgcacaaactgacacttgaaattaccgactttgatggctccgtgtctacaatcgacctgggggccagctcctctagattcaccaattggggaagcgtctccctctctctggatgctgagggcattagcgggtccaacagcttttctttcatcgaatcccccggcaagggatacgccattgttgacgagccgttcagcgagatccctcgccaaggctttctgggggaaatccggtgcaattctgagtccagcgtgctttctgcccacgaatcctgtctcagagctcccaacctgattagctataaacccatgatcgatcagctggagtgcacgaccaatctcattgaccctttcgtggtctttgaacgcggatccctgccgcagacacggaacgataagaccttcgccgcgagcaaaggcaatagaggggtgcaggctttttctaagggaagcgttcaagccgaccttacactgatgttcgataactttgaggtggacttcgtcggcgccgctgtgtcctgtgatgccgcgtttctcaatctgaccgggtgctactcttgtaacgctggcgcccgcgtttgcctgagcatcacgtccacaggaaccggcacactttctgcccataacaaggacgggagcctccacattgtgctgccctccgagaatggaaccaaagatcagtgccagatcctgcatttcaccgtccctgaagtggaggaagagtttatgtattcttgtgacggcgacgaacggcccctcctggttaaggggacacttatcgctattgatcctttcgacgatagacgggaggccggaggcgagagcacggtggtcaaccccaaatccggcagctggaactttttcgactggttctctgggctgatgtcctggtttggaggccctctcaagaccatcctgctgatttgcctttacgtggctctcagcatcgggctgttctttctgctcatttacctgggacgcacaggcctttctaaaatgtggctggccgcgaccaagaaggcctcctga

SEQ ID NO: 14562 - RNA, 3204 nt, synthetic construct
  misc_feature 1..3204: note = derived and/or modified CDS sequence (opt5) from RVFV(OS-1)__DQ380186.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggagttgtgcaaatccaggtgtctggcgtctggaaaaagcctctttgcgtggggtatgaacgcgttgtggtcaaaagagagctgagcgccaagcccatccagcgggtggaaccttgtacgacatgcattaccaaatgtgagccccacggactcgttgtgcgctccacaggctttaagatcagctctgccgtcgcttgcgcctccggggtgtgtgtcaccggaagccaatctcccagcaccgagattacactgaagtaccctggcatctcccagtctagcggcggggatattggagtgcatatggcgcacgacgatcagtccgttagctctaaaatcgtggctcattgcccgccccaggacccttgtcttgtccacggctgcattgtgtgcgcccatgggctgatcaattatcaatgtcacacggccctctccgctttcgttgtggtcttcgtgtttagctctgtggccatcatttgcctggctatcctgtacaaggttctcaaatgtctgaagattgcccccagaaaagtccttaaccctctgatgtggatcaccgcgttcattcggtgggtgtataagaagatggtggcccgcgtcgctgataatatcaaccaggtgaatagagaaatcggatggatggagggcgggcagctcgccctgggcaaccccgctccgattcctcggcacgcccccatccctcgctactccacataccttatgctgctcctgattgttagctatgcgtccgcctgctctgaactgatccaggctagctccagaattaccacatgttctaccgagggagtgaacacgaaatgccggctcagcggcacagccctgatccgcgctgggtccgtcggagccgaagcctgtcttatgctgaagggcgtgaaagaggaccaaaccaagtttctcaaaatcaagaccgttagctctgagctgtcctgcagagaagggcagagctactggacaggatctttctcccccaaatgtctgagctctcggagatgccatcttgtgggcgagtgtcacgtcaatcgctgcctcagctggcgggataacgaaacctccgctgagtttagcttcgtgggggaatctacaacgatgagagagaataagtgctttgagcagtgtggcggatggggctgcgggtgtttcaacgttaatccttcctgcctgtttgtgcatacctatctgcagagcgtccgcaaggaagcgctcaaagtgttcaactgtattgactgggtgcacaagctgacacttgagatcaccgactttgatggatccgtctctacaattgacctgggcgccagctcctctcggttcaccaattgggggagcgtttccctctctctggatgctgaaggaatcagcggctccaacagcttttctttcattgagtcccccgggaaaggctacgccatcgtggacgagccgttcagcgaaattcctagacaaggatttctgggcgagatccgctgcaattctgaatccagcgtgctttctgcccacgagtcctgtctccgggctcccaacctgatcagctataagcccatgattgatcagctggaatgcacgaccaatctcatcgaccctttcgtcgtgtttgagagagggtccctgccgcagacacgcaacgataaaaccttcgccgcgagcaagggaaatcggggcgttcaggctttttctaaggggagcgtgcaagccgaccttacactgatgttcgataactttgaggtcgacttcgtgggagccgctgtttcctgtgatgccgcgtttctcaatctgaccggctgctactcttgtaacgctggggccagagtgtgcctgagcattacgtccacaggcaccggaacactttctgcccataacaaagacggcagcctccacatcgtcctgccctccgaaaatgggaccaaggatcagtgccagattctgcatttcaccgtgcctgaggttgaagaggaatttatgtattcttgtgacggagacgagcgccccctcctggtgaaaggcacacttatcgctatcgatcctttcgacgatcggagagaggccgggggagaaagcacggtcgtgaaccccaagtccggcagctggaactttttcgactggttctctggcctgatgtcctggtttgggggacctctcaaaaccattctgctgatctgcctttacgtggctctcagcattggcctgttctttctgctcatctacctggggcggacaggactttctaagatgtggctggccgcgaccaagaaagcctcctga

SEQ ID NO: 14563 - RNA, 3204 nt, synthetic construct
  misc_feature 1..3204: note = derived and/or modified CDS sequence (opt5) from RVFV(BIME-01)__KX609032.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctgtggccattatctgcctggctattctgtacaaggtgctcagatgtctgaaaatcgcccccaagaaagttcttaaccctctgatgtggattaccgcgttcatccggtgggtctataagaagatggtggcccgcgtggctgataatatcaaccaggtcaatagagaaattggatggatggagggcgggcagctcgccctgggcaaccccgctccgatccctcggcacgcccccattcctcgctactccacataccttatgctgctcctgatcattagctatgcgtccgcctgctctgaactgatccaggctagctccagaatcaccacatgttctaccgagggagtgaacacgaaatgccggctcagcggcacagccctgattcgcgctgggtccgttggagccgaagcctgtcttatgctgaagggcgtgaaagaggaccaaaccaagtttctcaaaatcaagaccgtcagctctgagctgtcctgcagagaagggcagagctactggacaggatctttctcccccaaatgtctgagctctcggagatgccatcttgtgggcgagtgtcacgttaatcgctgcctcagctggcgggataacgaaacctccgctgagtttagcttcgtgggggaatctacaacgatgagagagaataagtgctttgagcagtgtggcggatggggctgcgggtgtttcaacgtcaatccttcctgcctgtttgtgcatacctatctgcagagcgttcgcaaggaagcgctccgggtgttcaactgtattgactgggtccacaaactgacacttgagatcaccgactttgatggatccgtgtctacaattgacctgggcgccagctcctctagattcaccaattgggggagcgtgtccctctctctggatgctgaaggaatcagcggctccaacagcttttctttcattgagtcccccgggaagggctacgccatcgtcgacgagccgttcagcgaaatccctcgccaaggatttctgggcgagattcggtgcaattctgaatccagcgttctttctgcccacgagtcctgtctcagagctcccaacctgatcagctataaacccatgattgatcagctggaatgcacgaccaatctcatcgaccctttcgtggtgtttgagcgcgggtccctgccgcagacacggaacgataagaccttcgccgcgagcaaaggaaatagaggcgtccaggctttttctaaggggagcgtgcaagccgaccttacactgatgttcgataactttgaggttgacttcgtgggagccgctgtctcctgtgatgccgcgtttctcaatctgaccggctgctactcttgtaacgctggggcccgcgtgtgcctgagcattacgtccacaggcaccggaacactttctgcccataacaaggacggcagcctccacatcgttctgccctccgaaaatgggaccaaagatcagtgccagatcctgcatttcaccgtgcctgaggtcgaagaggaatttatgtattcttgtgacggagacgagcggcccctcctggtgaagggcacacttattgctatcgatcctttcgacgatagacgggaggccgggggagaaagcacggttgtgaaccccaaatccggcagctggaactttttcgactggttctctggcctgatgtcctggtttgggggacctctcaagaccattctgctgatctgcctttacgtcgctctcagcattggcctgttctttctgctcatctacctggggcgcacaggactttctaaaatgtggctggccgcgaccaagaaggcctcctga

SEQ ID NO: 14564 - RNA, 3204 nt, synthetic construct
  misc_feature 1..3204: note = derived and/or modified CDS sequence (opt5) from RVFV(73HB1449)__DQ380211.1__Gn-Gc
  source 1..3204: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaaaatccctctaccgagatcacactgaagtaccctggcattagccagtcctctggcggggatatcggagtccatatggcgcacgacgatcagagcgtgtccagcaaaattgttgctcattgcccgccccaggacccttgtcttgtgcacggctgcatcgtctgcgcccatgggctgatcaactatcaatgtcacacggccctctctgctttcgtggttgtgttcgtcttttccagcattgccatcatttgcctggctatcctgtacagagtgctcaagtgtctgaaaattgcgccccggaaggtgcttaatcctctgatgtggatcaccgccttcatccgctgggtttataaaaagatggtcgccagagtggctgataacattaatcaggtgaaccgggaaatcggatggatggagggcgggcagctcgtcctgggcaaccccgccccgattcctcgccacgctcccatccctagatactctacataccttatgctgctcctgattgtgtcctatgccagcgcgtgctccgaactgatccaggcctctagccggatcaccacatgttccaccgagggagttaatacgaagtgccgcctctctggcacagctctgattagagccgggagcgtgggagctgaagcctgtcttatgctgaaaggcgtcaaggacgatcaaaccaaatttctcaagatcaaaaccgtgtccagcgagctgtcttgccgggaggggcagtcctactggacaggcagcttctctcccaagtgtctgtccagcagacgctgccatcttgttggagaatgtcacgtgaaccggtgcctctcttggagagacaatgagaccagcgccgaattttccttcgtcggggagagcacaacgatgcgcgaaaacaaatgctttgagcagtgtggcggatggggctgcgggtgtttcaatgtgaacccttcttgcctgtttgttcatacctatctgcagtccgtgcggaaggaggctctcagagtcttcaattgtattgactgggtgcacaagctgacacttgaaatcaccgattttgacggaagcgtgtccacaattgatctgggcgcgtctagctcccgcttcaccaactgggggtctgtcagcctctccctggacgccgagggaatctctggcagcaattcctttagcttcattgaatctcccgggaaaggctacgctatcgttgatgagccgttctccgagatccctcggcaaggatttctgggcgaaattagatgcaacagcgagtcttccgtgcttagcgcccacgaatcttgtctccgcgcccccaatctgatctcctataagcccatgattgaccagctggagtgcacgaccaacctcatcgatcctttcgtggtctttgaacgggggagcctgccgcagacaagaaatgagaaaaccttcgctgcctccaagggaaaccgcggcgtgcaggcgtttagcaaagggtctgttcaagctgaccttacactgatgttcgataattttgaggtggacttcgtcggagccgccgtgagctgtgatgctgcctttctcaacctgaccggctgctactcctgtaacgcgggggctcgggtttgcctgtctattacgagcacaggcaccggaacactttccgcccataataaggacggctctctccacatcgtgctgcccagcgaaaacgggaccaaggatcagtgccagatcctgcatttcaccgtccctgaggtggaagaggaatttatgtattcctgtgacggagacgagagacccctcctggttaaaggcacacttattgccatcgatcctttcgacgatcggcgcgaggctgggggagaatctacggtggtcaatcccaagagcggctcctggaactttttcgactggttcagcggcctgatgtcttggtttgggggacctctcaaaaccattctgctgatctgcctttacgtggccctctccattggcctgttctttctgctcatctacctggggagaacaggacttagcaagatgtggctggctgccaccaaaaaggcgtcttga

SEQ ID NO: 14565 - RNA, 3204 nt, synthetic construct
  misc_feature 1..3204: note = derived and/or modified CDS sequence (opt5) from RVFV(SA01-1322)__KX096942.1__Gn-Gc
  source 1..3204: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgccttttgtagccacgctaacgggtccggaatcgttcaaatccaggtgtctggcgtgtggaaaaagcctctttgcgtcgggtacgaacgcgtggttgtgaaaagagagctgagcgccaagcccattcagcgggtcgaaccttgtacgacatgcatcaccaaatgtgagccccacggactcgtggttcgctccacaggcttcaagattagctctgccgtggcttgcgcctccggggtctgtgtgaccggaagccaatctcccagcaccgagatcacactgaagtatcctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattaccaatgtcacacggccctctccgctttcgtggttgtgtttgtcttcagctctattgccatcatttgcctggctatcctgtatagagtgctcaagtgtctgaaaattgcgccccggaaggtgcttaaccctctgatgtggatcaccgcctttatccgctgggtttacaaaaagatggtcgccagagtggctgataatattaaccaggtgaatcgggaaatcggatggatggagggcgggcagctcgtcctgggcgaccccgccccgattcctcgccacgctcccatccctagatattccacataccttatgctgctcctgattatcagctacgcctccgcgtgctctgaactgatccaggccagctcccggattaccacatgttctaccgagggagtgaacacgaagtgccgcctcagcggcacagctctgatcagagccgggtccgttggagctgaagcctgtcttatgctgaaaggcgtgaaggaggatcaaaccaaattcctcaagattaaaaccgtcagctctgagctgtcctgccgggaagggcagagctattggacaggatctttttcccccaagtgtctgagctctagacgctgccatcttgtgggcgagtgtcacgttaaccggtgcctcagctggagagacaatgaaacctccgccgagttcagctttgtgggggaatctacaacgatgcgcgagaacaaatgcttcgagcagtgtggcggatggggctgcgggtgttttaatgtcaacccttcctgcctgttcgtgcatacctacctgcagagcgttcggaaggaagctctcagagtgtttaattgtatcgactgggtccacaagctgacacttgagattaccgatttcgacggatccgtgtctacaatcgatctgggcgcgagctcctctcgctttaccaactgggggagcgtgtccctctctctggacgccgaaggaattagcggctccaatagcttctctttcatcgagtcccccgggaaaggctatgctatcgtcgatgagccgtttagcgaaattcctcggcaaggattcctgggcgagatcagatgcaactctgaatccagcgttctttctgcccacgagtcctgtctccgcgcccccaatctgattagctacaagcccatgatcgaccagctggaatgcacgaccaacctcattgatccttttgtggtgttcgagcgggggtccctgccgcagacaagaaatgagaaaacctttgctgccagcaagggaaaccgcggcgtccaggcgttctctaaagggagcgtgcaagctgaccttacactgatgtttgataatttcgaagttgactttgtgggagccgccgtctcctgtgatgctgccttcctcaacctgaccggctgctattcttgtaatgcgggggctcgggtgtgcctgagcatcacgtccacaggcaccggaacactttctgcccataacaaggacggcagcctccacatcgttctgccctccgagaacgggaccaaggatcagtgccagattctgcattttaccgtgcctgaagtcgaggaagagttcatgtactcttgtgacggagacgagagacccctcctggtgaaaggcacacttatcgccattgatccttttgacgatcggcgcgaagctgggggagagagcacggttgtgaatcccaagtccggcagctggaacttcttcgactggttttctggcctgatgtcctggttcgggggacctctcaaaaccatcctgctgatttgcctttatgtcgccctcagcatcggcctgtttttcctgctcatctacctggggagaacaggactttctaagatgtggctggctgccaccaaaaaggcgtcctga

SEQ ID NO: 14566 - RNA, 3204 nt, synthetic construct
  misc_feature 1..3204: note = derived and/or modified CDS sequence (opt5) from RVFV(Sudan 2V-2007)__JQ820490.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgttccgtgcacggctgcatcgtctgcgcccatgggcttatcaattatcaatgtcacacggccctgagcgctttcgtggttgtgttcgtcttttcttccattgccatcatttgcctcgctatcctgtacagagtgctgaagtgtctcaaaattgcgccccggaaggtgctgaaccctcttatgtggatcaccgccttcatccgctgggtttataaaaagatggtcgccagagtggctgataatattaaccaggtgaatcgggaaatcggatggatggagggcgggcagctggtcctcggcaaccccgccccgattcctcgccacgctcccatccctagatacagcacatacctgatgcttctgctcattgtgtcccatgcctctgcgtgcagcgaactgatccaggcctcctctcggatcaccacatgtagcaccgagggagttaacacgaagtgccgcctgtccggcacagctctcattagagccgggagcgtgggagctgaagcctgtctgatgcttaaaggcgtcaaggaggaccaaaccaaatttctgaagatcaaaaccgtgtcttccgagctcagctgccgggaagggcagtcttattggacaggatccttcagccccaagtgtctgtctagcagacgctgccacctggttggcgagtgtcatgtgaatcggtgcctttcctggagagataacgaaaccagcgccgagttttctttcgtcggggaatccacaacgatgcgcgagaataaatgctttgagcagtgtggcggatggggctgcgggtgtttcaacgtgaatcctagctgcctctttgttcacacctacctgcagtccgtgcggaaggaagctctgagagtcttcaactgtattgactgggtgcacaagctcacactggagatcaccgactttgatggatctgtgagcacaattgaccttggcgcgtcctctagccgcttcaccaattgggggtccgtctctctgagcctcgatgccgaaggaatctccggcagcaactctttttccttcattgagagccccgggaaaggctatgctatcgttgacgagccgttctctgaaatccctcggcaaggatttctgggcgagattagatgcaattccgaaagctctgtgctgtccgcccatgagagctgtcttcgcgcccccaacctcatctcctacaagcccatgattgatcagctggaatgcacgaccaatctgatcgaccctttcgtggtctttgagcgggggagcctcccgcagacaagaaacgataaaaccttcgctgcctctaagggaaatcgcggcgtgcaggcgtttagcaaagggtccgttcaagctgacctgacacttatgttcgataactttgaggtggacttcgtcggagccgccgtgtcttgtgatgctgcctttctgaatctcaccggctgctatagctgtaacgcgggggctcgggtttgcctgtccattacgtctacaggcaccggaacactgagcgcccacaacaaggacggctcccttcatatcgtgctcccctctgaaaatgggaccaaggatcagtgccagatcctgcacttcaccgtccctgaggtggaagaggaatttatgtacagctgtgacggagacgagagacccctgctcgttaaaggcacactgatggccattgatcctttcgacgatcggcgcgaggctgggggagaatccacggtggtcaaccccaagagcggctcttggaactttttcgactggttctccggccttatgagctggtttgggggacctctgaaaaccatcctcctgatttgcctgtatgtggccctttctatcggcctcttctttctgctgatttacctcgggagaacaggactgtccaagatgtggcttgctgccaccaaaaaggcgagctga

SEQ ID NO: 14567 - RNA, 3204 nt, synthetic construct
  misc_feature 1..3204: note = derived and/or modified CDS sequence (opt5) from RVFV(35/74)__JF784387.1__Gn-Gc
  source 1..3204: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggagttgtgcaaatccaggtgtctggcgtctggaaaaagcctctttgcgtggggtatgaacgcgttgtggtcaaaagagagctgagcgccaagcccatccagcgggtggaaccttgtacgacatgcattaccaaatgtgagccccacggactcgttgtgcgctccacaggctttaagatcagctctgccgtcgcttgcgcctccggggtgtgtgtcaccggaagccaatctcccagcaccgagattacactgaagtaccctggcatctcccagtctagcggcggggatattggagtgcatatggcgcacgacgatcagtccgttagctctaaaatcgtggctcattgcccgccccaggacccttgtcttgtccacggctgcattgtgtgcgcccatgggctgatcaattatcaatgtcacacggccctctccgctttcgttgtggtcttcgtgtttagctctgtggccatcatttgcctggctatcctgtacaaggttctcaaatgtctgaagattgcccccagaaaagtccttgatcctctgatgtggatcaccgtgttcattcggtgggtgtataagaagatggtcgcgcgcgtggccgacaacatcaatcaggttaacagagaaatcggatggatggagggcgggcagctcgctctgggcaatcccgccccgattcctcggcacgctcccatccctcgctactccacataccttatgctgctcctgattgtgagctatgcctccgcgtgctctgaactgatccaggccagctccagaattaccacatgttctaccgagggagtcaacacgaaatgccggctcagcggcacagctctgatccgcgccgggtccgtgggagctgaagcctgtcttatgctgaagggcgttaaagaggatcaaaccaagtttctcaaaatcaagaccgtgagctctgagctgtcctgcagagaagggcagagctactggacaggatctttctcccccaaatgtctgagctctcggagatgccatcttgtcggcgagtgtcacgtgaaccgctgcctcagctggcgggacaatgaaacctccgccgagtttagcttcgttggggaatctacaacgatgagagagaacaagtgctttgagcagtgtggcggatggggctgcgggtgtttcaatgtgaacccttcctgcctgtttgtccatacctatctgcagagcgtgcgcaaggaagctctccgggtgttcaattgtattgactgggtccacaaactgacacttgagatcaccgattttgacggatccgtttctacaattgatctgggcgcgagctcctctagattcaccaactgggggagcgtgtccctctctctggacgccgaaggaatcagcggctccaatagcttttctttcattgagtcccccgggaagggctacgctatcgtggatgagccgttcagcgaaattcctcgccaaggatttctgggcgagatccggtgcaactctgaatccagcgtcctttctgcccacgagtcctgtctcagagcccccaatctgatcagctataaacccatgattgaccagctggaatgcacgaccaacctcatcgatcctttcgtggtttttgagcgcgggtccctgccgcagacacggaatgacaagaccttcgctgccagcaaaggaaacagaggcgtgcaggcgttttctaaggggagcgtccaagctgatcttacactgatgttcgacaattttgaggtggatttcgttggagccgccgtgtcctgtgacgctgcctttctcaacctgaccggctgctactcttgtaatgcgggggctcgcgtctgcctgagcattacgtccacaggcaccggaacactttctgcccataacaaggatggcagcctccacatcgtgctgccctccgaaaacgggaccaaagaccagtgccagattctgcatttcaccgttcctgaggtggaagaggaatttatgtattcttgtgacggagatgagcggcccctcctggtcaagggcacacttatcgccatcgaccctttcgatgacagacgggaggctgggggagaaagcacggtggtgaatcccaaatccggcagctggaactttttcgattggttctctggcctgatgtcctggtttgggggacctctcaagaccattctgctgatctgcctttacgtcgccctcagcattggcctgttctttctgctcatctacctggggcgcacaggactttctaaaatgtggctggctgccaccaagaaggcgtcctga

SEQ ID NO: 14568 - RNA, 3204 nt, synthetic construct
  misc_feature 1..3204: note = derived and/or modified CDS sequence (opt5) from RVFV(200803169)__JF311384.1__Gn-Gc
  source 1..3204: mol_type = other RNA
atggccggcatcgctatgacagtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttattttcgtgtttagctctaccgccatcatttgcctggctgtcctgtacagagtgctcaagtgtctgaaaatcgcgccccggaaggtgcttaaccctctgatgtggattacagccttcatccgctgggtttataaaaagatggtcgccagagtggctgataatatcaaccaggtgaatcgggaaattggatggatggagggcgggcagctcgccctgggcaaccccgctccgatccctcgccacgcccccattcctagatactccacctaccttatgctgctcctgatcgtcagctatgcgtccgcctgctctgaactgattcaggctagctcccggatcacaacctgttctacggagggagtgaacacaaagtgccgcctcagcggcaccgccctgatcagagctgggtccgttggagccgaagcctgtcttatgctgaaaggcgtgaaggtcgaccaaaccaaatttctcaagattaaaacagtgagctctgagctgtcctgccgggaggggcagagctactggaccggatctttctcccccaagtgtctgagctctagacgctgccatcttgttggcgaatgtcacgtgaatcggtgcctcagctggagagataacgagacatccgctgaatttagcttcgtcggggagtctacgaccatgcgcgaaaataaatgctttgagcagtgtggcggatggggctgcgggtgtttcaacgtgaatccttcctgcctgtttgttcatacatatctgcagagcgtgcggaaggaggcgctcagagtcttcaactgtatcgactgggtgcacaagctgacccttgaaattacagactttgatggatccgtgtctaccatcgacctgggcgccagctcctctcgcttcacgaattgggggagcgtctccctctctctggatgctgagggaattagcggctccaacagcttttctttcatcgaatcccccgggaaaggctacgccattgttgacgagccgttcagcgagatccctcggcaaggatttctgggcgaagtgagatgcaattctgagtccagcgtgctttctgcccacgaatcctgtctccgcgctcccaacctggtcagctataagcccatgatcgatcagctggagtgcaccacaaatctcattgaccctttcgtggtttttgaacgggggtccctgccgcagaccagaaacgataaaacattcgccgcgagcaagggaaatcgcggcgtgcaggctttttctaaagggagcgtccaagccgaccttaccctgatgttcgataactttgaggtggacttcgttggagccgctgtgtcctgtgatgccgcgtttctcaatctgacgggctgctactcttgtaacgctggggcccgggtctgcctgagcatcacatccaccggcacaggaaccctttctgcccataacaaggacggcagcctccacattgtgctgccctccgagaatgggaccaaggatcagtgccagatcctgcatttcacagttcctgaagtggaggaagagtttatgtattcttgtgacggagacgaaagacccctcctggtcaaaggcacgcttattgctatcgatcctttcgacgatcggcgcgaggccgggggagagagcaccgtggtgaaccccaagtccggcagctggaactttttcgactggttctctggcctgatgtcctggtttgggggacctctcaaaacaatcctgctgatttgcctttacgtcgctctcagcatcggcctgttctttctgctcatttacctggggagaaccggactttctaagatgtggctggccgcgaccaaaaaggcctcctga

SEQ ID NO: 14569 - RNA, 3204 nt, synthetic construct
  misc_feature 1..3204: note = derived and/or modified CDS sequence (opt5) from RVFV(2269/74)__DQ380222.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaacataagggaacaatggactctggccagaccaaacgggaactgaagtcctttgatatcagccagtgcccgaaaattgggggacacggctctaagaagtgcacaggcgacgctgccttctgttccgcctacgagtgcaccgctcagtacgcgaatgcctattgtagccacgctaacgggtccggaatcgttcaaatccaggtgtctggcgtgtggaaaaagcctctttgcgtcgggtacgaacgcgtggttgtgaaaagagagctgagcgccaagcccattcagcgggtcgaaccttgtacgacatgcatcaccaaatgtgagccccatggactcgtggttcgctccacaggctttaagattagctctgccgtggcttgcgcctccggggtctgtgtgaccggaagccaatctcccagcaccgagatcacactgaagtatcctggcatttcccagtctagcggcggggatatcggagtccacatggcgcatgacgatcagtccgtgagctctaaaattgttgctcactgcccgccccaggacccttgtcttgtgcatggctgcatcgtctgcgcccacgggctgatcaattaccaatgtcacacggccctctccgctttcgtggttgtgttcgtctttagctctgtggccattatctgcctggctattctgtataaggtgctcaaatgtctgaagatcgcccccaaaaaggttcttaaccctctgatgtggattaccgcgttcatcagatgggtctacaagaaaatggtggcccgggtggctgataatatcaaccaggtcaatcgcgaaattggatggatggagggcgggcagctcgccctgggcaaccccgctccgatccctagacatgcccccattcctcggtattccacataccttatgctgctcctgatcgtgagctacgcgtccgcctgctctgaactgattcaggctagctcccgcatcaccacatgttctaccgagggagttaacacgaagtgcagactcagcggcacagccctgatccgggctgggtccgtgggagccgaagcctgtcttatgctgaaaggcgtcaaggaggaccaaaccaaatttctcaagattaaaaccgtgagctctgagctgtcctgccgcgaagggcagagctattggacaggatctttctcccccaagtgtctgagctctagacggtgccaccttgttggcgagtgtcatgtgaatagatgcctcagctggcgcgataacgaaacctccgctgagtttagcttcgtcggggaatctacaacgatgcgggagaataagtgctttgagcagtgtggcggatggggctgcgggtgtttcaacgtgaatccttcctgcctgtttgttcacacctacctgcagagcgtgagaaaagaagcgctccgcgtcttcaactgtatcgactgggtgcacaagctgacacttgagattaccgactttgatggatccgtgtctacaatcgacctgggcgccagctcctctcggttcaccaattgggggagcgtctccctctctctggatgctgaaggaattagcggctccaacagcttttctttcatcgagtcccccgggaaaggctatgccattgttgacgagccgttcagcgaaatccctagacaaggatttctgggcgagatccgctgcaattctgaatccagcgtgctttctgcccatgagtcctgtctccgggctcccaacctgattagctacaagcccatgatcgatcagctggaatgcacgaccaatctcattgaccctttcgtggtctttgagagagggtccctgccgcagacacgcaacgataaaaccttcgccgcgagcaagggaaatcggggcgtgcaggctttttctaaggggagcgttcaagccgaccttacactgatgttcgataactttgaggtggacttcgtcggagccgctgtgtcctgtgatgccgcgtttctcaatctgaccggctgctattcttgtaacgctggggccagagtttgcctgagcatcacgtccacaggcaccggaacactttctgcccacaacaaagacggcagcctccatattgtgctgccctccgaaaatgggaccaaggatcagtgccagatcctgcacttcaccgtccctgaggtggaagaggaatttatgtactcttgtgacggagacgagcgccccctcctggttaaaggcacacttatcgctattgatcctttcgacgatcggagagaggccgggggagaaagcacggtggtcaaccccaagtccggcagctggaactttttcgactggttctctggcctgatgtcctggtttgggggacctctcaaaaccatcctgctgatttgcctttatgtggctctcagcatcggcctgttctttctgctcatttacctggggcggacaggactttctaagatgtggctggccgcgaccaagaaagcctcctga

SEQ ID NO: 14570 - RNA, 3204 nt, synthetic construct
  misc_feature 1..3204: note = derived and/or modified CDS sequence (opt5) from RVFV(SA-51 (Van Wyck))__DQ380195.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacgcggctctaagaagtgcacaggcgacgctgccttctgttccgcctacgagtgcaccgctcagtatgcgaatgcctactgtagccatgctaacgggtccggaatcgttcaaatccaggtgtctggcgtgtggaaaaagcctctttgcgtcgggtatgaaagagtggttgtgaaacgggagctgagcgccaagcccattcagcgcgtcgaaccttgtacgacatgcatcaccaaatgtgagccccacggactcgtggttagatccacaggctttaagattagctctgccgtggcttgcgcctccggggtctgtgtgaccggaagccaatctcccagcaccgagatcacactgaagtaccctggcatttcccagtctagcggcggggatatcggagtccacatggcgcatgacgatcagtccgtgagctctaaaattgttgctcactgcccgccccaggacccttgtcttgtgcatggctgcatcgtctgcgcccacgggctgatcaattatcaatgtcatacggccctctccgctttcgtggttgtgttcgtctttagctctgtggccattatctgcctggctattctgtacaaggtgctcaaatgtctgaagatcgcgccccggaaagttcttaaccctctgatgtggattaccgccttcatccgctgggtctataagaagatggtggccagagtggctgataatatcaaccaggtcaatcgggaaattggatggatggagggcgggcagctcgccctgggcaaccccgctccgatccctcgccacgcccccattcctagatactccacataccttatgctgctcctgatcgtgagctatgcgtccgcctgctctgaactgattcaggctagctcccggatcaccacatgttctaccgagggagttaacacgaaatgccgcctcagcggcacagccctgatcagagctgggtccgtgggagccgaagcctgtcttatgctgaagggcgtcaaagaggaccaaaccaagtttctcaaaattaagaccgtgagctctgagctgtcctgccgggaagggcagagctactggacaggatctttctcccccaaatgtctgagctctagacgctgccaccttgttggcgagtgtcatgtgaatcggtgcctcagctggagagataacgaaacctccgctgagtttagcttcgtcggggaatctacaacgatgcgcgagaataagtgctttgagcagtgtggcggatggggctgcgggtgtttcaacgtgaatccttcctgcctgtttgttcacacctatctgcagagcgtgcggaaggaagcgctcagagtcttcaactgtatcgactgggtgcataaactgacacttgaggtgaccgactttgatggatccgtctctacaattgacctgggcgccagctcctctcgcttcaccaattgggggagcgtttccctctctctggatgctgaaggaatcagcggctccaacagcttttctttcattgagtcccccgggaagggctacgccatcgtggacgagccgttcagcgaaattcctcggcaaggatttctgggcgagatcagatgcaattctgaatccagcgtgctttctgcccacgagtcctgtctccgcgctcccaacctgatcagctataaacccatgattgatcagctggaatgcacgaccaatctcatcgaccctttcgtcgtgtttgagcgggggtccctgccgcagacaagaaacgataagaccttcgccgcgagcaaaggaaatcgcggcgttcaggctttttctaaggggagcgtgcaagccgaccttacactgatgttcgataactttgaggtcgacttcgtgggagccgctgtttcctgtgatgccgcgtttctcaatctgaccggctgctactcttgtaacgctggggcccgggtgtgcctgagcattacgtccacaggcaccggaacactttctgcccacaacaaggacggcagcctccatatcgtcctgccctccgaaaatgggaccaaagatcagtgccagattctgcacttcaccgtgcctgaggttgaagaggaatttatgtattcttgtgacggagacgagagacccctcctggtgaagggcacacttatcgctatcgatcctttcgacgatcggcgcgaggccgggggagaaagcacggtcgtgaaccccaaatccggcagctggaactttttcgactggttctctggcctgatgtcctggtttgggggacctctcaagaccattctgctgatctgcctttacgtggctctcagcattggcctgttctttctgctcatctacctggggagaacaggactttctaaaatgtggctggccgcgaccaagaaggcctcctga

SEQ ID NO: 14571 - RNA, 3204 nt, synthetic construct
  misc_feature 1..3204: note = derived and/or modified CDS sequence (opt5) from RVFV(OS-8)__DQ380185.1__Gn-Gc
  source 1..3204: mol_type = other RNA
atggccggcatcgctatgacagtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggagttgtgcaaatccaggtgtctggcgtctggaaaaagcctctttgcgtggggtatgaacgcgttgtggtcaaaagagagctgagcgccaagcccatccagcgggtggaaccttgtacgacatgcattaccaaatgtgagccccacggactcgttgtgcgctccacaggctttaagatcagctctgccgtcgcttgcgcctccggggtgtgtgtcaccggaagccaatctcccagcaccgagattacactgaagtaccctggcatctcccagtctagcggcggggatattggagtgcatatggcgcacgacgatcagtccgttagctctaaaatcgtggctcattgcccgccccaggacccttgtcttgtccacggctgcattgtgtgcgcccatgggctgatcaattatcaatgtcacacggccctctccgctttcgttgtggtcttcgtgtttagctctgtggccatcatttgcctggctatcctgtacaaggttctcaaatgtctgaagattgcccccagaaaagtccttaaccctctgatgtggatcaccgcgttcattcggtgggtgtataagaagatggtggcccgcgtcgctgataatatcaaccaggtgaatagagaaatcggatggatggagggcgggcagctcgccctgggcaaccccgctccgattcctcggcacgcccccatccctcgctactccacataccttatgctgctcctgattgttagctatgcgtccgcctgctctgaactgatccaggctagctccagaattaccacatgttctaccgagggagtgaacacgaaatgccggctcagcggcacagccctgatccgcgctgggtccgtcggagccgaagcctgtcttatgctgaagggcgtgaaagaggaccaaaccaagtttctcagaatcaaaaccgttagctctgagctgtcctgccgggaagggcagagctactggacaggatctttctcccccaagtgtctgagctctagacgctgccatcttgtgggcgagtgtcacgtcaatcggtgcctcagctggagagataacgaaacctccgctgagtttagcttcgtgggggaatctacaacgatgcgcgagaataaatgctttgagcagtgtggcggatggggctgcgggtgtttcaacgttaatccttcctgcctgtttgtgcatacctatctgcagagcgtccggaaggaagcgctcagagtgttcaactgtattgactgggtgcacaagctgacacttgagatcaccgactttgatggatccgtctctacaattgacctgggcgccagctcctctcgcttcaccaattgggggagcgtttccctctctctggatgctgaaggaatcagcggctccaacagcttttctttcattgagtcccccgggaaaggctacgccatcgtggacgagccgttcagcgaaattcctcggcaaggatttctgggcgagatcagatgcaattctgaatccagcgtgctttctgcccacgagtcctgtctccgcgctcccaacctgatcagctataagcccatgattgatcagctggaatgcacgaccaatctcatcgaccctttcgtcgtgtttgagcgggggtccctgccgcagacaagaaacgataaaaccttcgccgcgagcaagggaaatcgcggcgttcaggctttttctaaagggagcgtgcaagccgaccttacactgatgttcgataactttgaggtcgacttcgtgggagccgctgtttcctgtgatgccgcgtttctcaatctgtctggctgctacagctgtaacgctggggcccgggtgtgcctgtccattacctctacgggcacaggaacccttagcgcccataacaaggacggctccctccacatcgtcctgccctctgaaaatgggacaaaggatcagtgccagattctgcatttcaccgtgcctgaggttgaagaggaatttatgtatagctgtgacggagacgagagacccctcctggtgaaaggcacccttatcgctatcgatcctttcgacgatcggcgcgaggccgggggagaatccacagtcgtgaaccccaagagcggctcttggaactttttcgactggttctccggcctgatgagctggtttgggggacctctcaaaacgattctgctgatctgcctttacgtggctctctctattggcctgttctttctgctcatctacctggggagaaccggactttccaagatgtggctggccgcgaccaaaaaggccagctga

SEQ ID NO: 14572 - RNA, 3204 nt, synthetic construct
  misc_feature 1..3204: note = derived and/or modified CDS sequence (opt5) from RVFV(KEN07-KUR340)__EF460404.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttattttcgtgtttagctctaccgccatcatttgcctggctgtcctgtacagaatgctcaagtgtctgaaaatcgcgccccggattgtgcttaaccctctgatgtggatcacagccttcatccgctgggtgtataagaaaatggttgccagagtcgctgataatattaaccaggtgaatcgggaaatcggatggatggagggcgggcagctcgccctgggcaaccccgctccgattcctcgccacgcccccatccctagatactccacctaccttatgctgctcctgattgtgagctatgcgtccgcctgctctgaactgatccaggctagctcccggatcacaacctgttctacggagggagtcaacacaaagtgccgcctcagcggcaccgccctgattagagctgggtccgtgggagccgaagcctgtcttatgctgaagggcgttaaagaggaccaaaccaagtttctcaaaatcaagacagtgagctctgagctgtcctgccgggaagggcagagctactggaccggatctttctcccccaaatgtctgagctctagacgctgccatcttgtcggcgagtgtcacgtgaatcggtgcctcagctggagagataacgaaacatccgctgagtttagcttcgttggggaatctacgaccatgcgcgagaataagtgctttgagcagtgtggcggatggggctgcgggtgtttcaacgtgaatccttcctgcctgtttgtccatacatatctgcagagcgtgcggaaagaagcgctcagagttttcaactgtattgactgggtgcacaagctgacccttgagatcacagactttgatggatccgtctctaccattgacctgggcgccagctcctctcgcttcacgaattgggggagcgtgtccctctctctggatgctgaaggaatcagcggctccaacagcttttctttcattgagtcccccgggaagggctacgccatcgtggacgagccgttcagcgaaatccctcggcaaggatttctgggcgagattagatgcaattctgaatccagcgtcctttctgcccacgagtcctgtctccgcgctcccaacctggttagctataaacccatgatcgatcagctggaatgcaccacaaatctcattgaccctttcgtggtgtttgagcgggggtccctgccgcagaccagaaacgataagacattcgccgcgagcaaaggaaatcgcggcgtccaggctttttctaaggggagcgtgcaagccgaccttaccctgatgttcgataactttgaggttgacttcgtgggagccgctgtctcctgtgatgccgcgtttctcaatctgacgggctgctactcttgtaacgctggggcccgggtgtgcctgagcatcacatccaccggcacaggaaccctttctgcccataacaaagacggcagcctccacattgttctgccctccgaaaatgggaccaaggatcagtgccagatcctgcatttcacagtgcctgaggtcgaagaggaatttatgtattcttgtgacggagacgagagacccctcctggtgaagggcacgcttatcgctattgatcctttcgacgatcggcgcgaggccgggggagaaagcaccgttgtgaaccccaaatccggcagctggaactttttcgactggttctctggcctgatgtcctggtttgggggacctctcaagacaatcctgctgatttgcctttacgtcgctctcagcatcggcctgttctttctgctcatttacctggggagaaccggactttctaaaatgtggctggccgcgacaaagaaagcctcctga

SEQ ID NO: 14573 - RNA, 3204 nt, synthetic construct
  misc_feature 1..3204: note = derived and/or modified CDS sequence (opt5) from RVFV(ANK-3837)__DQ380215.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaaaactggactctggccagacaaagcgggaacttaaatcctttgatatcagccagtgcccgaagattgggggacatggctctaagaaatgcaccggcgacgctgccttctgttccgcctacgagtgcacagctcagtatgcgaatgcctactgtagccacgctaacgggtccggaatcgttcaaatccaggtgtctggcgtgtggaagaaacctctgtgcgtcgggtatgaacgcgtggttgtgaagagagagctcagcgccaaacccattcagcgggtcgaaccttgtaccacgtgcatcacaaagtgtgagccccacggactggtggttcgctccaccggctttaagattagctctgccgtggcttgcgcctccggggtctgtgtgacaggaagccaatctcccagcaccgagatcacccttaaataccctggcatttcccagtctagcggcggggatatcggagtccatatggcgcacgacgatcagtccgtgagctctaagattgttgctcattgcccgccccaggacccttgtctggtgcacggctgcatcgtctgcgcccatgggctcatcaattatcaatgtcacacagccctgtccgctttcgtggttgtgttcgtctttagctctattgccatcatttgcctggctatcctctacagagtgctgaaatgtcttaagattgctccccggaaagtgctgaaccctctcatgtggatcacggcgttcatccgctgggtttatagaaagatggtcgcccgggtggctgataatattaaccaggtgaatcgcgaaatcggatggatggagggcgggcagctggtccttggcaaccccgccccgattcctagacacgtgcccatccctcggtactccacctacctgatgctcctgctgattgttagctatgcttccgcctgctctgaactcatccaggcgagctcccgcatcacaacctgttctacagagggagtgaacaccaagtgcagactgagcggcacggcccttattcgggctgggtccgtcggagccgaagcctgtctgatgctcaaaggcgtgaaggaggaccaaacaaaatttctgaagatcaaaaccgttagctctgagctgtcctgcagagaagggcagagctactggaccggatctttctcccccaagtgtcttagctctcgccggtgccatctcgtgggcgagtgtcacgtcaatagatgcctgagctggcgcgataacgaaacatccgccgagtttagcttcgtgggggaatctaccacaatgcgggagaataaatgctttgagcagtgtggcggatggggctgcgggtgtttcaacgttaatccttcctgcctgtttgtgcatacgtatctccagagcgtcagaaaggaagccctgcgcgtgttcaactgtattgactgggtgcacaaacttaccctggagatcacagactttgatggatccgtctctaccattgacctcggcgctagctcctctcggttcacaaattgggggagcgtttccctgtctctggatgcggaaggaatcagcggctccaacagcttttctttcattgagtcccccgggaagggctacgccatcgtggacgagccgttcagcgaaatccctagacaaggatttcttggcgagattcgctgcaattctgaatccagcgtgctctctgctcacgagtcctgtctgcgggcccccaacctgatcagctataagcccatgattgatcagctcgaatgcaccacgaatctgatcgaccctttcgtcgtgtttgagagagggtcccttccgcagacccgcaacgataaaacattcgccgctagcaagggaaatcggggcgttcaggccttttctaaagggagcgtgcaagcggacctgaccctcatgttcgataactttgaggtcgacttcgtgggagctgccgtttcctgtgatgccgcttttctgaatctgacaggctgctactcttgtaacgccggggcgagagtgtgccttagcattacctccacgggcacaggaaccctctctgctcataacaaggacggcagcctgcacatcgtcctgccctccgaaaatgggacaaaggatcagtgccagatcctccatttcaccgtgcctgaggttgaagaggaatttatgtattcttgtgacggagacgagcggcccctgcttgtgcgcggcaccctgattgccatcgatcctttcgacgatagacgggaggccgggggagaaagcacagtcgtgaaccccaaatccggcagctggaactttttcgactggttctctggcctcatgtcctggtttgggggacctctgaagacgattctgcttatctgcctctacgtggctctgagcattggcctgttctttctcctgatctaccttgggagaaccggactgtctaaaatgtggctcgccgctacaaagaaagcctcctga

SEQ ID NO: 14574 - RNA, 3204 nt, synthetic construct
  misc_feature 1..3204: note = derived and/or modified CDS sequence (opt5) from RVFV(Lunyo)__KU167026.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggtttctggccagaccaaacgggaactgaagtcctttgacatcagccagtgcccgaaaattgggggacatggctctaagaagtgcacaggcgatgctgccttctgttccgcctacgagtgcaccgctcagtatgcgaatgcctactgtagccacgctaacgggtccggaatcgtgcaaatccaggtgtctggcgtctggaaaaagcctctttgcgtggggtatgaacgcgttgtggtcaaaagagagctgagcgccaagcccattcagcgggtggaaccttgtacgacatgcatcaccaaatgtgagccccacggactcgttgtgcgctccacaggctttaagattagctctgccgtcgcttgcgcctccggggtgtgtgtcaccggaagccaatctcccagcaccgagatcacactgaagtaccctggcatttcccagtctagcggcggggacatcggagtgcatatggcgcacgatgaccagtccgttagctctaaaattgtggctcattgcccgccccaggatccttgtcttgtccacggctgcatcgtgtgcgcccatgggctgatcaattatcaatgtcacacggccctctccgctttcgttgtggtcttcgtgtttagctctgtggccattatctgcctggctattctgtacaaggttctcaaatgtctgaagatcgcccccagaaaagtccttaaccctctgatgtggattaccgcgttcatccggtgggtgtataagaagatggtggcccgcgtcgctgacaatatcaaccaggtgaatagagaaattggatggatggagggcgggcagctcgccctgggcaaccccgctccgatccctcggcacgcccccattcctcgctactccacataccttatgctgctcctgatcgttagctatgcgtccgcctgctctgaactgattcaggctagctccagaatcaccacatgttctaccgagggagtgaacacgcggtgccgcctcagcggcacagccctgatcagagctgggtccgtcggagccgaagcctgtcttatgctgaaaggcgtgaaggaggatcaaaccaaatttctcaagattaaaaccgttagctctgagctgtcctgccgggaagggcagagctactggacaggatctttctcccccaagtgtctgagctctagacgctgccatcttgtgggcgagtgtcacgtcaatcggtgcctcagctggagagacaacgaaacctccgctgagtttagcttcgtgggggaatctacaacgatgcgcgagaataaatgctttgagcagtgtggcggatggggctgcgggtgtttcaacgttaatccttcctgcctgtttgtgcatacctatctgcagagcgtccggaaggaagcgctcagagtgttcaactgtatcgattgggtgcacaagctgacacttgagattaccgactttgacggatccgtctctacaatcgatctgggcgccagctcctctcgcttcaccaattgggggagcgtttccctctctctggacgctgaaggaattagcggctccaacagcttttctttcatcgagtcccccgggaaaggctacgccattgtggatgagccgttcagcgaaatccctcggcaaggatttctgggcgagatcagatgcaattctgaatccagcgtgctttctgcccacgagtcctgtctccgcgctcccaacctgattagctataagcccatgatcgaccagctggaatgcacgaccaatctcattgatcctttcgtcgtgtttgagcgggggtccctgccgcagacaagaaacgacaaaaccttcgccgcgagcaagggaaatcgcggcgttcaggctttttctaaagggagcgtgcaagccgatcttacactgatgttcgacaactttgaggtcgatttcgtgggagccgctgtttcctgtgacgccgcgtttctcaatctgaccggctgctactcttgtaacgctggggcccgggtgtgcctgagcatcacgtccacaggcaccggaacactttctgcccataacaaggatggcagcctccacattgtcctgccctccgaaaatgggaccaaggaccagtgccagatcctgcatttcaccgtgcctgaggttgaagaggaatttatgtattcttgtgatggagacgagagacccctcctggtgaaaggcacacttatcgctattgaccctttcgatgaccggcgcgaggccgggggagaaagcacggtcgtgaaccccaagtccggcagctggaactttttcgattggttctctggcctgatgtcctggtttgggggacctctcaaaaccatcctgctgatttgcctttacgtggctctcagcatcggcctgttctttctgctcatttacctggggagaacaggactttctaagatgtggctggccgcgaccaaaaaggcctcctga

SEQ ID NO: 14575 - RNA, 3204 nt, synthetic construct
  misc_feature 1..3204: note = derived and/or modified CDS sequence (opt5) from RVFV(200803167)__JF311382.1__Gn-Gc
  source 1..3204: mol_type = other RNA
atggccggcatcgctatgaccgtgctgcccgccctcgcggtcttcgctctggcccctgttgtgtttgccgaggaccttcacctgagaaatcggccggggaagggacataattacattgatggcatgacacaggaagacgctacgtgcaaacccgtgacctatgccggggcttgtagctccttcgatgtcctcctggagaagggaaaatttcctcttttccaatcttacgcccaccatcgcacactgctcgaagcggtgcacgacaccatcattgccaaggctgatccccctagctgcgacctgcagtccgcccatggcaacccctgtatgaaagagaagctggttatgaagacacactgccctaatgattatcagtctgctcactacctcaacaatgacgggaaaatggccagcgtgaagtgtccgcccaaatatgaactgaccgaggattgcaacttttgtagacagatgacaggagcgtcccttaagaaaggctcttaccctctgcaagacctcttctgccagagctccgaggatgacggcagcaagctgaagaccaaaatgaagggggtctgtgaagtgggagttcaggcccttaaaaagtgcgatggccagctgtctacggctcatgaggtggtcccctttgccgtgttcaaaaattccaagaaagtgtatctcgacaagctggacctgaagaccgaagagaacctcctgcctgatagctttgtctgtttcgagcacaaagggcaatacaagggaacaatggactctggccagaccaaacgggaacttaagtcctttgatatcagccagtgccccaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagccgctgtgcgtcgggtatgaacgcgtggttgtgaaaagagagctcagcgccaagcctattcagcgggtcgaaccctgtacgacatgcatcaccaaatgtgagcctcacggactggtggttcgctccacaggctttaagattagctctgccgtggcttgcgcctccggggtctgtgtgaccggaagccaatctcccagcaccgagatcgcgcttaagtaccccggcatttcccagtctagcggcggggatatcggagtccatatggctcacgacgatcagtccgtgagctctaaaattgttgcccattgccctccgcaggacccctgtctggtgcacggctgcatcgtctgcgcccatgggctcatcaattatcaatgtcacacagctctgtccgccttcgtggttgtgttcgtctttagctctattgctatcatttgcctggccatcctctacagagtgctgaagtgtcttaaaattgcgcctcggaaggtgctgaaccccctcatgtggatcacggccttcatccgctgggtttataaaaagatggtcgctagagtggccgataatattaaccaggtgaatcgggaaatcggatggatggagggcgggcagctggtccttggcaaccctgctcccattccgcgccacgcccctatccccagatactccacctacctgatgctcctgctgattgtgagctatgcgtccgcctgctctgaactcatccaggctagctcccggatcacaacctgttctacagagggagttaacaccaagtgccgcctgagcggcacggcccttattagagctgggtccgtgggagccgaagcctgtctgatgctcaaaggcgtcaaggaggaccaaacaaaatttctgaagatcaaaaccgtgagctctgagctgtcctgccgggaagggcagagctactggaccggatctttctcccctaagtgtcttagctctagacgctgccatctcgttggcgagtgtcacgtgaatcggtgcctgagctggagagataacgaaacatccgctgagtttagcttcgtcggggaatctaccacaatgcgcgagaataaatgctttgagcagtgtggcggatggggctgcgggtgtttcaacgtgaatccctcctgcctgtttgttcatacgtatctccagagcgtgcggaaggaagcgctgagagtcttcaactgtattgactgggtgcacaaacttaccctggagatcacagactttgatggatccgtgtctaccattgacctcggcgccagctcctctcgcttcacaaattgggggagcgtctccctgtctctggatgctgaaggaatcagcggctccaacagcttttctttcattgagtcccctgggaaaggctacgccatcgttgacgagcccttcagcgaaatcccgcggcaaggatttcttggcgagattagatgcaattctgaatccagcgtgctctctgcccacgagtcctgtctgcgcgctcctaacctgatcagctataagcccatgattgatcagctcgaatgcaccacgaatctgatcgaccccttcgtggtctttgagcgggggtcccttcctcagaccagaaacgataaaacattcgccgcgagcaagggaaatcgcggcgtgcaggctttttctaaagggagcgttcaagccgacctgaccctcatgttcgataactttgaggtggacttcgtcggagccgctgtgtcctgtgatgccgcgtttctgaatctgacaggctgctactcttgtaacgctggggcccgggtttgccttagcattacctccacgggcacaggaaccctctctgcccataacaaggacggcagcctgcacatcgtgctgccgtccgaaaatgggacaaaggatcagtgccagatcctccatttcaccgtccccgaggtggaagaggaatttatgtattcttgtgacggagacgagagacctctgcttgttaaaggcaccctgattgctatcgatcccttcgacgatcggcgcgaggccgggggagaaagcacagtggtcaaccctaagtccggcagctggaactttttcgactggttctctggcctcatgtcctggtttgggggacccctgaaaacgatgctgcttatttgcctctacgtggctctgagcatcggcctgttctttctcctgatttaccttgggagaaccggactgtctaagatgtggctcgccgcgacaaagaaggcctcctga

SEQ ID NO: 14576 - RNA, 3204 nt, synthetic construct
  misc_feature 1..3204: note = derived and/or modified CDS sequence (opt5) from RVFV(2373/74)__DQ380194.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaatggttgctcattgcccgccccaggacccttgtcttgtgcacggctgcattgtctgcgcccatgggctgatcaattatcaatgtcacacggccctctccgctttcgtggttgtgttcgtctttagctctgtggccatcatttgcctggctatcctgtacaaggtgctcaaatgtctgaagattgcccccagaaaagttcttaaccctctgatgtggatcaccgcgttcattcggtgggtctataagaagatggtggcccgcgtggctgataatatcaaccaggtcaatagagaaatcggatggatggagggcgggcagctcgccctgggcaaccccgctccgattcctcggcacgcccccatccctcgctactccacataccttatgctgctcctgattgtgagctatgcgtccgcctgctctgaactgatccaggctagctccagaattaccacatgttctaccgagggagttaacacgaaatgccggctcagcggcacagccctgatccgcgctgggtccgtgggagccgaagcctgtcttatgctgaagggcgtcaaagaggaccaaaccaagtttctcaaaatcaagaccgtgagctctgagctgtcctgcagagaagggcagagctactggacaggatctttctcccccaaatgtctgagctctcggagatgccatcttgttggcgagtgtcacgtgaatcgctgcctcagctggcgggataacgaaacctccgctgagtttagcttcgtcggggaatctacaacgatgagagagaataagtgctttgagcagtgtggcggatggggctgcgggtgtttcaacgtgaatccttcctgcctgtttgttcatacctatctgcagagcgtgcgcaaggaagcgctccgggtcttcaactgtattgactgggtgcacaaactgacacttgagatcaccgactttgatggatccgtgtctacactggacctcggcgccagctcctctagattcaccaattgggggagcgtctccctgtctctggatgctgaaggaattagcggctccaacagcttttctttcatcgagtcccccgggaagggctacgccattgttgacgagccgttcagcgaaatccctcgccaaggatttcttggcgagattcggtgcaattctgaatccagcgtgctctctgcccacgagtcctgtctgagagctcccaacctgatcagctataaacccatgatcgatcagctcgaatgcacgaccaatctgattgaccctttcgtggtctttgagcgcgggtcccttccgcagacacggaacgagaagaccttcgccgcgagcaaaggaaatagaggcgtgcaggctttttctaaggggagcgttcaagccgatctgacactcatgttcgacaactttgaagtggatttcgtcggagccgctgtgtcctgtgacgccgcgtttctgaatctgaccggctgctactcttgtaacgctggggcccgcgtttgccttagcatcacgtccacaggcaccggaacactctctgcccataacaaggatggcagcctgcacattgtgctgccctccgagaatgggaccaaagaccagtgccagatcctccatttcaccgtccctgaagtggaggaagagtttatgtattcttgtgatggagacgagcggcccctgcttgttaagggcacactgattgctatcgaccctttcgatgacagacgggaagccgggggagagagcacggtggtcaaccccaaatccggcagctggaactttttcgattggttctctggcctcatgtcctggtttgggggacctctgaagaccatcctgcttatttgcctctacgtggctctgagcatcggcctgttctttctcctgatttaccttgggcgcacaggactgtctaaaatgtggctcgccgcgaccaagaaggcctcctga

SEQ ID NO: 14577 - RNA, 3204 nt, synthetic construct
  misc_feature 1..3204: note = derived and/or modified CDS sequence (opt5) from RVFV(Kenya 57 (Rintoul))__DQ380192.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagatcaaacgggaactgaagtcctttgatattagccagtgcccgaaaatcgggggacatggctctaagaagtgcaccggcgacgctgccttctgttccgcctacgagtgcacagctcagtatgcgaatgcctactgtagccacgctaacgggtccggaatcgttcaaattcaggtgtctggcgtgtggaaaaagcctctttgcgtcgggtatgaacgcgtggttgtgaaaagagagctgagcgccaagcccatccagcgggtcgaaccttgtaccacgtgcattacaaaatgtgagccccacggactcgtggttcgctccaccggctttaagatcagctctgccgtggcttgcgcctccggggtctgtgtgacaggaagccaatctcccagcaccgagattaccctgaagtaccctggcatctcccagtctagcggcggggatattggagtccatatggcgcacgacgatcagtccgtgagctctaaaatcgttgctcattgcccgccccaggacccttgtcttgtgcacggctgcatcgtctgcgcccatgggctgattaattatcaatgtcacacagccctctccgctttcgtggttgtgttcgtctttagctctgtggccatcatttgcctggctatcctgtacaaggtgctcaaatgtctgaagattgcccccagaaaagttcttaaccctctgatgtggatcacggcgttcatccggtgggtctataagaagatggtggcccgcgtggctgataatattaaccaggtcaatagagaaatcggatggatggagggcgggcagctcgtgctgggcaaccccgccccgattcctcggcacgctcccatccctcgctactccacctaccttatgctgctcctgattgttagctatgcctccgcgtgctctgaactgatccaggccagctccagaatcacaacctgttctacagagggagtgaacaccaaatgccggctcagcggcacggctctgattcgcgccgggtccgtcggagctgaagcctgtcttatgctgaagggcgtgaaagaggaccaaacaaagtttctcaaaatcaagaccgttagctctgagctgtcctgcagagaagggcagagctactggaccggatctttctcccccaaatgtctgagctctcggagatgccatcttgtgggcgagtgtcacgtcaatcgctgcctcagctggcgggataacgaaacatccgccgagtttagcttcgtgggggaatctaccacaatgagagagaataagtgctttgagcagtgtggcggatggggctgcgggtgtttcaacgttaatccttcctgcctgtttgtgcatacgtatctgcagagcgtccgcaaggaagctctccgggtgttcaactgtattgactgggtgcacaaactgacccttgagatcacagactttgatggatccgtctctaccgttgacctgggcgcgagctcctctagattcacaaattgggggagcgtgtccctctctctggatgccgaaggaattagcggctccaacagcttttctttcatcgagtcccccgggaagggctacgctattgtggacgagccgttcagcgaaatctctcgccaaggatttctgggcgagatccggtgcaattccgaaagctctgtcctttccgcccacgagagctgtctcagagcccctaacctgatttcctataaacccatgatcgatcagctggaatgcaccacgaatctcattgaccccttcgtggtttttgagcgcgggagcctgcctcagacccggaacgataagacattcgctgcctctaaaggaaatagaggcgtgcaggcgtttagcaaggggtccgtccaagctgaccttaccctgatgttcgataactttgaggtggacttcgttggagccgccgtgtcttgtgatgctgcctttctcaatctgacaggctgctacagctgtaacgcgggggctcgcgtctgcctgtccatcacctctacgggcacaggaacccttagcgcccataacaaggacggctccctccacattgtgctgccgtctgaaaatgggacaaaagatcagtgccagatcctgcatttcaccgttcccgaggtggaagaggaatttatgtatagctgtgacggagacgagcggcctctcctggtcaagggcacccttatcgccattgatcccttcgacgatagacgggaggctgggggagaatccacagtggtgaaccctaaaagcggctcttggaactttttcgactggttctccggcctgatgagctggtttgggggacccctcaagacgatcctgctgatttgcctttacgtcgccctctctatcggcctgttctttctgctcatttacctggggcgcaccggactttccaaaatgtggctggctgccacaaagaaggcgagctga

SEQ ID NO: 14578 - RNA, 3204 nt, synthetic construct
  misc_feature 1..3204: note = derived and/or modified CDS sequence (opt5) from RVFV(RVFBJ01/2016)__KX785331.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaacatgaactcaccgaggattgcaacttttgtagacagatgacaggagcgtccctgaagaaaggctcttatccccttcaagacctgttctgccagagctccgaggatgacggcagcaagctcaagaccaaaatgaagggggtctgtgaagtgggagttcaggccctgaaaaagtgcgatggccagctttctacggctcacgaggtggtcccttttgccgtgttcaaaaattccaagaaagtgtacctggacaagctcgacctgaagaccgaagagaacctgctccccgatagctttgtctgtttcgagcataaagggcaatataagggaacaatggactctggccagaccaaacgggaactgaagtcctttgatatcagccagtgcccgaaaattgggggacacggctctaagaagtgcacaggcgacgctgccttctgttccgcctacgagtgcaccgctcagtacgcgaatgcctattgtagccacgctaacgggtccggaatcgttcaaatccaggtgtctggcgtgtggaaaaagcctctttgcgtcgggtacgaacgcgtggttgtgaaaagagagctgagcgccaagcccattcagcgggtcgaaccttgtacgacatgcatcaccaaatgtgagccccatggactcgtggttcgctccacaggctttaagattagctctgccgtggcttgcgcctccggggtctgtgtgaccggaagccaatctcccagcaccgagatcacactgaagtatcctggcatttcccagtctagcggcggggatatcggagtccacatggcgcatgacgatcagtccgtgagctctaaaattgttgctcactgcccgccccaggacccttgtcttgtgcatggctgcatcgtctgcgcccacgggctgatcaattaccaatgtcacacggccctctccgctttcgtggttgtgttcgtctttagctctgtggccattatctgcctggctattctgtataaggtgctcagatgtctgaaaatcgcccccaagaaagttcttaaccctctgatgtggattaccgcgttcatccggtgggtctacaagaagatggtggcccgcgtggctgataatatcaaccaggtcaatagagaaattggatggatggagggcgggcagctcgccctgggcaaccccgctccgatccctcggcatgcccccattcctcgctattccacataccttatgctgctcctgatcattagctacgcgtccgcctgctctgaactgatccaggctagctccagaatcaccacatgttctaccgagggagtgaacacgaaatgccggctcagcggcacagccctgattcgcgctgggtccgttggagccgaagcctgtcttatgctgaagggcgtgaaagaggaccaaaccaagtttctcaaaatcaagaccgtcagctctgagctgtcctgcagagaagggcagagctattggacaggatctttctcccccaaatgtctgagctctcggagatgccaccttgtgggcgagtgtcatgttaatcgctgcctcagctggcgggataacgaaacctccgctgagtttagcttcgtgggggaatctacaacgatgagagagaataagtgctttgagcagtgtggcggatggggctgcgggtgtttcaacgtcaatccttcctgcctgtttgtgcacacctacctgcagagcgttcgcaaggaagcgctccgggtgttcaactgtattgactgggtccacaaactgacacttgagatcaccgactttgatggatccgtgtctacaattgacctgggcgccagctcctctagattcaccaattgggggagcgtgtccctctctctggatgctgaaggaatcagcggctccaacagcttttctttcattgagtcccccgggaagggctatgccatcgtcgacgagccgttcagcgaaatccctcgccaaggatttctgggcgagattcggtgcaattctgaatccagcgttctttctgcccatgagtcctgtctcagagctcccaacctgatcagctacaaacccatgattgatcagctggaatgcacgaccaatctcatcgaccctttcgtggtgtttgagcgcgggtccctgccgcagacacggaacgataagaccttcgccgcgagcaaaggaaatagaggcgtccaggctttttctaaggggagcgtgcaagccgaccttacactgatgttcgataactttgaggttgacttcgtgggagccgctgtctcctgtgatgccgcgtttctcaatctgaccggctgctattcttgtaacgctggggcccgcgtgtgcctgagcattacgtccacaggcaccggaacactttctgcccacaacaaggacggcagcctccatatcgttctgccctccgaaaatgggaccaaagatcagtgccagatcctgcacttcaccgtgcctgaggtcgaagaggaatttatgtactcttgtgacggagacgagcggcccctcctggtgaagggcacacttattgctatcgatcctttcgacgatagacgggaggccgggggagaaagcacggttgtgaaccccaaatccggcagctggaactttttcgactggttctctggcctgatgtcctggtttgggggacctctcaagaccattctgctgatctgcctttatgtcgctctcagcattggcctgttctttctgctcatctacctggggcgcacaggactttctaaaatgtggctggccgcgaccaagaaggcctcctga

SEQ ID NO: 14579 - RNA, 3204 nt, synthetic construct
  misc_feature 1..3204: note = derived and/or modified CDS sequence (opt5) from RVFV(clone 13)__DQ380213.1__Gn-Gc
  source 1..3204: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaacatgaactcaccgaggattgcaacttttgtagacagatgacaggagcgtccctgaagaaaggctcttatccccttcaagacctgttctgccagagctccgaggatgacggcagcaagctcaagaccaaaatgaagggggtctgtgaagtgggagttcaggccctgaaaaagtgcgatggccagctttctacggctcacgaggtggtcccttttgccgtgttcaaaaattccaagaaagtgtacctggacaagctcgacctgaagaccgaagagaacctgctccccgatagctttgtctgtttcgagcataaagggcaatataagggaacaatggactctggccagaccaaacgggaactgaagtcctttgatatcagccagtgcccgaaaattgggggacacggctctaagaagtgcacaggcgacgctgccttctgttccgcctacgagtgcaccgctcagtacgcgaatgcctattgtagccacgctaacgggtccggaatcgttcaaatccaggtgtctggcgtgtggaaaaagcctctttgcgtcgggtacgaacgcgtggttgtgaaaagagagctgagcgccaagcccattcagcgggtcgaaccttgtacgacatgcatcaccaaatgtgagccccatggactcgtggttcgctccacaggctttaagattagctctgccgtggcttgcgcctccggggtctgtgtgaccggaagccaaaatccctctaccgagatcacactgaagtatcctggcattagccagtcctctggcggggatatcggagtccacatggcgcatgacgatcagagcgtgtccagcaaaattgttgctcactgcccgccccaggacccttgtcttgtgcatggctgcatcgtctgcgcccacgggctgatcaactaccaatgtcacacggccctctctgctttcgtggttgtgttcgtcttttccagcattgccatcatttgcctggctatcctgtatagagtgctcaagtgtctgaaaattgcgccccggaaggtgcttaatcctctgatgtggatcaccgccttcatccgctgggtttacaaaaagatggtcgccagagtggctgataacattaatcaggtgaaccgggaaatcggatggatggagggcgggcagctcgtcctgggcaaccccgccccgattcctcgccatgctcccatccctagatattctacataccttatgctgctcctgattgtgtcctacgccagcgcgtgctccgaactgatccaggcctctagccggatcaccacatgttccaccgagggagttaatacgaagtgccgcctctctggcacagctctgattagagccgggagcgtgggagctgaagcctgtcttatgctgaaaggcgtcaaggacgatcaaaccaaatttctcaagatcaaaaccgtgtccagcgagctgtcttgccgggaggggcagtcctattggacaggcagcttctctcccaagtgtctgtccagcagacgctgccaccttgttggagaatgtcatgtgaaccggtgcctctcttggagagacaatgagaccagcgccgaattttccttcgtcggggagagcacaacgatgcgcgaaaacaaatgctttgagcagtgtggcggatggggctgcgggtgtttcaatgtgaacccttcttgcctgtttgttcacacctacctgcagtccgtgcggaaggaggctctcagagtcttcaattgtattgactgggtgcacaagctgacacttgaaatcaccgattttgacggaagcgtgtccacaattgatctgggcgcgtctagctcccgcttcaccaactgggggtctgtcagcctctccctggacgccgagggaatctctggcagcaattcctttagcttcattgaatctcccgggaaaggctatgctatcgttgatgagccgttctccgagatccctcggcaaggatttctgggcgaaattagatgcaacagcgagtcttccgtgcttagcgcccatgaatcttgtctccgcgcccccaatctgatctcctacaagcccatgattgaccagctggagtgcacgaccaacctcatcgatcctttcgtggtctttgaacgggggagcctgccgcagacaagaaatgagaaaaccttcgctgcctccaagggaaaccgcggcgtgcaggcgtttagcaaagggtctgttcaagctgaccttacactgatgttcgataattttgaggtggacttcgtcggagccgccgtgagctgtgatgctgcctttctcaacctgaccggctgctattcctgtaacgcgggggctcgggtttgcctgtctattacgagcacaggcaccggaacactttccgcccacaataaggacggctctctccatatcgtgctgcccagcgaaaacgggaccaaggatcagtgccagatcctgcacttcaccgtccctgaggtggaagaggaatttatgtactcctgtgacggagacgagagacccctcctggttaaaggcacacttattgccatcgatcctttcgacgatcggcgcgaggctgggggagaatctacggtggtcaatcccaagagcggctcctggaactttttcgactggttcagcggcctgatgtcttggtttgggggacctctcaaaaccattctgctgatctgcctttatgtggccctctccattggcctgttctttctgctcatctacctggggagaacaggacttagcaagatgtggctggctgccaccaaaaaggcgtcttga

SEQ ID NO: 14580 - RNA, 3204 nt, synthetic construct
  misc_feature 1..3204: note = derived and/or modified CDS sequence (opt5) from RVFV__JQ068143.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatcgactctggccagaccaaacgggaactgaagtcctttgatattagccagtgcccgaaaatcgggggacatggctctaagaagtgcacaggcgacgctgccttctgttccgcctacgagtgcaccgctcagtatgcgaatgcctactgtagccacgctaacgggtccggaatcgttcaaattcaggtgtctggcgtgtggaaaaagcctctttgcgtcgggtatgaacgcgtggttgtgaaaagagagctgagcgccaagcccatccagcgggtcgaaccttgtacgacatgcattaccaaatgtgagccccacggactcgtggttcgctccacaggctttaagatcagctctgccgtggcttgcgcctccggggtctgtgtgaccggaagccaatctcccagcaccgagattacactgaagtaccctggcatctcccagtctagcggcggggatattggagtccatatggcgcacgacgatcagtccgtgagctctaaaatcgttgctcattgcccgccccaggacccttgtcttgtgcacggctgcatcgtctgcgcccatgggctgattaattatcaatgtcacacggccctctccgctttcgtggttgtgttcgtctttagctctgtggccatcatttgcctggctatcctgtacaaggtgctcagatgtctgaaaattgcccccaagaaagttcttaaccctctgatgtggatcaccgcgttcatccggtgggtctataagaagatggtggcccgcgtggctgataatattaaccaggtcaatagagaaatcggatggatggagggcgggcagctcgccctgggcaaccccgctccgattcctcggcacgcccccatccctcgctactccacataccttatgctgctcctgattatcagctatgcgtccgcctgctctgaactgatccaggctagctccagaattaccacatgttctaccgagggagtgaacacgaaatgccggctcagcggcacagccctgatccgcgctgggtccgttggagccgaagcctgtcttatgctgaagggcgtgaaagaggaccaaaccaagtttctcaaaattaagaccgtcagctctgagctgtcctgcagagaagggcagagctactggacaggatctttctcccccaaatgtctgagctctcggagatgccatcttgtgggcgagtgtcacgttaatcgctgcctcagctggcgggataacgaaacctccgctgagtttagcttcgtgggggaatctacaacgatgagagagaataagtgctttgagcagtgtggcggatggggctgcgggtgtttcaacgtcaatccttcctgcctgtttgtgcatacctatctgcagagcgttcgcaaggaagcgctccgggtgttcaactgtatcgactgggtccacaaactgacacttgagattaccgactttgatggatccgtgtctacaatcgacctgggcgccagctcctctagattcaccaattgggggagcgtgtccctctctctggatgctgaaggaattagcggctccaacagcttttctttcatcgagtcccccgggaagggctacgccatcgtcgacgagccgttcagcgaaattcctcgccaaggatttctgggcgagatccggtgcaattctgaatccagcgttctttctgcccacgagtcctgtctcagagctcccaacctgattagctataaacccatgatcgatcagctggaatgcacgaccaatctcattgaccctttcgtggtgtttgagcgcgggtccctgccgcagacacggaacgataagaccttcgccgcgagcaaaggaaatagaggcgtccaggctttttctaaggggagcgtgcaagccgaccttacactgatgttcgataactttgaggttgacttcgtgggagccgctgtctcctgtgatgccgcgtttctcaatctgaccggctgctactcttgtaacgctggggcccgcgtgtgcctgagcatcacgtccacaggcaccggaacactttctgcccataacaaggacggcagcctccacatcgttctgccctccgaaaatgggaccaaagatcagtgccagattctgcatttcaccgtgcctgaggtcgaagaggaatttatgtattcttgtgacggagacgagcggcccctcctggtgaagggcacacttatcgctattgatcctttcgacgatagacgggaggccgggggagaaagcacggttgtgaaccccaaatccggcagctggaactttttcgactggttctctggcctgatgtcctggtttgggggacctctcaagaccatcctgctgatttgcctttacgtcgctctcagcatcggcctgttctttctgctcatctacctggggcgcacaggactttctaaaatgtggctggccgcgaccaagaaggcctcctga

SEQ ID NO: 14581 - RNA, 3204 nt, synthetic construct
  misc_feature 1..3204: note = derived and/or modified CDS sequence (opt5) from RVFV(SA-75)__DQ380189.1__Gn-Gc
  source 1..3204: mol_type = other RNA
atggccagaatcgctatgaccgtgctgcccgccctcgcggtcttcgctctggcccctgttgtgtttgccgaggacccgcaccttcggaatcgccccggcaaggggcataattacattgatggaatgacacaggaagacgctacgtgcaaacctgtgacctatgccggcgcttgtagctccttcgatgtcctgctcgagaaggggaaatttcccctgttccaatcttacgcccaccatagaacacttctggaagcggtgcacgacaccatcattgccaaggctgatcctcccagctgcgacctccagtccgcccatggaaacccttgtatgaaagagaagctggttatgaagacacactgcccgaatgattatcagtctgctcactacctgaacaatgacggcaaaatggccagcgtgaagtgtccccctaaatatgaactcaccgaggattgcaacttttgtcggcagatgacaggggcgtccctgaagaaaggatcttacccccttcaagacctgttctgccagagctccgaggatgacggcagcaagctcaagaccaaaatgaagggcgtctgtgaagtgggggttcaggccctgaaaaagtgcgatggacagctttctacggctcatgaggtggtcccttttgccgtgttcaaaaattccaagaaagtgtatctggacaagctcgacctgaagaccgaagagaacctgctccccgatagctttgtctgtttcgagcacaaaggccaatacaaggggacaatggactctggacagaccaaacgcgaactgaagtcctttgatatcagccagtgcccgaaaattggcgggcatggatctaagaagtgcacaggcgacgctgccttctgttccgcctacgagtgcaccgctcagtatgcgaatgcctactgtagccacgctaacggctccggggttgtgcaaatccaggtgtctggagtctggaaaaagcctctttgcgtgggctatgaaagagttgtggtcaaacgggagctgagcgccaagcccatccagcgcgtggaaccttgtacgacatgcattaccaaatgtgagccccacgggctcgttgtgagatccacaggatttaagatcagctctgccgtcgcttgcgcctccggcgtgtgtgtcaccgggagccaatctcccagcaccgagattacactgaagtaccctggaatctcccagtctagcggcggcgatattggggtgcatatggcgcacgacgatcagtccgttagctctaaaatcgtggctcattgcccgccccaggacccttgtcttgtccacggatgcattgtgtgcgcccatggcctgatcaattatcaatgtcacacggccctctccgctttcgttgtggtcttcgtgtttagctctgtggccatcatttgcctggctatcctgtacaaggttctcaaatgtctgaagattgcgccccggaaagtccttaaccctctgatgtggatcaccgtgttcattcgctgggtgtataagaagatggtcgccagagtggccgataatatcaaccaggttaatcgggaaatcgggtggatggagggaggccagctcgctctggggaaccccgccccgattcctcgccacgctcccatccctagatactccacataccttatgctgctcctgattgtgagctatgcctccgcgtgctctgaactgatccaggccagctcccggattaccacatgttctaccgagggcgtcaacacgaaatgccgcctcagcggaacagctctgatcagagccggctccgtgggggctgaagcctgtcttatgctgaagggagttaaagaggaccaaaccaagtttctcaaaatcaagaccgtgagctctgagctgtcctgccgggaaggccagagctactggacagggtctttctcccccaaatgtctgagctctagacgctgccatcttgtcggagagtgtcacgtgaatcggtgcctcagctggagagataacgaaacctccgccgagtttagcttcgttggcgaatctacaacgatgcgcgagaataagtgctttgagcagtgtgggggctggggatgcggctgtttcaacgtgaatccttcctgcctgtttgtccatacctatctgcagagcgtgcggaaggaagctctcagagtgttcaactgtattgactgggtccacaaactgacacttgagatcaccgactttgatgggtccgtttctacaattgacctgggagcgagctcctctcgcttcaccaattggggcagcgtgtccctctctctggatgccgaagggatcagcggatccaacagcttttctttcattgagtcccccggcaaggggtacgctatcgtggacgagccgttcagcgaaattcctcggcaaggctttctgggagagatcagatgcaattctgaatccagcgtcctttctgcccacgagtcctgtctccgcgcccccaacctgatcagctataaacccatgattgatcagctggaatgcacgaccaatctcatcgaccctttcgtggtttttgagcggggctccctgccgcagacaagaaacgataagaccttcgctgccagcaaagggaatcgcggagtgcaggcgttttctaagggcagcgtccaagctgaccttacactgatgttcgataactttgaggtggacttcgttggggccgccgtgtcctgtgatgctgcctttctcaatctgaccggatgctactcttgtaacgcgggcgctcgggtctgcctgagcattacgtccacagggaccggcacactttctgcccataacaaggacggaagcctccacatcgtgctgccctccgaaaatggcaccaaagatcagtgccagattctgcatttcaccgttcctgaggtggaagaggaatttatgtattcttgtgacggggacgagagacccctcctggtcaagggaacacttatcgccatcgatcctttcgacgatcggcgcgaggctggcggggaaagcacggtggtgaaccccaaatccggaagctggaactttttcgactggttctctggcctgatgtcctggtttggcgggcctctcaagaccattctgctgatctgcctttacgtcgccctcagcattggactgttctttctgctcatctacctgggcagaacagggctttctaaaatgtggctggctgccaccaagaaggcgtcctga

SEQ ID NO: 14582 - RNA, 3204 nt, synthetic construct
  misc_feature 1..3204: note = derived and/or modified CDS sequence (opt5) from RVFV(ANK-6087)__DQ380216.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaaaactggactctggccagacaaagcgggaacttaaatcctttgatatcagccagtgcccgaagattgggggacatggctctaagaaatgcaccggcgacgctgccttctgttccgcctacgagtgcacagctcagtatgcgaatgcctactgtagccacgctaacgggtccggaatcgttcaaatccaggtgtctggcgtgtggaagaaacctctgtgcgtcgggtatgaacgcgtggttgtgaagagagagctcagcgccaaacccattcagcgggtcgaaccttgtaccacgtgcatcacaaagtgtgagccccacggactggtggttcgctccaccggctttaagattagctctgccgtggcttgcgcctccggggtctgtgtgacaggaagccaatctcccagcaccgagatcacccttaaataccctggcatttcccagtctagcggcggggatatcggagtccatatggcgcacgacgatcagtccgtgagctctaagattgttgctcattgcccgccccaggacccttgtctggtgcacggctgcatcgtctgcgcccatgggctcatcaattatcaatgtcacacagccctgtccgctttcgtggttgtgttcgtctttagctctattgccatcatttgcctggctatcctctacagagtgctgaaatgtcttaagattgctccccggaaagtgctgaaccctctcatgtggatcacggcgttcatccgctgggtttatagaaagatggtcgcccgggtggctgataatattaaccaggtgaatcgcgaaatcggatggatggagggcgggcagctggtccttggcaaccccgccccgattcctagacacgtgcccatccctcggtactccacctacctgatgctcctgctgattgttagctatgcttccgcctgctctgaactcatccaggcgagctcccgcatcacaacctgttctacagagggagtgaacaccaagtgcagactgagcggcacggcccttattcgggctgggtccgtcggagccgaagcctgtctgatgctcaaaggcgtgaaggaggaccaaacaaaatttctgaagatcaaaaccgttagctctgagctgtcctgcagagaagggcagagctactggaccggatctttctcccccaagtgtcttagctctcgccggtgccatctcgtgggcgagtgtcacgtcaatagatgcctgagctggcgcgataacgaaacatccgccgagtttagcttcgtgggggaatctaccacaatgcgggagaataaatgctttgagcagtgtggcggatggggctgcgggtgtttcaacgttaatccttcctgcctgtttgtgcatacgtatctccagagcgtcagaaaggaagccctgcgcgtgttcaactgtattgactgggtgcacaaacttaccctggagatcacagactttgatggatccgtctctaccattgacctcggcgctagctcctctcggttcacaaattgggggagcgtttccctgtctctggatgcggaaggaatcagcggctccaacagcttttctttcattgagtcccccgggaagggctacgccatcgtggacgagccgttcagcgaaatccctagacaaggatttcttggcgagattcgctgcaattctgaatccagcgtgctctctgctcacgagtcctgtctgcgggcccccaacctgatcagctataagcccatgattgatcagctcgaatgctccaccaatctgatcgaccctttcgtcgtgtttaaaagagggagccttccgcagacgcgcaacgataagaccttcgccgcttctaaaggaaatcggggcgttcaggcctttagcaaggggtccgtgcaagcggacctgacactcatgttcgataactttgaggtcgacttcgtgggagctgccgtttcttgtgatgccgcttttctgaatctgaccggctgctacagctgtaacgccggggcgagagtgtgcctttccattacatctaccggcacgggaacactcagcgctcataacaaggacggctccctgcacatcgtcctgccctctgagaatgggaccaaagatcagtgccagatcctccatttcacagtgcctgaagttgaggaagagtttatgtatagctgtgacggagacgaacggcccctgcttgtgcgcggcaccctgattgccatcgatcctttcgacgatagacgggaggccgggggagagtccaccgtcgtgaaccccaagagcggctcttggaactttttcgactggttctccggcctcatgagctggtttgggggacctctgaaaacaattctgcttatctgcctctacgtggctctgtctattggcctgttctttctcctgatctaccttgggagaacgggactgtccaagatgtggctcgccgctaccaaaaaggccagctga

SEQ ID NO: 14583 - RNA, 3204 nt, synthetic construct
  misc_feature 1..3204: note = derived and/or modified CDS sequence (opt5) from RVFV(KEN/Kil-006/07)__HM586966.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgccgatggcaacaaatgtatgaaggagaagctggttatgaaaacacattgccctaatgactatcagtctgctcactacctgaacaatgatgggaagatggccagcgtgaaatgtccgcccaagtatgaactcaccgaggactgcaacttttgtagacagatgacaggagcgtccctgaaaaagggctcttaccctcttcaagatctgttctgccagagctccgaggacgatggcagcaagctcaaaaccaagatgaaaggggtctgtgaagtgggagttcaggccctgaagaaatgcgacggccagctttctacggctcacgaggtggtcccctttgccgtgttcaaaaattccaagaaggtgtatctggacaagctcgatctgaaaaccgaagagaacctgctccctgacagctttgtctgtttcgagcataaggggcaatacaaaggaacaatggattctggccagaccaagcgggaactgaaatcctttgacatcagccagtgccccaagattgggggacacggctctaagaaatgcacaggcgatgctgccttctgttccgcctacgagtgcaccgctcagtatgcgaatgcctactgtagccatgctaacgggtccggaatcgttcaaatccaggtgtctggcgtgtggaagaaaccgctttgcgtcgggtatgaacgcgtggttgtgaagagagagctgagcgccaaacctattcagcgggtcgaaccctgtacgacatgcatcaccaagtgtgagcctcacggactcgtggttcgctccacaggctttaagattagctctgccgtggcttgcgcctccggggtctgtgtgaccggaagccaatctcccagcaccgagatcacactgaaataccccggcatttcccagtctagcggcggggacatcggagtccacatggcgcatgatgaccagtccgtgagctctaagattgttgctcactgccctccgcaggatccctgtcttgtgcatggctgcatcgtctgcgcccacgggctgatcaattatcaatgtcatacggccctctccgctttcgtggttattttcgtgtttagctctaccgccatcatttgcctggctgtcctgtacagagtgctcaaatgtctgaagatcgcccctcggaaagtgcttaaccccctgatgtggattacagcgttcatccgctgggtttataagaagatggtcgccagagtggctgacaatatcaaccaggtgaatcgggaaattggatggatggagggcgggcagctcgccctgggcaaccctgctcccatcccgcgccacgcccctattcccagatactccacctaccttatgctgctcctgatcgtcagctatgcgtccgcctgctctgaactgattcaggctagctcccggatcacaacctgttctacggagggagtgaacacaaaatgccgcctcagcggcaccgccctgatcagagctgggtccgttggagccgaagcctgtcttatgctgaagggcgtgaaagaggatcaaaccaagtttctcaaaattaagacagtcagctctgagctgtcctgccgggaagggcagagctactggaccggatctttctcccctaaatgtctgagctctagacgctgccaccttgtgggcgagtgtcatgttaatcggtgcctcagctggagagacaacgaaacatccgctgagtttagcttcgtgggggaatctacgaccatgcgcgagaataagtgctttgagcagtgtggcggatggggctgcgggtgtttcaacgtcaatccctcctgcctgtttgtgcacacatatctgcagagcgttcggaaggaagcgctcagagtgttcaactgtatcgactgggtccataaactgacccttgagattacagattttgacggatccgtgtctaccatcgatctgggcgccagctcctctcgcttcacgaattgggggagcgtgtccctctctctggacgctgaaggaattagcggctccaacagcttttctttcatcgagtcccctgggaagggctacgccattgtcgatgagcccttcagcgaaatcccgcggcaaggatttctgggcgagatcagatgcaattctgaatccagcgttctttctgcccacgagtcctgtctccgcgctcctaacctggtgagctataaacccatgattgaccagctggaatgcaccacaaatctcatcgatcccttcgtggtctttgagcgggggtccctgcctcagaccagaaacgacaagacattcgccgcgagcaaaggaaatcgcggcgtgcaggctttttctaaggggagcgttcaagccgatcttaccctgatgttcgacaactttgaggtggatttcgtcggagccgctgtgtcctgtgacgccgcgtttctcaatctgacgggctgctactcttgtaacgctggggcccgggtttgcctgagcattacatccaccggcacaggaaccctttctgcccacaacaaggatggcagcctccatatcgtgctgccgtccgaaaatgggaccaaagaccagtgccagattctgcacttcacagtccccgaggtggaagaggaatttatgtattcttgtgacggagatgagagacctctcctggttaagggcacgcttatcgctatcgaccccttcgatgaccggcgcgaggccgggggagaaagcaccgtggtcaaccctaaatccggcagctggaactttttcgattggttctctggcctgatgtcctggtttgggggacccctcaagacaattctgctgatctgcctttacgtggctctcagcattggcctgttctttctgctcatctacctggggagaaccggactttctaaaatgtggctggccgcgacaaagaaggcctcctga

SEQ ID NO: 14584 - RNA, 3204 nt, synthetic construct
  misc_feature 1..3204: note = derived and/or modified CDS sequence (opt5) from RVFV(MgH824)__DQ380210.1__Gn-Gc
  source 1..3204: mol_type = other RNA
atggccggcatcgctatgaccgtgctgcccgccctcgcggtcttcgctctggcccctgttgtgtttgccgaggacccgcaccttagaaaccggcccgggaagggatacaattatattgatggcatgacacaggaagacgctacgtgcaaacctgtgacctacgccggggcttgtagctccttcgatgtcctgctcgagaagggaaaatttcccctgttccaatcttatgcccatcaccgcacacttctggaagcggtgcatgacaccatcattgccaaggctgatcctcccagctgcgacctccagtccgcccacggcaacccttgtatgaaagagaagctggttatgaagacacattgcccgaatgattaccagtctgctcactatctgaacaatgacgggaaaatggccagcgtgaagtgtccccctaaatacgaactcaccgaggattgcaacttttgtagacagatgacaggagcgtccctgaagaaaggctcttatccccttcaagacctgttctgccagagctccgaggatgacggcagcaagctcaagaccaaaatgaagggggtctgtgaagtgggagttcaggccctgaaaaagtgcgatggccagctttctacggctcacgaggtggtcccttttgccgtgttcaaaaattccaagaaagtgtacctggacaagctcgacctgaagaccgaagagaacctgctccccgatagctttgtctgtttcgagcggaaagggcaatacaagggaacaatggactctggccagaccaaacgcgaactgaagtcctttgatatcagccagtgcccgaaaattgggggacatggctctaagaagtgcacaggcgacgctgccttctgttccgcctatgagtgcaccacgcagtacgctaatgcgtattgtagccacgccaacgggtccggagttgtgcaaatccaggtgtctggcgtctggaaaaagcctctttgcgtggggtacgaaagagttgtggtcaaacgggagctgagcgctaagcccatccagcgcgtggaaccttgtacaacctgcattacaaaatgtgagccccatggactcgttgtgagatccaccggctttaagatcagctctgccgtcgcctgcgcttccggggtgtgtgtcaccggaagccaatctcccagcacagagattacgctgaagtatcctggcatctcccagtctagcggcggggatattggagtgcacatggcccacgacgatcagtccgttagctctaaaatcgtggcgcattgcccgccccaggacccttgtcttgtccacggctgcattgtgtgcgctcatgggctgatcaattaccaatgtcacaccgccctctccgccttcgttgtggtcttcgtgtttagctctatcgctattatctgcctggccattctgtatcgggtgctcaagtgtctgaaaatcgctccccgcaaggttcttaaccctctgatgtggattacagccttcatcagatggatctacaaaaagatggtcgcgcgggtggccgataatattaaccaggtgaatcgcgaaatcggatggatggagggcgggcagctcgtcctgggcaaccccgctccgattcctagacatgcccccatccctcggtactccacctatcttatgctgctcctgattgtgagctacgcttccgcctgctctgaactgatccaggcgagctcccgcatcacaacctgttctacggagggagttgacacaaagtgcagactcagcggcaccgccctgattcgggctgggtccgtgggagccgaggcttgtcttatgctgaaaggcgtcaaggaagatcaaaccaaatttctcaagatcaaaacagtgagctctgagctgtcctgcagagaagggcagagctattggaccggatctttctcccccaagtgtctgagctctcgccggtgccaccttgttggcgagtgtcacgtgaacagatgcctcagctggcgcgacaatgaaacatccgccgagtttagcttcgtcggggaatctacgaccatgcgggagaacaaatgctttgagcagtgtggcggatggggctgcgggtgtttcaatgtgaacccttcctgcctgtttgttcatacatacctgcagagcgtgagaaaggaagccctccgcgtcttcaattgtattgactgggtgcacaagctgacccttgagatcacagattttgacggatccgtgtctaccattgatctgggcgctagctcctctcggttcacgaactgggggagcgtctccctctctctggacgcggaaggaatcagcggctccaatagcttttctttcattgagtcccccgggaaaggctatgccatcgttgatgagccgttccctgaaatccccagacaaggatttctgggcgagattcgctgcaacagcgaatcttccgtgcttagcgctcatgagtcttgtctccgggcccccaatctgatctcctacaagcctatgattgaccagctggaatgcaccacaaacctcatcgatccgttcgtggtctttgagagagggagcctgccccagacccgcaatgacaaaacattcgccgcttccaagggaaaccggggcgtgcaggcctttagcaaagggtctgttcaagcggatcttaccctgatgttcgacaattttgaggtggatttcgtcggagctgccgtgagctgtgacgccgcttttctcaacctgacgggctgctattcctgtaatgccggggcgagagtttgcctgtctattacaagcaccggcacaggatccctttctgctcacaacaaggatggcagcctccacatcgtgctgccttccgaaaacgggaccaaggaccagtgccagatcctgcatttcaccgtccccgaggtggaagaggaatttatgtactcttgtgacggagatgagcggcctctcctggttaaaggcacacttattgccatcgaccccttcgatgaccgcagagaggccgggggagaaagcacggtggtcaatcctaagtccggcagctggaactttttcgattggttctctggcctgatgtcctggtttgggggacccctcaaaaccattctgctgatctgcctttacgtggctctcagcattggcctgttctttctgctcatctatctggggcggacaggactttctaagatgtggctggccgctaccaaaaaggcctcctga

SEQ ID NO: 14585 - RNA, 3204 nt, synthetic construct
  misc_feature 1..3204: note = derived and/or modified CDS sequence (opt5) from RVFV(KEN/Mal-032/07)__HM586967.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggccgcctgcaggaagacgctacatgcaaacctgtgacgtatgccggggcttgtagctccttcgatgtcctcctggagaagggaaaatttccccttttccaatcttacgcccaccatagaaccctgctcgaagcggtgcacgacacaatcattgccaaggctgatcctcccagctgcgacctgcagtccgccgatggcaacaaatgtatgaaggagaagctggttatgaaaacccattgccctaatgactatcagtctgctcactacctcaacaatgatgggaagatggccagcgtgaaatgtccgcccaagtatgaactgacagaggactgcaacttttgtcggcagatgaccggagcgtcccttaaaaagggctcttaccctctgcaagatctcttctgccagagctccgaggacgatggcagcaagctgaaaacaaagatgaaaggggtctgtgaagtgggagttcaggcccttaagaaatgcgacggccagctgtctaccgctcacgaggtggtcccctttgccgtgttcaaaaattccaagaaggtgtatctcgacaagctggatctgaaaacggaagagaacctcctgcctgacagctttgtctgtttcgagcataaggggcaatacaaaggaaccatggattctggccagacaaagcgcgaacttaaatcctttgacatcagccagtgccccaagattgggggacacggctctaagaaatgcaccggcgatgctgccttctgttccgcctacgagtgcacagctcagtatgcgaatgcctactgtagccatgctaacgggtccggaatcgttcaaatccaggtgtctggcgtgtggaagaaaccgctgtgcgtcgggtatgaaagagtggttgtgaagcgggagctcagcgccaaacctattcagcgcgtcgaaccctgtaccacgtgcatcacaaagtgtgagcctcacggactggtggttagatccaccggctttaagattagctctgccgtggcttgcgcctccggggtctgtgtgacaggaagccaatctcccagcaccgagatcacccttaaataccccggcatttcccagtctagcggcggggacatcggagtccacatggcgcatgatgaccagtccgtgagctctaagattgttgctcactgccctccgcaggatccctgtctggtgcatggctgcatcgtctgcgcccacgggctcatcaattatcaatgtcatacagccctgtccgctttcgtggttattttcgtgtttagctctacggccatcatttgcctggctgtcctctaccgggtgctgaaatgtcttaagatcgcccctcgcaaagtgctgaaccccctcatgtggattaccgcgttcatcagatgggtttataagaagatggtcgcccgggtggctgacaatatcaaccaggtgaatcgcgaaattggatggatggagggcgggcagctggcccttggcaaccctgctcccatcccgagacacgcccctattccccggtactccacatacctgatgctcctgctgatcgtcagctatgcgtccgcctgctctgaactcattcaggctagctcccgcatcaccacatgttctaccgagggagtgaacacgaaatgcagactgagcggcacagcccttatccgggctgggtccgttggagccgaagcctgtctgatgctcaagggcgtgaaagaggatcaaaccaagtttctgaaaattaagaccgtcagctctgagctgtcctgcagagaagggcagagctactggacaggatctttctcccctaaatgtcttagctctcgccggtgccacctcgtgggcgagtgtcatgttaatagatgcctgagctggcgcgacaacgaaacctccgctgagtttagcttcgtgggggaatctacaacgatgcgggagaataagtgctttgagcagtgtggcggatggggctgcgggtgtttcaacgtcaatccctcctgcctgtttgtgcacacctatctccagagcgttagaaaggaagcgctgcgcgtgttcaactgtatcgactgggtccataaacttacactggagattaccgattttgacggatccgtgtctacaatcgatctcggcgccagctcctctcggttcaccaattgggggagcgtgtccctgtctctggacgctgaaggaattagcggctccaacagcttttctttcatcgagtcccctgggaagggctacgccattgtcgatgagcccttcagcgaaatcccgagacaaggatttcttggcgagatccgctgcaattctgaatccagcgttctctctgcccacgagtcctgtctgcgggctcctaacctggtgagctataaacccatgattgaccagctcgaatgcacgaccaatctgatcgatcccttcgtggtctttgagagagggtcccttcctcagacacgcaacgacaagaccttcgccgcgagcaaaggaaatcggggcgtgcaggctttttctaaggggagcgttcaagccgatctgacactcatgttcgacaactttgaggtggatttcgtcggagccgctgtgtcctgtgacgccgcgtttctgaatctgaccggctgctactcttgtaacgctggggccagagtttgccttagcattacgtccacaggcaccggaacactctctgcccacaacaaggatggcagcctgcatatcgtgctgccgtccgaaaatgggaccaaagaccagtgccagattctccacttcaccgtccccgaggtggaagaggaatttatgtattcttgtgacggagatgagcggcctctgcttgttaagggcacactgatcgctatcgaccccttcgatgaccgcagagaggccgggggagaaagcacggtggtcaaccctaaatccggcagctggaactttttcgattggttctctggcctcatgtcctggtttgggggacccctgaagaccattctgcttatctgcctctacgtggctctgagcattggcctgttctttctcctgatctaccttgggcggacaggactgtctaaaatgtggctcgccgcgaccaagaaggcctcctga

SEQ ID NO: 14586 - RNA, 3204 nt, synthetic construct
  misc_feature 1..3204: note = derived and/or modified CDS sequence (opt5) from RVFV(Kenya 56 (IB8))__DQ380190.1__Gn-Gc
  source 1..3204: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacagggggacgctacgtgcaaacctgtgacctatgccggagcttgtagctccttcgatgtcctgctcgaaaagggcaaatttcccctgttccaatcttacgcccaccatcgcacacttctggaggcggtgcacgacaccatcattgccaaggctgatcctcccagctgcgacctccagtccgcccatgggaacccttgtatgaaagaaaagctggttatgaagacacactgcccgaaagattatcagtctgctcactacctgaataacgacggaaagatggccagcgtgaaatgtccccctaagtatgagctcaccgaagattgcaatttttgtagacagatgacaggcgcgtccctgaaaaagggctcttacccccttcaagacctgttctgccagagctccgaggatgacgggagcaagctcaaaaccaagatgaaaggagtctgtgaggtgggcgttcaggccctgaagaaatgcgatgggcagctttctacggctcatgaagtggtcccttttgccgtgttcaagaactccaaaaaggtgtatctggacaagctcgacctgaaaaccgaggaaaatctgctccccgatagctttgtctgtttcgagcacaagggacaatacaaaggcacaatggactctgggcagaccaagcgggagctgaaatcctttgatatcagccagtgcccgaagattggaggccatggctctaagaaatgcacaggggacgctgccttctgttccgcctacgaatgcaccgctcagtatgcgaacgcctactgtagccacgctaatggatccggcatcgttcaaatccaggtgtctggggtgtggaagcgccctctttgcgtcggatatgagagagtggttgtgaaacgggaactgagcgccaagcccattcagcgcgtcgagccttgtacgacatgcatcaccaaatgtgaaccccacggcctcgtggttagatccacagggtttaagattagctctgccgtggcttgcgcctccggagtctgtgtgaccggcagccaatctcccagcaccgagatcacactgaagtaccctggcatgtcccagtctagcgggggagatattggcgtccatatggcgcacgacgatcagtccgtgagctctaaaatcgttgctcattgcccgccccaggacccttgtcttgtgcacgggtgcattgtctgcgcccatggactgatcaactatcaatgtcacacggccctctccgctttcgtggttgtgttcgtctttagctctgtggccatcatttgcctggctatcctgtacaaggtgctcaaatgtctgaagattgcgccccggaaagttcttaatcctctgatgtggatcaccgccttcattcgctgggtctataagaagatggtggccagagtggctgataacatcaatcaggtcaaccgggagatcggctggatggaagggggccagcccgccctcggaaatccggctcctattccccgccacgcccctatccccagatactccacatacctgatgcttctgctcattgtgagctatgcgtccgcctgctctgagctgatccaggctagctcccggattaccacatgttctaccgaaggcgttaacacgaaatgccgcctgagcgggacagccctcatcagagctggatccgtgggcgccgaggcctgtctgatgcttaagggggtcaaagaagaccaaaccaagtttctgaaaatcaagaccgtgagctctgagctctcctgccgggagggacagagctactggacaggctctttctcccctaaatgtctgagctctagacgctgccatctggttggggaatgtcacgtgaaccggtgccttagctggagagataatgagacctccgctgaatttagcttcgtcggcgagtctacaacgatgcgcgaaaacaagtgctttgagcagtgtggaggctgggggtgcggatgtttcaatgtgaacccctcctgcctctttgttcatacctatctgcagagcgtgcggaaggaggcgctgagagtcttcaattgtattgactgggtgcacaaactcacactggaaatcaccgactttgatggctccgtgtctacaattgaccttggggccagctcctctcgcttcaccaactggggaagcgtctccctgtctctcgatgctgagggcatcagcgggtccaatagcttttctttcattgaatccccgggcaagggatacgccatcgttgacgagcctttcagcgagattccccggcaaggctttctgggggaaatcagatgcaactctgagtccagcgtgctgtctgcccacgaatcctgtcttcgcgctcccaatctcatcagctataaacctatgattgatcagctggagtgcacgaccaacctgatcgacccgttcgtggcctttgaacggggatccctcccccagacaagaaatgataagaccttcgcggctagcaaaggcaaccgcggggtccaggccttttctaagggaagcgtgcaagccgacctgacacttatgttcgataattttgaggttgacttcgtgggcgctgccgtctcctgtgatgcggcttttctgaacctcaccgggtgctactcttgtaatgccggcgcccgggtgtgcctgagcattacgtccacaggaaccggcacactgtctgctcataacaaggacgggagccttcacatcgttctcccttccgagaacggaaccaaagatcagtgccagattctgcatttcaccgtgcccgaagtcgaggaagagtttatgtattcttgtgacggcgacgaaagacctctgctcgtgaaggggacactgatcgccatcgatcccttcgacgatcggcgcgaggctggaggcgagagcacggttgtgaatcctaaatccggcagctggaactttttcgactggttctctgggcttatgtcctggtttggaggccccctgaagaccattctcctgatctgcctgtacgtcgcccttagcattggactcttctttctgctgatctacctcgggagaacaggcctgtctaaaatgtggcttgcggccaccaagaaggcttcctga

SEQ ID NO: 14587 - RNA, 3204 nt, synthetic construct
  misc_feature 1..3204: note = derived and/or modified CDS sequence (opt5) from RVFV(KEN/Gar-008/06)__HM586965.1__Gn-Gc
  source 1..3204: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctcgcgtgtggaaaaagcctctttgcgtcggctatgaaagagtggttgtgaaacgggagctgagcgccaagcccattcagcgcgtcgaaccttgtacgacatgcatcaccaaatgtgagccccacgggctcgtggttagatccacaggatttaagattagctctgccgtggcttgcgcctccggcgtctgtgtgaccgggagccaatctcccagcaccgagatcacactgaagtaccctggaatttcccagtctagcggcggcgatatcggggtccatatggcgcacgacgatcagtccgtgagctctaaaattgttgctcattgcccgccccaggacccttgtcttgtgcacggatgcatcgtctgcgcccatggcctgatcaattatcaatgtcacacggccctctccgctttcgtggttattttcgtgtttagctctaccgccatcatttgcctggctgtcctgtaccgggtgctcaagtgtctgaaaatcgctccccgcaaggtgcttaaccctctgatgtggattacagcgttcatcagatgggtttataaaaagatggtcgcccgggtggctgataatatcaaccaggtgaatcgcgaaattgggtggatggagggaggccagctcgccctggggaaccccgctccgatccctagacacgcccccattcctcggtactccacctaccttatgctgctcctgatcgtcagctatgcgtccgcctgctctgaactgattcaggctagctcccgcatcacaacctgttctacggagggcgtgaacacaaagtgcagactcagcggaaccgccctgatccgggctggctccgttggggccgaagcctgtcttatgctgaaaggagtgaaggaggaccaaaccaaatttctcaagattaaaacagtcagctctgagctgtcctgcagagaaggccagagctactggaccgggtctttctcccccaagtgtctgagctctcgccggtgccatcttgtgggagagtgtcacgttaatagatgcctcagctggcgcgataacgaaacatccgctgagtttagcttcgtgggcgaatctacgaccatgcgggagaataaatgctttgagcagtgtgggggctggggatgcggctgtttcaacgtcaatccttcctgcctgtttgtgcatacatatctgcagagcgttagaaaggaagcgctccgcgtgttcaactgtatcgactgggtccacaagctgacccttgagattacagactttgatgggtccgtgtctaccatcgacctgggagccagctcctctcggttcacgaattggggcagcgtgtccctctctctggatgctgaagggattagcggatccaacagcttttctttcatcgagtcccccggcaaagggtacgccattgtcgacgagccgttcagcgaaatccctagacaaggctttctgggagagatccgctgcaattctgaatccagcgttctttctgcccacgagtcctgtctccgggctcccaacctggtgagctataagcccatgattgatcagctggaatgcaccacaaatctcatcgaccctttcgtggtctttgagagaggctccctgccgcagacccgcaacgataaaacattcgccgcgagcaaggggaatcggggagtgcaggctttttctaaaggcagcgttcaagccgaccttaccctgatgttcgataacctcaaggtggactttgtcggggccgctgtgtcctgtgatgccgcgttcctgaatctgacgggatgctactcttgtaacgctggcgccagagtttgccttagcattacatccaccgggacaggcaccctctctgcccataacaaggacggaagcctgcacatcgtgctgccctccgagaatggcaccaaagatcagtgccagattctccattttacagtccctgaagtgaaggaggagttcatgtattcttgtgacggggacgaacgggctctgcttatgaaaggaacgctgatcgccatcgatccctttgacgatcgcagagaagctggcggggagagcaccgttgtgaaccctaagtccggaagctggaatttctttgactggttctctggcctcatgtcctggttcggcgggcccctgaaaacaattctgcttatctgcctctacgtcgccctgagcattggactgtttttcctcctgatctaccttggccggaccgggctgtctaagatgtggctcgcggccacaaagaaagcctcctga

SEQ ID NO: 14588 - RNA, 3204 nt, synthetic construct
  misc_feature 1..3204: note = derived and/or modified CDS sequence (opt5) from RVFV(KEN/Bar-035/07)__HM586969.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggccgcctgcaggaagacgctacatgcaaacctgtgacgtatgccggggcttgtagctccttcgatgtcctcctggagaagggaaaatttccccttttccaatcttacgcccaccatagaaccctgctcgaagcggtgcacgacacaatcattgccaaggctgatcctcccagctgcgacctgcagtccgccgatggcaacaaatgtatgaaggagaagctggttatgaaaacccattgccctaatgactatcagtctgctcactacctcaacaatgatgggaagatggccagcgtgaaatgtccgcccaagtatgaactgacagaggactgcaacttttgtcggcagatgaccggagcgtcccttaaaaagggctcttaccctctgcaagatctcttctgccagagctccgaggacgatggcagcaagctgaaaacaaagatgaaaggggtctgtgaagtgggagttcaggcccttaagaaatgcgacggccagctgtctaccgctcacgaggtggtcccctttgccgtgttcaaaaattccaagaaggtgtatctcgacaagctggatctgaaaacggaagagaacctcctgcctgacagctttgtctgtttcgagcataaggggcaatacaaaggaaccatggattctggccagacaaagcgcgaacttaaatcctttgacatcagccagtgccccaagattgggggacacggctctaagaaatgcaccggcgatgctgccttctgttccgcctacgagtgcacagctcagtatgcgaatgcctactgtagccatgctaacgggtccggaatcgttcaaatccaggtgtctggcgtgtggaagaaaccgctgtgcgtcgggtatgaaagagtggttgtgaagcgggagctcagcgccaaacctattcagcgcgtcgaaccctgtaccacgtgcatcacaaagtgtgagcctcacggactggtggttagatccaccggctttaagattagctctgccgtggcttgcgcctccggggtctgtgtgacaggaagccaatctcccagcaccgagatcacccttaaataccccggcatttcccagtctagcggcggggacatcggagtccacatggcgcatgatgaccagtccgtgagctctaagattgttgctcactgccctccgcaggatccctgtctggtgcatggctgcatcgtctgcgcccacgggctcatcaattatcaatgtcatacagccctgtccgctttcgtggttattttcgtgtttagctctacggccatcatttgcctggctgtcctctaccgggtgctgaaatgtcttaagatcgcccctcgcaaagtgctgaaccccctcatgtggattaccgcgttcatcagatgggtttataagaagatggtcgcccgggtggctgacaatatcaaccaggtgaatcgcgaaattggatggatggagggcgggcagctggcccttggcaaccctgctcccatcccgagacacgcccctattccccggtactccacatacctgatgctcctgctgatcgtcagctatgcgtccgcctgctctgaactcattcaggctagctcccgcatcaccacatgttctaccgagggagtgaacacgaaatgcagactgagcggcacagcccttatccgggctagatccgttggggccgaagcctgtctgatgctcaagggagtgaaagaggatcaaaccaagtttctgaaaattaagaccgtcagctctgagctgtcctgccgcgaaggccagagctactggacagggtctttctcccctaaatgtcttagctctcggagatgccacctcgtgggagagtgtcatgttaatcgctgcctgagctggcgggacaacgaaacctccgctgagtttagcttcgtgggcgaatctacaacgatgagagagaataagtgctttgagcagtgtgggggctggggatgcggctgtttcaacgtcaatccctcctgcctgtttgtgcacacctatctccagagcgttcgcaaggaagcgctgcgggtgttcaactgtatcgactgggtccataaacttacactggagattaccgattttgacgggtccgtgtctacaatcgatctcggagccagctcctctagattcaccaattggggcagcgtgtccctgtctctggacgctgaagggattagcggatccaacagcttttctttcatcgagtcccctggcaaggggtacgccattgtcgatgagcccttcagcgaaatcccgcgccaaggctttcttggagagatccggtgcaattctgaatccagcgttctctctgcccacgagtcctgtctgagagctcctaacctggtgagctataaacccatgattgaccagctcgaatgcacgaccaatctgatcgatcccttcgtggtctttgagcgcggctcccttcctcagacacggaacgacaagaccttcgccgcgagcaaagggaatagaggagtgcaggctttttctaagggcagcgttcaagccgatctgacactcatgttcgacaactttgaggtggatttcgtcggggccgctgtgtcctgtgacgccgcgtttctgaatctgaccggatgctactcttgtaacgctggcgcccgggtttgccttagcattacgtccacagggaccggcacactctctgcccacaacaaggatggaagcctgcatatcgtgctgccgtccgaaaatggcaccaaagaccagtgccagattctccacttcaccgtccccgaggtggaagaggaatttatgtattcttgtgacggggatgagcgccctctgcttgttaagggaacactgatcgctatcgaccccttcgatgacagacgggaggccggcggggaaagcacggtggtcaaccctaaatccggaagctggaactttttcgattggttctctggcctcatgtcctggtttggcgggcccctgaagaccattctgcttatctgcctctacgtggctctgagcattggactgttctttctcctgatctaccttggcagaacagggctgtctaaaatgtggctcgccgcgaccaagaaggcctcctga

SEQ ID NO: 14589 - RNA, 3204 nt, synthetic construct
  misc_feature 1..3204: note = derived and/or modified CDS sequence (opt5) from RVFV(Smithburn)__DQ380193.1__Gn-Gc
  source 1..3204: mol_type = other RNA
atggccggcatcgctatgaccgtgttccccgccctggtcgtttttgcgctcgctcctgtggtgttcgccgaggacccgcacctgagaaaccggcccgggaagggacataattacattgatggcatgacacaggaagacgccacgtgcaaacctgtcacctatgctggggcctgtagctcctttgatgtgcttctggagaagggaaaattccccctctttcaatcttacgctcaccatcgcacactgcttgaagccgttcacgacatcattatcgcgaaggccgatcctcccagctgcaacctgcagtccgctcatggcaatccttgtatgaaagagaagctcgtgatgaagacctattgcccgaacgactaccagtctgcccactatctgaataacgatgggaaaatggctagcgtcaagtgtccccctaaacacgaactgacagaggactgcaatttctgtagacagatgaccggagcctccctcaaggagggctcttaccccctgcaagatctgttttgccagagctccgaagacgatggcagcaaacttaagacaaagatgaaaggggtgtgtgaggttggagtgcaggtcctcaagaaatgcgacggccagctgtctaccgcgcatgaagtggtgcctttcgccgtctttaagaactccaaaaaggtttatcttgataaactggacctcaagacggaggagaatctgctgcccgacagcttcgtgtgttttgaacacaaggggcaatacaaaggaaccatggattctggccagattaagcgggagctcaaatccttcgacatcagccagtgcccgaagatcgggggacatggctctaaaaagtgcacaggcgatgctgccttttgttccgcttacgaatgcaccgcccagtatgccaacgcttactgtagccacgcgaatgggtccggaattgtgcaaatccaggtctctggcgtgtggaagaaacctctgtgcgttgggtatgagcgcgtggtcgtgaagagagaacttagcgccaaacccattcagcgggttgagccttgtacaacctgcatcacgaagtgtgagccccacggactggtggtccgctccacaggcttcaaaattagctctgctgtggcctgcgcctccggggtctgtgtgaccggaagccaatctcccagcacagaaatcaccctcaagtaccctggcatttcccagtctagcggcggggacatcggagttcatatggctcacgatgaccagtccgtgagctctaagatcgtcgcccattgcccgccccaggatccttgtctggtgcacggctgcattgtttgcgcgcatgggcttatcaactatcaatgtcacaccgctttctccgcctttgtggtcgtgttcgtgtttagctctgttgtcattatctgcctggccattctctacaaagtgctgaagtgtctgaaaatcgctcccagaaaggtgctcaatcctctgatgtggatcacagccttcattcggtgggtctataaaaagatggtggctcgcgttgccgacaacatcaatcaggtgaacagagagattggatggatggaaggcgggcagcttgtcctgggcaaccccgcgccgatccctcggcacgcccccattcctcgctactccacgtacctcatgctgcttctgatcgtgagctatgcttccgcctgctctgagctcatccaggctagctccagaattaccacatgttctaccgaaggagttaatacaaagtgccggctgagcggcaccgccctgatccgcgcggggtccgtgggagccgaggcttgtctcatgctgaaaggcgtcaaggaggatcaaacgaaatttcttaagattaaaacagtgagctctgaactgtcctgcagagaggggcagagctactggaccggatctttctcccccaagtgtctcagctctcggagatgccatctggttggcgaatgtcacgtgaaccgctgcctgagctggcgggacaatgagacctccgccgaatttagcttcgtcggggagtctacaaccatgagagagaacaaatgctttgaacagtgtggcggatggggctgcgggtgtttcaatgtgaacccttcctgcctttttgtgcatacatatctccagagcgtccgcaaggaggctctgcgggttttcaattgtatcgattgggtgcacaagctgacgctcgaaattaccgactttgacggatccgtgtctacagtcgatctgggcgccagctcctctagattcaccaactgggggagcgtgtccctttctctggacgccgagggaatcagcggctccaatagcttctcttttattgagtcccccgggaaaggctacgctatcgttgatgaaccgttcagcgagatccctcgccaaggatttctcggcgaaattcggtgcaactctgagtccagcgtgctgtctgcgcacgaatcctgtctgagagcccccaatcttatcagctataagcccatgattgaccagctcgagtgcacaaccaacctgatcgatcctttcgtcgtgtttgagcgcgggtccctgccgcagacgcggaatgacaaaaccttcgctgccagcaagggaaacagaggcgttcaggccttttctaaagggagcgtgcaagctgatctcacactgatgttcgacaattttgaagtcgatttcgtgggagccgcggtttcctgtgacgctgcctttcttaacctgaccggctgctactcttgtaacgccggggctcgcgtgtgcctcagcattacatccaccggcacgggaacactgtctgcccataataaggatggcagcctgcacatcgtccttccctccgagaacgggaccaaggaccagtgccagatcctccatttcacagtgcctgaagtggaggaagagtttatgtattcttgtgatggagacgagcggcccctgctggtcaaaggcaccctcattgcgatcgaccctttcgatgacagacgggaagctgggggagagagcaccgttgtgaatcccaagtccggcagctggaacttctttgattggttctctggcctgatgtcctggtttgggggacctcttaaaacaattctgctcatctgcctgtacgtggccctgagcattggccttttctttttcctcatctacctggggcgcacgggactgtctaagatgtggctcgccgctaccaaaaaggcctcctga

SEQ ID NO: 14590 - RNA, 3204 nt, synthetic construct
  misc_feature 1..3204: note = derived and/or modified CDS sequence (opt5) from RVFV(Beijing-01)__KX611606.1__Gn-Gc
  source 1..3204: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcgtgacacaggaagacgctacgtgcaaacctgtcacctatgccggggcttgtagctccttcgatgtgctgctcgagaagggaaaatttcccctgttccaatcttacgcccaccatcgcacacttctggaagcggttcacgacaccatcattgccaaggctgatcctcccagctgcgacctccagtccgcccatggcaacccttgtatgaaagagaagctggtgatgaagacacactgcccgaatgattatcagtctgctcactacctgaacaatgacgggaaaatggccagcgtcaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtgtgtgaagttggagtgcaggccctgaaaaagtgcgatggccggctttctacggctcatgaggtcgtgccttttgccgtgttcaaaaattccaagaaagtctatctggacaagctcgacctgaagaccgaagagaacctgctccccgatagctttgtttgtttcgagcacaaagggcagtacaagggaacaatggactctggccaaaccaaacgcgaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgtgcagatccaagtgtctggcgtctggaaaaagcctctttgcgtggggtatgaaagagttgtggtcaaacgggagctgagcgccaagcccattcagcgcgtggaaccttgtacgacatgcatcaccaaatgtgagccccacggactcgttgtgagatccacaggctttaagattagctctgccgtcgcttgcgcctccggggtgtgtgtcaccggaagccagtctcccagcaccgagatcacactgaagtaccctggcatttcccaatctagcggcggggatatcggagtgcatatggcgcacgacgatcagtccgttagctctaaaattgtgttcgactgcccgccccaggatccttgtcttgtccatggctgcatcgtgtgcgctcacgggctgatcaattatcagtgtcatacggccctctccgccttcgttgtggtctttgtgttcagctctgtggctattatctgcctggccattctgtacaaggttctccggtgtctgaaaatcgctcccaagaaagtccttaaccctctgatgtggattaccgcctttatccgctgggtgtataagaagatggtggcgagagtcgccgacaatatcaaccaagtgaatcgggaaattggatggatggagggcgggcagctcgctctgggcaaccccgccccgatccctcgccacgctcccattcctagatactccacataccttatgctgctcctgatcattagctatgcctccgcgtgctctgaactgatccaggccagctcccggatcaccacatgttctaccgagggagttaacacgaaatgccgcctcagcggcacagctctgattagagccgggtccgtgggagctgaagcctgtcttatgttcgagggcgtcaaggaggatcagaccaaatttctgaagatcaaaaccgtgagctctgaactctcctgccgggaggggcaaagctactggacaggatctttctcccccaagtgtctgagctctagacgctgccacctggttggcgaatgtcatgtgaatcggtgccttagctggagagacaacgagacctccgccgaatttagcttcgtcggggagtctacaacgatgcgcgagaataaatgctttgaacagtgtggcggatggggctgcgggtgtttcaacgtgaatccttcctgcctctttgttcacacctatctgcagagcgtgcggaaggaggctctgagagtcttcaactgtattgactgggtgcataagctcacactggaaatcaccgattttgacggatccgtgtctacaattgatcttggcgcgagctcctctcgcttcaccaattgggggagcgtctccctgtctctcgacgccgagggaatcagcggctccaacagcttctcttttattgagtcccccgggaaaggctacgctatcgttgatgaaccgttcagcgagatccctcggcagggatttctgggcgaaattagatgcaattctgagtccagcgtgctgtctgcccacgaatcctgtcttcgcgcccccaacctcatcagctataagcccatgattgaccaactggagtgcacgaccaatctgatcgatcctttcgtggtctttgagcgggggtccctcccgcagacaagaaacgacaaaaccttcgctgccagcaagggaaatcgcggcgtgcaggcgttttctaaagggagcgttcaggctgatctgacacttatgttcgacaactttgaagtggatttcgtcggagccgccgtgtcctgtgacgctgcctttctgaatctcaccggctgctactcttgtaacgcgggggctcgggtttgcctgagcattacgtccacaggcaccggaacactgtctgcccacaacaaggatggcagccttcatatcgtgctcccctccgagaatgggaccaaggaccaatgccagatcctgcacttcaccgtccctgaagtggaggaagagtttatgtattcttgtgacggagatgagagacccctgctcgttaaaggcacactgattgccatcgaccctttcgatgaccggcgcgaagctgggggagagagcacggtggtcaaccccaagtccggcagctggaatttctttgattggttctctggccttatgtcctggtttgggggacctctgaaaaccattctcctgatctgcctgtacgtggcccttagcattggcctcttctttctgctgatctacctcgggagaacaggactgtctaagatgtggcttgctgccaccaaaaaggcgtcctga

SEQ ID NO: 14591 - RNA, 3204 nt, synthetic construct
  misc_feature 1..3204: note = derived and/or modified CDS sequence (opt5) from RVFV(KEN/Bar-032/07)__HM586968.1__Gn-Gc
  source 1..3204: mol_type = other RNA
atggccggcatcgctatgaccgtgctgcccgccctcgcggtcttcgctctggcccctgttgtgtttgccgaggacccgcaccttagaaatcggcccgggaagggacataattacattgatggccgcctgcaggaagacgctacatgcaaacctgtgacgtatgccggggcttgtagctccttcgatgtcctcctggagaagggaaaatttccccttttccaatcttacgcccaccatagaaccctgctcgaagcggtgcacgacacaatcattgccaaggctgatcctcccagctgcgacctgcagtccgccgatggcaacaaatgtatgaaggagaagctggttatgaaaacccattgccctaatgactatcagtctgctcactacctcaacaatgatgggaagatggccagcgtgaaatgtccgcccaagtatgaactgacagaggactgcaacttttgtcggcagatgaccggagcgtcccttaaaaagggctcttaccctctgcaagatctcttctgccagagctccgaggacgatggcagcaagctgaaaacaaagatgaaaggggtctgtgaagtgggagttcaggcccttaagaaatgcgacggccagctgtctaccgctcacgaggtggtcccctttgccgtgttcaaaaattccaagaaggtgtatctcgacaagctggatctgaaaacggaagagaacctcctgcctgacagctttgtctgtttcgagcataaggggcaatacaaaggaaccatggattctggccagacaaagcgcgaacttaaatcctttgacatcagccagtgccccaagattgggggacacggctctaagaaatgcaccggcgatgctgccttctgttccgcctacgagtgcacagctcagtatgcgaatgcctactgtagccatgctaacgggtccggaatcgttcaaatccaggtgtctggcgtgtggaagaaaccgctgtgcgtcgggtatgaaagagtggttgtgaagcgggagctcagcgccaaacctattcagcgcgtcgaaccctgtaccacgtgcatcacaaagtgtgagcctcacggactggtggttagatccaccggctttaagattagctctgccgtggcttgcgcctccggggtctgtgtgacaggaagccaatctcccagcaccgagatcacccttaaataccccggcatttcccagtctagcgtcggcgacatcggggtgcacatggcgcatgatgaccagtccgttagctctaagattgtggctcactgccctccgcaggatccctgtctggtccatggatgcatcgtgtgcgcccacggcctcatcaattatcaatgtcatacagccctgtccgctttcgttgtgattttcgtctttagctctacggccatcatttgcctggctgtgctctaccgggtgctgaaatgtcttaagatcgcccctcgcaaagttctgaaccccctcatgtggattaccgcgttcatcagatgggtctataagaagatggtggcccgggtggctgacaatatcaaccaggtcaatcgcgaaattgggtggatggagggaggccagctggcccttgggaaccctgctcccatcccgagacacgcccctattccccggtactccacatacctgatgctcctgctgatcgtgagctatgcgtccgcctgctctgaactcattcaggctagctcccgcatcaccacatgttctaccgagggcgttaacacgaaatgcagactgagccacacagcccttatccgggctggatccgtgggcgccgaagcctgtctgatgctcaagggggtcaaagaggatcaaaccaagtttctgaaaattaagaccgtgagctctgagctgtcctgcagagaaggacagagctactggacaggctctttctcccctaaatgtcttagctctcgccggtgccatctcgttggggagtgtcacgtgaatagatgcctgagctggcgcgacaacgaaacctccgctgagtttagcttcgtcggagaatctacaacgatgcgggagaataagtgctttgagcagtgtggcgggtggggctgcggatgtttcaacgtgaatccctcctgcctgtttgttcatacctatctccagagcgtgagaaaggaagcgctgcgcgtcttcaactgtatcgactgggtgcacaaacttacactggagattaccgattttgacggctccgtgtctacaatcgatctcggggccagctcctctcggttcaccaattggggaagcgtctccctgtctctggacgctgaaggcattagcgggtccaacagcttttctttcatcgagtcccctggaaagggctacgccattgttgatgagcccttcagcgaaatcccgagacaagggtttcttggcgagatccgctgcaattctgaatccagcgtgctctctgcccacgagtcctgtctgcgggctcctaacctggtgagctataaacccatgattgaccagctcgaatgcacgaccaatctgatcgatcccttcgtcgtgtttgagagaggatcccttcctcagacacgcaacgacaagaccttcgccgcgagcaaaggcaatagaggggttcaggctttttctaagggaagcgtgcaagccgatctgacactccggttcgacaactttgaggtcgatttcgtgggcgccgctgtttcctgtgacgccgcgtttctgaatctgaccgggtgctactcttgtaacgctggagcccgggtgtgccttagcattacgtccacaggcaccgggacactctctgcccataacaaggatggcagcctgcacatcgtcctgccgtccgaaaatggaaccaaagaccagtgccagattctccatttcaccgtgcccgaggttgaagaggaatttatgtattcttgtgacggcgatgagcgccctctgcttgtgaaggggacactgatcgctatcgaccccttcgatgacagacgggaggccggaggcgaaagcacggtcgtgaaccctaaatccgggagctggaactttttcgattggttctctggactcatgtcctggtttggcggccccctgaagaccattctgcttatctgcctctacgtggctctgagcattgggctgttctttctcctgatctaccttggaagaacaggcctgtctaaaatgtggctcgccgcgaccaagaaggcctcctga

SEQ ID NO: 14592 - RNA, 3204 nt, synthetic construct
  misc_feature 1..3204: note = derived and/or modified CDS sequence (opt5) from RVFV(TAN/Dod-002/07)__HM586971.1__Gn-Gc
  source 1..3204: mol_type = other RNA
atggccggcatcgctatgacagtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggccgcaagaagtgcacaggcgacgctgccttctgttctgcctacgagtgcaccgctcagtatgcgaatgcctactgttcccacgctaacgggagcggaatcgttcaaatccaggtgtccggcgtgtggaaaaagcctctttgcgtcgggtatgaaagagtggttgtgaaacgggagctgtctgccaagcccattcagcgcgtcgaaccttgtacgacatgcatcaccaaatgtgagccccacggactcgtggttagaagcacaggctttaagatttccagcgccgtggcttgcgcctctggggtctgtgtgaccggatcccaaagcccctctaccgagatcacactgaagtaccctggcattagccagtcctctggcggggatatcggagtccatatggcgcacgacgatcagagcgtgtccagcaaaattgttgctcattgcccgccccaggacccttgtcttgtgcacggctgcatcgtctgcgcccaagcctggatcatttctcagtggcatacggctctgtccgccttcgtggttatcttcgtgtttagctctaccgctattatctgtctcgccgtcctgtatcgggtgctgaagtgcctcaaaattgcgccccgcaaggtgctgaatcctcttatgtggatcacagccttcatcagatgggtttacaaaaagatggtcgctcgggtggccgataacattaatcaggtgaaccgcgaaatcgggtggatggagggaggccagctggctctcgggaatcccgccccgattcctagacacgcgcccatccctcggtattccacctacctgatgcttctgctcattgtcagctacgcctccgcttgttctgaactgatccaagccagctcccgcatcacaacctgctctacggagggcgtgaacacaaagtgtagactgagcggaaccgctctcattcgggccggctccgttggggccgaggcttgcctgatgcttaaaggagtgaaggaagaccagaccaaatttctgaagatcaaaacagtcagctctgagctctcctgtagagaaggccagagctattggaccgggtctttctcccccaagtgcctgagctctcgccggtgtcacctggtgggagagtgccatgttaacagatgtcttagctggcgcgataatgaaacatccgcggagtttagcttcgtgggcgaatctacgaccatgcgggagaacaaatgctttgagcagtgcgggggctggggatgtggctgcttcaatgtcaacccttcctgtctctttgtgcacacatacctgcaaagcgttagaaaggaagccctgcgcgtgttcaattgcattgactgggtccataagctcaccctggagatcacagactttgatgggtccgtgtctaccattgaccttggagctagctcctctcggttcacgaactggggcagcgtgtccctgtctctcgatgccgaagggatcagcggatccaatagcttttctttcattgagtcccccggcaaagggtatgccatcgtcgacgagccgttcagcgaaatccctagacagggctttctgggagagattcgctgtaactctgaatccagcgttctgtctgctcacgagtcctgccttcgggcccccaatctcgtgagctacaagcccatgatcgatcagctggaatgtaccacaaacctgattgaccctttcgtggtctttgagagaggctccctcccgcagacccgcaatgataaaacattcgcggctagcaaggggaaccggggagtgcaagccttttctaaaggcagcgttcaggccgacctgacccttatgttcgataattttgaggtggacttcgtcggggctgccgtgtcctgcgatgcggcttttctgaacctcacgggatgttattcttgcaatgccggcgccagagtttgtctgagcatcacatccaccgggacaggcaccctgtctgctcacaacaaggacggaagccttcatattgtgctcccctccgaaaacggcaccaaggatcagtgccaaatcctgcacttcacagtccctgaggtggaagaggaatttatgtactcttgcgacggggacgagcggcccctgctcgttaaaggaacgctgatcgccattgatcctttcgacgatcgcagagaggctggcggggaaagcaccgtggtcaatcccaagtccggaagctggaactttttcgactggttctctggccttatgtcctggtttggcgggcctctgaaaacaatcctcctgatttgtctgtatgtggcccttagcatcggactcttctttctgctgatttacctcggccggaccgggctgtctaagatgtggcttgcggccaccaaaaaggcttcctga

SEQ ID NO: 14593 - RNA, 3204 nt, synthetic construct
  misc_feature 1..3204: note = derived and/or modified CDS sequence (opt5) from RVFV(KEN/Gar-004/06)__HM586964.1__Gn-Gc
  source 1..3204: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattcccaaaaggtgtatctggacaaactcgacctgaagaccgaagagaacctgctccccgatagctttgtctgtttcgagcacaaggggcagtacaaaggaacaatggactctggccagaccaagcgggaactgaaatcctttgatatcagccagtgcccgaagattgggggacatggccgcaaaaagagaacaggcgacgctgccttctgctctgcctacgagtgtaccgctcaatatgcgaatgcctactgctcccgggctaacgggagcggaatcgttcagatccaggtgtcccgcgtgtggaagaaacctctttgtgtcggctatgaaagagtggttgtgaagcgggagctgtctgccaaacccattcaacgcgtcgaaccttgcacgacatgtatcaccaagtgcgagccccacgggctcgtggttagaagcacaggatttaaaatttccagcgccgtggcttgtgcctctggcgtctgcgtgaccgggtcccagagcccctctaccgagatcacactgaagtaccctggaattagccagtcctctggcggcgatatcggggtccacatggcgcatgacgatcagagcgtgtccagcaagattgttgctcactgtccgccccaagacccttgccttgtgcatggatgtatcgtctgcgcccacggcctgatcaataaccagtctcattccgccctcagcgctttcgtggttattttcgtgttttcttccacggccatcatttgcctggctgtcctgtatcgggtgctcaaatgtctgaagatcgctccccgcaaagtgcttaatcctctgatgtggattaccgcgttcatcagatgggtttacaagaaaatggtcgcccgggtggctgataacatcaatcaggtgaaccgcgaaattgggtggatggagggaggccagctcgccctggggaaccccgctccgatccctagacacgcccccattcctcggtatagcacataccttatgctgctcctgatcgtctcctacgcgtctgcctgcagcgaactgattcaagcctcctctagaatcaccacatgtagcaccgagggcgtgaatacgaagtgccgcctctccggaacagccctgatccgggctggcagcgttggggccgaagcctgtcttatgctgaagggagtgaaagaggaccagaccaagtttctcaaaattaagaccgtctcttccgagctgagctgcagagaaggccagtcttattggacagggtccttcagccccaaatgtctgtctagccgccggtgccaccttgtgggagagtgtcatgttaacagatgcctctcctggcgcgataatgaaaccagcgctgagttttctttcgtgggcgaatccacaacgatgcgggagaacaagtgttttgagcagtgcgggggctggggatgcggctgtttcaatgtcaaccctagctgcctgtttgtgcacacctacctgcaatccgttagaaaagaagcgctccgcgtgttcaattgtatcgactgggtccataagctgacacttgagattaccgactttgatgggtctgtgagcacaatcgacctgggagcctcctctagccggttcaccaactggggctccgtgtctctcagcctggatgctgaagggatttccggaagcaattctttttccttcatcgagagccccggcaaggggtatgccattgtcgacgagccgttctctgaaatccctagacagggctttctgggagagatccgctgcaactccgaaagctctgttctttccgcccacgagagctgtctccgggctcccaatctggtgtcctacaaacccatgattgatcagctggaatgcacgaccaacctcatcgaccctttcgtggtctttgagagaggcagcctgccgcagacacggaatgataagaccttcgccgcgtctaaagggaaccgcggagtgcaggcttttagcaagggctccgttcaagccgaccttacactgagattcgataattttgaggtggacttcgtcggggccgctgtgtcttgtgatgccgcgtttctcaacctgaccggatgctatagctgtaacgctggcgcccgggtttgcctgtccattacgtctacagggaccggcacacttagcgcccacaataaagacggatccctccatatcgtgctgccctctgaaaacggcaccaaggatcagtgtcaaattctgcacttcaccgtccctgaggtggaagaggaatttatgtacagctgcgacggggacgagagacccctcctggttaagggaacacttatcgctatcgatcctttcgacgatcgccgggaggccggcggggaatccacggtggtcaatcccaaaagcggatcttggaactttttcgactggttctccggcctgatgagctggtttggcgggcctctcaagaccattctgctgatctgcctttatgtggctctctctattggactgttctttctgctcatctacctgggcagaacagggctttccaaaatgtggctggccgcgaccaagaaagccagctga

SEQ ID NO: 14594 - RNA, 1680 nt, synthetic construct
  misc_feature 1..1680: note = derived and/or modified CDS sequence (opt5) from RVFV(ZH-548)__DQ380206.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctcctgtccgcccatggcaacccttgtatgaaagagaagctggttatgaagacacactgcccgaatgattatcagtctgctcactacctcaacaatgacgggaaaatggccagcgtgaagtgtccccctaaatatgaactgaccgaggattgcaacttttgtagacagatgacaggagcgtcccttaagaaaggctcttaccccctgcaggacctcttctgccaaagctccgaggatgacggcagcaagctgaagaccaaaatgaagggggtctgtgaagtgggagttcaggcccttaaaaagtgcgatggccagctgtctacggctcatgaggtggtcccttttgccgtgttcaaaaattccaagaaagtgtatctcgacaagctggacctgaagaccgaagagaacctcctgcccgatagctttgtctgtttcgagcacaaagggcagtacaagggaacaatggactctggccaaaccaaacgggaacttaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcagatccaagtgtctggcgtgtggaaaaagcctctgtgcgtcgggtatgaacgcgtggttgtgaaaagagagctcagcgccaagcccattcagcgggtcgaaccttgtacgacatgcatcaccaaatgtgagccccacggactggtggttcgctccacaggctttaagattagctctgccgtggcttgcgcctccggggtctgtgtgaccggaagccagtctcccagcaccgagatcacacttaagtaccctggcatttcccaatctagcggcggggatatcggagtccatatggcgcacgacgatcagtccgtgagctctaaaattgttgctcattgcccgccccaggacccttgtctggtgcacgattgcatcgtctgcgcccatggcctcatcaattatcagtgtcacacggccctgtccgctttcgtggttgtgttcgtctttagctctattgccatcatttgcctggctatcctctacagagtgctgaagtgtcttaaaattgcgccccggaaggtgctgaaccctctcatgtggatcaccgccttcatccgctggatttataaaaagatggttgccagagtcgctgacaatatcaaccaagtgaatcgggaaattgggtggatggagggaggccagctggtgcttgggaaccccgccccgatccctcgccacgctcccattcctagatactccacatacctgatgctcctgctgatcgtcagctatgcctccgcg

SEQ ID NO: 14595 - RNA, 1680 nt, synthetic construct
  misc_feature 1..1680: note = derived and/or modified CDS sequence (opt5) from RVFV(MP-12)__DQ380208.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctcctgtccgcccatggcaacccttgtatgaaagagaagctggttatgaagacacactgcccgaatgattatcagtctgctcaccatctcaacaatgacgggaaaatggccagcgtgaagtgtccccctaaatacgaactgaccgaggattgcaacttttgtagacagatgacaggagcgtcccttaagaaaggctcttatcccctgcaggacctcttctgccaaagctccgaggatgacggcagcaagctgaagaccaaaatgaagggggtctgtgaagtgggagttcaggcccttaaaaagtgcgatggccagctgtctacggctcacgaggtggtcccttttgccgtgttcaaaaattccaagaaagtgtacctcgacaagctggacctgaagaccgaagagaacctcctgcccgatagctttgtctgtttcgagcataaagggcagtataagggaacaatggactctggccaaaccaaacgggaacttaagtcctttgatatcagccagtgcccgaaaattgggggacacggctctaagaagtgcacaggcgacgctgccttctgttccgcctacgagtgcaccgctcagtacgcgaatgcctattgtagccacgctaacgggtccggaatcgttcagatccaagtgtctggcgtgtggaaaaagcctctgtgcgtcgggtacgaacgcgtggttgtgaaaagagagctcagcgccaagcccattcagcgggtcgaaccttgtacgacatgcatcaccaaatgtgagccccatggactggtggttcgctccacaggctttaagattagctctgccgtggcttgcgcctccggggtctgtgtgaccggaagccagtctcccagcaccgagatcacacttaagtatcctggcatttcccaatctagcggcggggatatcggagtccacatggcgcatgacgatcagtccgtgagctctaaaattgttgctcactgcccgccccaggacccttgtctggtgcatgattgcatcgtctgcgcccacggcctcatcaattaccagtgtcacacggccctgtccgctttcgtggttgtgttcgtctttagctctattgccatcatttgcctggctatcctctatagagtgctgaagtgtcttaaaattgcgccccggaaggtgctgaaccctctcatgtggatcaccgccttcatccgctggatttacaaaaagatggttgccagagtcgctgacaatatcaaccaagtgaatcgggaaattgggtggatggagggaggccagctggtgcttgggaaccccgccccgatccctcgccatgctcccattcctagatattccacatacctgatgctcctgctgatcgtcagctacgcctccgcg

SEQ ID NO: 14596 - RNA, 1680 nt, synthetic construct
  misc_feature 1..1680: note = derived and/or modified CDS sequence (opt5) from RVFV(MP12)__Z30318.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctcctgtccgcccatggcaacccttgtatgaaagagaagctggttatgaagacacactgcccgaatgattatcagtctgctcaccatctcaacaatgacgggaaaatggccagcgtgaagtgtccccctaaatacgaactgaccgaggattgcaacttttgtagacagatgacaggagcgtcccttaagaaaggctcttatcccctgcaggacctcttctgccaaagctccgaggatgacggcagcaagctgaagaccaaaatgaagggggtctgtgaagtgggagttcaggcccttaaaaagtgcgatggccagctgtctacggctcacgaggtggtcccttttgccgtgttcaaaaattccaagaaagtgtacctcgacaagctggacctgaagaccgaagagaacctcctgcccgatagctttgtctgtttcgagcataaagggcagtataagggaacaatggactctggccaaaccaaacgggaacttaagtcctttgatatcagccagtgcccgaaaattgggggacacggctctaagaagtgcacaggcgacgctgccttctgttccgcctacgagtgcaccgctcagtacgcgaatgcctattgtagccacgctaacgggtccggaatcgttcagatccaagtgtctggcgtgtggaaaaagcctctgtgcgtcgggtacgaacgcgtggttgtgaaaagagagctcagcgccaagcccattcagcgggtcgaaccttgtacgacatgcatcaccaaatgtgagccccatggactggtggttcgctccacaggctttaagattagctctgccgtggcttgcgcctccggggtctgtgtgaccggaagccagtctcccagcaccgagatcacacttaagtatcctggcatttcccaatctagcggcggggatatcggagtccacatggcgcatgacgatcagtccgtgagctctaaaattgttgctcactgcccgccccaggacccttgtctggtgcatgattgcatcgtctgcgcccacggcctcatcaattaccagtgtcacacggccctgtccgctttcgtggttgtgttcgtctttagctctattgccatcatttgcctggctatcctctatagagtgctgaagtgtcttaaaattgcgccccggaaggtgctgaaccctctcatgtggatcaccgccttcatccgctggatttacaaaaagatggttgccagagtcgctcataatatcaaccaagtgaatcgggaaattgggtggatggagggaggccagctggtgcttgggaaccccgccccgatccctcgccacgctcccattcctagatattccacatacctgatgctcctgctgatcgtcagctacgcctccgcg

SEQ ID NO: 14597 - RNA, 1680 nt, synthetic construct
  misc_feature 1..1680: note = derived and/or modified CDS sequence (opt5) from RVFV(2007001811)__EU574040.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgtacagagtgctcaagtgtctgaaaattgcgccccggaaggtgcttaaccctctgatgtggatcaccgccttcatccgctgggtttataaaaagatggtcgccagagtggctgataatattaaccaggtgaatcgggaaatcggatggatggagggcgggcagctcgtcctgggcaaccccgccccgattcctcgccacgctcccatccctagatactccacataccttatgctgctcctgattgtgagctatgcctccgcg

SEQ ID NO: 14598 - RNA, 1680 nt, synthetic construct
  misc_feature 1..1680: note = derived and/or modified CDS sequence (opt5) from RVFV(2250/74)__DQ380209.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgtacagagtgctcaagtgtctgaaaattgcgccccggaaggtgcttaaccctctgatgtggatcaccgccttcatccgctggatttataaaaagatggttgccagagtcgctgataatatcaaccaggtgaatcgggaaattggatggatggagggcgggcagctcgtgctgggcaaccccgccccgatccctcgccacgctcccattcctagatactccacataccttatgctgctcctgatcgtcagctatgcctccgcg

SEQ ID NO: 14599 - RNA, 1680 nt, synthetic construct
  misc_feature 1..1680: note = derived and/or modified CDS sequence (opt5) from RVFV(T1)__DQ380201.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctgtgctgtacagagtgctcaagtgtctgaaaatcgcgccccggaaggttcttaaccctctgatgtggattaccgccttcatccgctggatctataaaaagatggtcgccagagtggctgataatattaaccaggtgaatcgggaaatcggatggatggagggcgggcagctcgtcctgggcaaccccgccccgattcctcgccacgctcccatccctagatactccacataccttatgctgctcctgattgtgagctatgcctccgcg

SEQ ID NO: 14600 - RNA, 1680 nt, synthetic construct
  misc_feature 1..1680: note = derived and/or modified CDS sequence (opt5) from RVFV(Ken 199800523)__KU978777.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgccttttgtagccacgctaacgggtccggaatcgttcaaatccaggtgtctggcgtgtggaaaaagcctctttgcgtcgggtacgaacgcgtggttgtgaaaagagagctgagcgccaagcccattcagcgggtcgaaccttgtacgacatgcatcaccaaatgtgagccccacggactcgtggttcgctccacaggcttcaagattagctctgccgtggcttgcgcctccggggtctgtgtgaccggaagccaatctcccagcaccgagatcacactgaagtatcctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattaccaatgtcacacggccctctccgctttcgtggttgtgtttgtcttcagctctattgccatcatttgcctggctatcctgtatagagtgctcaagtgtctgaaaattgcgccccggaaggtgcttaaccctctgatgtggatcaccgcctttatccgctgggtttacaaaaagatggtcgccagagtggctgataatattaaccaggtgaatcgggaaatcggatggatggagggcgggcagctcgtcctgggcaaccccgccccgattcctcgccacgctcccatccctagatattccacataccttatgctgctcctgattgtgagctacgcctccgcg

SEQ ID NO: 14601 - RNA, 1680 nt, synthetic construct
  misc_feature 1..1680: note = derived and/or modified CDS sequence (opt5) from RVFV(1853/78)__DQ380220.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggagttgtgcaaatccaggtgtctggcgtctggaaaaagcctctttgcgtggggtatgaacgcgttgtggtcaaaagagagctgagcgccaagcccatccagcgggtggaaccttgtacgacatgcattaccaaatgtgagccccacggactcgttgtgcgctccacaggctttaagatcagctctgccgtcgcttgcgcctccggggtgtgtgtcaccggaagccaatctcccagcaccgagattacactgaagtaccctggcatctcccagtctagcggcggggatattggagtgcatatggcgcacgacgatcagtccgttagctctaaaatcgtggctcattgcccgccccaggacccttgtcttgtccacggctgcattgtgtgcgcccatgggctgatcaattatcaatgtcacacggccctctccgctttcgttgtggtcttcgtgtttagctctatcgccattatctgcctggctattctgtacagagtgctcaagtgtctgaaaatcgcgccccggaaggttcttaaccctctgatgtggattaccgccttcatccgctgggtctataaaaagatggtggccagagtggctgataatatcaaccaggtcaatcgggaaattggatggatggagggcgggcagctcgtgctgggcaaccccgccccgatccctcgccacgctcccattcctagatactccacataccttatgctgctcctgatcgttagctatgcctccgcg

SEQ ID NO: 14602 - RNA, 1680 nt, synthetic construct
  misc_feature 1..1680: note = derived and/or modified CDS sequence (opt5) from RVFV(73HB1449)__DQ380211.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaaaatccctctaccgagatcacactgaagtaccctggcattagccagtcctctggcggggatatcggagtccatatggcgcacgacgatcagagcgtgtccagcaaaattgttgctcattgcccgccccaggacccttgtcttgtgcacggctgcatcgtctgcgcccatgggctgatcaactatcaatgtcacacggccctctctgctttcgtggttgtgttcgtcttttccagcattgccatcatttgcctggctatcctgtacagagtgctcaagtgtctgaaaattgcgccccggaaggtgcttaatcctctgatgtggatcaccgccttcatccgctgggtttataaaaagatggtcgccagagtggctgataacattaatcaggtgaaccgggaaatcggatggatggagggcgggcagctcgtcctgggcaaccccgccccgattcctcgccacgctcccatccctagatactctacataccttatgctgctcctgattgtgtcctatgccagcgcg

SEQ ID NO: 14603 - RNA, 1680 nt, synthetic construct
  misc_feature 1..1680: note = derived and/or modified CDS sequence (opt5) from RVFV(2007000234)__JF326191.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttattttcgtgtttagctctaccgccatcatttgcctggctgtcctgtacagagtgctcaagtgtctgaaaatcgcgccccggaaggtgcttaaccctctgatgtggattacagccttcatccgctgggtttataaaaagatggtcgccagagtggctgataatatcaaccaggtgaatcgggaaattggatggatggagggcgggcagctcgccctgggcaaccccgctccgatccctcgccacgcccccattcctagatactccacctaccttatgctgctcctgatcgtcagctatgcgtccgcc

SEQ ID NO: 14604 - RNA, 1680 nt, synthetic construct
  misc_feature 1..1680: note = derived and/or modified CDS sequence (opt5) from RVFV(73HB1230)__DQ380221.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaaaaggaactgaaatcctttgatatcagccagtgcccgaagattgggggacatggctctaagaaatgcacaggcgacgctgccttctgttccgcctacgagtgcaccgctcagtatgcgaatgcctactgtagccacgctaacgggtccggaatcgttcaaatccaggtgtctggcgtgtggaagaaacctctttgcgtcgggtatgaacgggtggttgtgaagcgcgagctgagcgccaaacccattcagagagtcgaaccttgtacgacatgcatcaccaagtgtgagccccacggactcgtggttcggtccacaggctttaagattagctctgccgtggcttgcgcctccggggtctgtgtgaccggaagccaatctcccagcaccgagatcacactgaaataccctggcatttcccagtctagcggcggggatatcggagtccatatggcgcacgacgatcagtccgtgagctctaagattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgtaccgcgtgctcaaatgtctgaagattgcccccagaaaagtgcttaaccctctgatgtggatcaccgcgttcatccggtgggtttataagaagatggtcgcccgcgtggctgataatattaaccaggtgaatagagaaatcggatggatggagggcgggcagctcgtcctgggcaaccccgccccgattcctcggcacgctcccatccctcgctactccacataccttatgctgctcctgattgtgagctatgcctccgcg

SEQ ID NO: 14605 - RNA, 1680 nt, synthetic construct
  misc_feature 1..1680: note = derived and/or modified CDS sequence (opt5) from RVFV(ZM-657)__DQ380204.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaaagcctactgtagccacgctaatgggtccggaatcgttcaaatccaggtgtctggcgtgtggaagaaacctctttgcgtcgggtatgaacgcgtggttgtgaagagagagctgagcgccaaacccattcagcgggtcgaaccttgtacgacatgcatcaccaagtgtgagccccacggactcgtggttcgctccacaggctttaagattagctctgccgtggcttgcgcctccggggtctgtgtgaccggaagccaatctcccagcaccgagatcacactgaaataccctggcatttcccagtctagcggcggggatatcggagtccatatggcgcacgacgatcagtccgtgagctctaagattgttgctcattgcccgccccaggacccttgtcttgtgcacggctgcatcgtctgcgcccatgggctgatcaactatcaatgtcacacggccctctccgctttcgtggttgtgttcgtctttagctctattgccatcatttgcctggctatcctgtacagagtgctcaaatgtctgaagattgcgccccggaaagtgcttaatcctctgatgtggatcaccgccttcatccgctggatttataagaagatggttgccagagtcgctgataacatcaatcaggtgaaccgggaaattggatggatggagggcgggcagctcgtgctgggcaatcccgccccgatccctcgccacgctcccattcctagatactccacataccttatgctgctcctgatcgtcagctatgcctccgcg

SEQ ID NO: 14606 - RNA, 1680 nt, synthetic construct
  misc_feature 1..1680: note = derived and/or modified CDS sequence (opt5) from RVFV(Kenya 83 (21445))__DQ380198.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgtacagagtgctcaagtgtctgaaaattgcgccccggaaggtgcttaaccctctgatgtggatcaccgccttcatccgctgggtttataaaaagatggtcgccagagtggctgataatattaaccaggtgaatcgggaaatcggatggatggagggcgggcagctcgccctgggcaaccccgctccgattcctcgccacgcccccatccctagatactccacataccttatgctgctcctgattgtcagctatgcgtccgcc

SEQ ID NO: 14607 - RNA, 1680 nt, synthetic construct
  misc_feature 1..1680: note = derived and/or modified CDS sequence (opt5) from RVFV(SAUDI 200010901)__KU978778.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgccttttgtagccacgctaacgggtccggaatcgttcaaatccaggtgtctggcgtgtggaaaaagcctctttgcgtcgggtacgaacgcgtggttgtgaaaagagagctgagcgccaagcccattcagcgggtcgaaccttgtacgacatgcatcaccaaatgtgagccccacggactcgtggttcgctccacaggcttcaagattagctctgccgtggcttgcgcctccggggtctgtgtgaccggaagccaatctcccagcaccgagatcacactgaagtatcctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattaccaatgtcacacggccctctccgctttcgtggttgtgtttgtcttcagctctattgccatcatttgcctggctatcctgtatagagtgctcaagtgtctgaaaattgcgccccggaaggtgcttaaccctctgatgtggatcaccgcctttatccgctgggtttacaaaaagatggtcgccagagtggctgataatattaaccaggtgaatcgggaaatcggatggatggagggcgggcagctcgtcctgggcaaccccgccccgattcctcgccacgctcccatccctagatattccacataccttatgctgctcctgattatcagctacgcctccgcg

SEQ ID NO: 14608 - RNA, 1680 nt, synthetic construct
  misc_feature 1..1680: note = derived and/or modified CDS sequence (opt5) from RVFV(2007004194)__EU574031.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgagcaacgacgggaaaatggcctccgtgaagtgtccccctaaatatgaactcaccgaggattgcaatttttgtagacagatgacaggagcgtctctgaagaaaggcagctacccccttcaagacctgttctgccagtccagcgaggatgacggctctaagctcaagaccaaaatgaagggggtctgtgaagtgggagttcaggccctgaaaaagtgcgatggccagctttccacggctcatgaggtggtcccttttgccgtgttcaaaaacagcaagaaagtgtatctggacaagctcgacctgaagaccgaagagaatctgctccccgattcttttgtctgtttcgagcacaaagggcaatacaagggaacaatggactccggccagaccaaacgggaacttaagagctttgatatctctcagtgcccgaaaattgggggacatggctccaagaagtgcacaggcgacgctgccttctgtagcgcctacgagtgcaccgctcagtatgcgaacgcctactgttcccacgctaatgggtctggaatcgttcaaatccaggtgagcggcgtgtggaaaaagcctctgtgcgtcgggtatgaacgcgtggttgtgaaaagagagctgtccgccaagcccattcagcgggtcgaaccttgtacgacatgcatcaccaaatgtgagccccacggactcgtggttcgcagcacaggctttaagatttcttccgccgtggcttgcgccagcggggtctgtgtgaccggatctcaaagcccctccaccgagatcacactgaagtaccctggcatttctcagagctccggcggggatatcggagtccatatggcgcacgacgatcagagcgtgtcttccaaaattgttgctcattgcccgccccaggacccttgtcttgtgcacggctgcatcgtctgcgcccatgggctgatcaactatcaatgtcacacggccctcagcgctttcgtggttgtgttcgtcttttcttccattgccatcatttgcctggctatcctgtacagagtgctcaagtgtctgaaaattgcgccccggaaggtgcttaatcctctgatgtggatcaccgccttcatccgctgggtttataaaaagatggtcgccagagtggctgataacattaatcaggtgaaccgggaaatcggatggatggagggcgggcagctcgtcctgggcaatcccgccccgattcctcgccacgctcccatccctagatacagcacataccttatgctgctcctgattgtgtcctatgcctctgcg

SEQ ID NO: 14609 - RNA, 1680 nt, synthetic construct
  misc_feature 1..1680: note = derived and/or modified CDS sequence (opt5) from RVFV(ZH-501-777)__DQ380202.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggacccgggccagaccaaacgggaactgaagtcttttgatatctcccagtgccctaaaattgggggacatggcagcaagaagtgcacaggcgacgctgccttctgttctgcctacgagtgcaccgctcagtatgcgaatgcctactgttcccacgctaacgggagcggaatcgttcaaatccaggtgtccggcgtgtggaaaaagcccctttgcgtcgggtatgaacgcgtggttgtgaaaagagagctgtctgccaagcctattcagcgggtcgaaccctgtacgacatgcatcaccaaatgtgagccccacggactcgtggttcgcagcacaggctttaagatttccagcgccgtggcttgcgcctctggggtctgtgtgaccggatcccaaagcccttctaccgagatcacactgaagtacccgggcattagccagtcctctggcggggatatcggagtccatatggcgcacgacgatcagagcgtgtccagcaaaattgttgctcattgtccccctcaggacccctgccttgtgcacggctgcatcgtctgcgcccatgggctgatcaattatcaatgtcacacggccctctctgctttcgtggttgtgttcgtcttttccagcattgccatcatttgcctggctgtgctgtacagagtgctcaagtgtctgaaaatcgcccctcggaaggttcttaaccccctgatgtggattaccgcgttcatccgctggatctataaaaagatggtcgccagagtggctgataatattaaccaggtgaatcgggaaatcggatggatggagggcgggcagctcgtcctgggcaacccggcccctattccccgccacgctcctatccccagatactctacataccttatgctgctcctgattgtgtcctatgccagcgcg

SEQ ID NO: 14610 - RNA, 1680 nt, synthetic construct
  misc_feature 1..1680: note = derived and/or modified CDS sequence (opt5) from RVFV(ZC-3349)__DQ380207.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcaggctgtgtccagcaaaattgttgcccattgcccgccccaggacccttgtcttgtgcacggctgcatcgtctgcgcccatgggctgatcaattatcaatgtcacacggctctctctgccttcgtggttgtgttcgtcttttccagcattgctatcatttgcctggccatcctgtacagagtgctcaagtgtctgaaaattgcgccccggaaggtgcttaaccctctgatgtggatcaccgccttcatccgctggatttataaaaagatggttgctagagtcgccgataatatcaaccacgtgaatcgggaaattggatggatggagggcgggcagctcgtgctgggcaaccccgctccgatccctcgccatgcccccattcctagatactctacataccttatgctgctcctgatcgtctcctatgcgagcgcc

SEQ ID NO: 14611 - RNA, 1680 nt, synthetic construct
  misc_feature 1..1680: note = derived and/or modified CDS sequence (opt5) from RVFV(200803166)__JF311381.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcaagaaaggaaagtttcccctgttccaatcttacgcccaccatcgcacacttctggaggcggtgcacgacaccatcattgccaaagctgatcctcccagctgcgacctccagtccgcccatggcaacccttgtatgaaggaaaagctggttatgaaaacacactgcccgaatgattatcagtctgctcactacctgaacaatgacgggaagatggccagcgtgaaatgtccccctaagtatgagctcaccgaagattgcaacttttgtagacagatgacaggagcgtccctgaaaaagggctcttacccccttcaagacctgttctgccagagctccgaggatgacggcagcaagctcaaaaccaagatgaaaggggtctgtgaggtgggagttcaggccctgaagaaatgcgatggccagctttctacggctcatgaagtggtcccttttgccgtgttcaaaaattccaagaaggtgtatctggacaagctcgacctgaaaaccgaggaaaacctgctccccgatagctttgtctgtttcgagcacaaggggcaatacaaaggaacaatggactctggccagaccaagcgggagctgaaatcctttgatatcagccagtgcccgaagattgggggacatggctctaagaaatgcacaggcgacgctgccttctgttccgcctacgaatgcaccgctcagtatgcgaatgcctactgtagccacgctaacgggtccggaatcgttcaaatccaggtgtctggcgtgtggaagaaacctctttgcgtcgggtatgagcgcgtggttgtgaagagagaactgagcgccaaacccattcagcgggtcgagccttgtacgacatgcatcaccaagtgtgaaccccacggactcgtggttcgctccacaggctttaagattagctctgccgtggcttgcgcctccggggtctgtgtgaccggaagccaatctcccagcaccgagatcacactgaaataccctggcatttcccagtctagcggcggggatatcggagtccatatggcgcacgacgatcagtccgtgagctctaagattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgtacagagtgctcaaatgtctgaagattgcgccccggaaagtgcttaaccctctgatgtggatcaccgccttcatccgctgggtttataagaagatggtcgccagagtggctgataatattaaccaggtgaatcgggagatcggatggatggaaggcgggcagctcgtcctgggcaaccccgccccgattcctcgccacgctcccatccctagatactccacataccttatgctgctcctgattgtgagctatgccaccgcg

SEQ ID NO: 14612 - RNA, 1680 nt, synthetic construct
  misc_feature 1..1680: note = derived and/or modified CDS sequence (opt5) from RVFV(1260/78)__DQ380214.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctatcctgcacagagtgctcaagtgtctgaaaattgcgccccggaaggtgcttaaccctctgatgtggatcaccgccttcatccgctgggtttacaaaaagatggtcgccagagtggctgataatattaaccaggtgaatcgggaaatcggatggatggagggcgggcagctcgtcctgggcaaccccgccccgattcctcgccatgctcccatccctagatattccacataccttatgctgctcctgattgtgagctacgcctccgcg

SEQ ID NO: 14613 - RNA, 1680 nt, synthetic construct
  misc_feature 1..1680: note = derived and/or modified CDS sequence (opt5) from RVFV(T-46 (228113))__DQ380199.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaaaagactctggccagaccaagcgggaactgaaatcctttgatatcagccagtgcccgaagattgggggacatggctctaagaaatgcacaggcgacgctgccttctgttccgcctacgagtgcaccgctcagtatgcgaatgcctactgtagccacgctaacgggtccggaatcgttcaaatccaggtgtctggcgtgtggaagaaacctctttgcgtcgggtatgaacgcgtggttgtgaagagagagctgagcgccaaacccattcagcgggtcgaaccttgtacgacatgcatcaccaagtgtgagccccacggactcgtggttcgctccacaggctttaagattagctctgccgtggcttgcgcctccggggtctgtgtgaccggaagccaatctcccagcaccgagatcacactgaaataccctggcatttcccagtctagcggcggggatatcggagtccatatggcgcacgacgatcagtccgtgagctctaagattgttgctcattgcccgccccaggacccttgtcttgtgcacggctgcatcgtctgcgcccatgggctgatcaattatcaatgtcacacggccctctccgctttcgtggttgtgttcgtctttagctctattgccatcatttgcctggctgtgctgtacagagtgctcaaatgtctgaagatcgcgccccggaaagttcttaaccctctgatgtggattaccgccttcatccgctggatctataagaagatggtcgccagagtggctgataatattaaccaggtgaatcgggaaatcggatggatggagggcgggcagctcgtcctgggcaaccccgccccgattcctcgccacgctcccatccctagatactccacataccttatgctgctcctgattgtgagctatgcctccgcg

SEQ ID NO: 14614 - RNA, 1680 nt, synthetic construct
  misc_feature 1..1680: note = derived and/or modified CDS sequence (opt5) from RVFV(ZINGA J83 R1)__KU978776.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagactgatgacaggagcgtcccttaagaaaggctcttaccccctgcaggacctcttctgccaaagctccgaggatgacggcagcaagctgaagaccaaaatgaagggggtctgtgaagtgggagttcaggcccttaaaaagtgcgatggccagctgtctacggctcatgaggtggtcccttttgccgtgttcaaaaattccaagaaagtgtatctcgacaagctggacctgaagaccgaagagaacctcctgcccgatagctttgtctgtttcgagcacaaagggcagtacaagggaacaatggactctggccaaaccaaacgggaacttaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcagatccaagtgtctggcgtgtggaaaaagcctctgtgcgtcgggtatgaacgcgtggttgtgaaaagagagctcagcgccaagcccattcagcgggtcgaaccttgtacgacatgcatcaccaaatgtgagccccacggactggtggttcgctccacaggctttaagattagctctgccgtggcttgcgcctccggggtctgtgtgaccggaagccagtctcccagcaccgagatcacacttaagtaccctggcatttcccaatctagcggcggggatatcggagtccatatggcgcacgacgatcagtccgtgagctctaaaattgttgctcattgcccgccccaggacccttgtctggtgcacggctgcatcgtctgcgcccatgggctcatcaattatcagtgtcacacggccctgtccgctttcgtggttgtgttcgtctttagctctattgccatcatttgcctggctatcctctacagagtgctgaagtgtcttaaaattgcgccccggaaggtgctgaaccctctcatgtggatcaccgccttcatccgctgggtttatagaaaaatggtcgcccgggtggctgataatattaaccaagtgaatcgcgaaatcggatggatggagggcgggcagctggtccttggcaaccccgccccgattcctagacacgtgcccatccctcggtactccacatacctgatgctcctgctgattgttagctatgcttccgcc

SEQ ID NO: 14615 - RNA, 1680 nt, synthetic construct
  misc_feature 1..1680: note = derived and/or modified CDS sequence (opt5) from RVFV(clone 13)__DQ380213.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaacatgaactcaccgaggattgcaacttttgtagacagatgacaggagcgtccctgaagaaaggctcttatccccttcaagacctgttctgccagagctccgaggatgacggcagcaagctcaagaccaaaatgaagggggtctgtgaagtgggagttcaggccctgaaaaagtgcgatggccagctttctacggctcacgaggtggtcccttttgccgtgttcaaaaattccaagaaagtgtacctggacaagctcgacctgaagaccgaagagaacctgctccccgatagctttgtctgtttcgagcataaagggcaatataagggaacaatggactctggccagaccaaacgggaactgaagtcctttgatatcagccagtgcccgaaaattgggggacacggctctaagaagtgcacaggcgacgctgccttctgttccgcctacgagtgcaccgctcagtacgcgaatgcctattgtagccacgctaacgggtccggaatcgttcaaatccaggtgtctggcgtgtggaaaaagcctctttgcgtcgggtacgaacgcgtggttgtgaaaagagagctgagcgccaagcccattcagcgggtcgaaccttgtacgacatgcatcaccaaatgtgagccccatggactcgtggttcgctccacaggctttaagattagctctgccgtggcttgcgcctccggggtctgtgtgaccggaagccaaaatccctctaccgagatcacactgaagtatcctggcattagccagtcctctggcggggatatcggagtccacatggcgcatgacgatcagagcgtgtccagcaaaattgttgctcactgcccgccccaggacccttgtcttgtgcatggctgcatcgtctgcgcccacgggctgatcaactaccaatgtcacacggccctctctgctttcgtggttgtgttcgtcttttccagcattgccatcatttgcctggctatcctgtatagagtgctcaagtgtctgaaaattgcgccccggaaggtgcttaatcctctgatgtggatcaccgccttcatccgctgggtttacaaaaagatggtcgccagagtggctgataacattaatcaggtgaaccgggaaatcggatggatggagggcgggcagctcgtcctgggcaaccccgccccgattcctcgccatgctcccatccctagatattctacataccttatgctgctcctgattgtgtcctacgccagcgcg

SEQ ID NO: 14616 - RNA, 1680 nt, synthetic construct
  misc_feature 1..1680: note = derived and/or modified CDS sequence (opt5) from RVFV(SA01-1322)__KX096942.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgccttttgtagccacgctaacgggtccggaatcgttcaaatccaggtgtctggcgtgtggaaaaagcctctttgcgtcgggtacgaacgcgtggttgtgaaaagagagctgagcgccaagcccattcagcgggtcgaaccttgtacgacatgcatcaccaaatgtgagccccacggactcgtggttcgctccacaggcttcaagattagctctgccgtggcttgcgcctccggggtctgtgtgaccggaagccaatctcccagcaccgagatcacactgaagtatcctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattaccaatgtcacacggccctctccgctttcgtggttgtgtttgtcttcagctctattgccatcatttgcctggctatcctgtatagagtgctcaagtgtctgaaaattgcgccccggaaggtgcttaaccctctgatgtggatcaccgcctttatccgctgggtttacaaaaagatggtcgccagagtggctgataatattaaccaggtgaatcgggaaatcggatggatggagggcgggcagctcgtcctgggcgaccccgccccgattcctcgccacgctcccatccctagatattccacataccttatgctgctcctgattatcagctacgcctccgcg

SEQ ID NO: 14617 - RNA, 1680 nt, synthetic construct
  misc_feature 1..1680: note = derived and/or modified CDS sequence (opt5) from RVFV(25010-24)__KM210509.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcattgtgcgctccacaggctttaagatcagctctgccgttgcttgcgcctccggggtgtgtgtcaccggaagccaatctcccagcaccgagattacactgaagtaccctggcatctcccagtctagcggcggggatattggagtgcatatggcgcacgacgatcagtccgtcagctctaaaatcgtggctcattgcccgccccaggacccttgtcttgttcacggctgcatcgtgtgcgcccatgggctgattaattatcaatgtcacacggccctctccgctttcgtcgtggttttcgtgtttagctctgtcgccatcatttgcctggctatcctgtacaaggtgctcaaatgtctgaagattgcccccaaaaaggtgcttaaccctctgatgtggatcaccgcgttcatcagatgggtttataagaaaatggtcgcccgggtggctgataatattaaccaggtgaatcgcgaaatcggatggatggagggcgggcagctcgccctgggcaaccccgctccgattcctagacacgcccccatccctcggtactccacataccttatgctgctcctgattgtcagctatgcgtccgcc

SEQ ID NO: 14618 - RNA, 1680 nt, synthetic construct
  misc_feature 1..1680: note = derived and/or modified CDS sequence (opt5) from RVFV(200803162)__JF311377.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcgccaaatgtgagccccacggactcgtggttcgctccaccggctttaagattagctctgctgtggcctgcgcgtccggggtctgtgtgacaggaagccaatctcccagcaccgagatcaccctgaagtaccctggcatttcccagtctagcggcggggatatcggagtccatatggctcacgacgatcagtccgtgagctctaaaattgttgcccattgcccgccccaggacccttgtcttgtgcacgattgcatcgtctgcgcccatggcctgatcaattatcaatgtcacacagctctctccgccttcgtggttattttcgtgtttagctctacggctatcatttgcctggccgtcctgtacagagtgctcaagtgtctgaaaatcgcgccccggaaggtgcttaaccctctgatgtggattaccgccttcatccgctgggtttataaaaagatggtcgctagagtggccgacaatatcaaccaggtgaatcgggaaattgggtggatggagggaggccagctcgctctgcgcaaccccgccccgatccctagacacgcgcccattcctcggtactccacataccttatgctgctcctgatcgtcagctatgcctccgct

SEQ ID NO: 14619 - RNA, 1680 nt, synthetic construct
  misc_feature 1..1680: note = derived and/or modified CDS sequence (opt5) from RVFV(2007002476)__EU574036.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttattttcgtgtttagctctaccgccatcatttgcctggctgtcctgtacagagtgctcaagtgtctgaaaatcgcgccccggaaggtgcttaaccctctgatgtggattacagccttcatcaaatgggtttataagaagatggtcgcccgcgtggctgataatatcaaccaggtgaatagagaaattggatggatggagggcgggcagctcgccctgggcaaccccgctccgatccctcggcacgcccccattcctcgctactccacctaccttatgctgctcctgatcgtcagctatgcgtccgcc

SEQ ID NO: 14620 - RNA, 1680 nt, synthetic construct
  misc_feature 1..1680: note = derived and/or modified CDS sequence (opt5) from RVFV(Hv-B375)__DQ380218.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaaaacgaactcaccgaggattgcaatttttgtagacagatgacaggagcgtccctgaagaaaggctcttatccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaactccaagaaagtgtacctggacaagctcgacctgaagaccgaagagaatctgctccccgatagctttgtctgtttcgagcacaaagggcaatataagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtacgcgaacgcctattgtagccacgctaatgggtccggaatcgttcaaatccaggtgtctggcgtgtggaaaaagcctctttgcgtcgggtacgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtatcctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaactaccaatgtcacacggccctctccgctttcgtggttgtgttcgtctttagctctattgccatcatttgcctggctatcctgtatagagtgctcaagtgtctgaaaattgcgccccggaaggtgcttaatcctctgatgtggatcaccgccttcatccgctgggtttacaaaaagatggtcgccagagtggctgataacattaatcaggtgaaccgggaaatcggatggatggagggcgggcagctcgtcctgggcaaccccgccccgattcctcgccacgctcccatccctagatattccacataccttatgctgctcctgattgtgagctacgcctccgcg

SEQ ID NO: 14621 - RNA, 1680 nt, synthetic construct
  misc_feature 1..1680: note = derived and/or modified CDS sequence (opt5) from RVFV(OS-1)__DQ380186.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggagttgtgcaaatccaggtgtctggcgtctggaaaaagcctctttgcgtggggtatgaacgcgttgtggtcaaaagagagctgagcgccaagcccatccagcgggtggaaccttgtacgacatgcattaccaaatgtgagccccacggactcgttgtgcgctccacaggctttaagatcagctctgccgtcgcttgcgcctccggggtgtgtgtcaccggaagccaatctcccagcaccgagattacactgaagtaccctggcatctcccagtctagcggcggggatattggagtgcatatggcgcacgacgatcagtccgttagctctaaaatcgtggctcattgcccgccccaggacccttgtcttgtccacggctgcattgtgtgcgcccatgggctgatcaattatcaatgtcacacggccctctccgctttcgttgtggtcttcgtgtttagctctgtggccatcatttgcctggctatcctgtacaaggttctcaaatgtctgaagattgcccccagaaaagtccttaaccctctgatgtggatcaccgcgttcattcggtgggtgtataagaagatggtggcccgcgtcgctgataatatcaaccaggtgaatagagaaatcggatggatggagggcgggcagctcgccctgggcaaccccgctccgattcctcggcacgcccccatccctcgctactccacataccttatgctgctcctgattgttagctatgcgtccgcc

SEQ ID NO: 14622 - RNA, 1680 nt, synthetic construct
  misc_feature 1..1680: note = derived and/or modified CDS sequence (opt5) from RVFV(2373/74)__DQ380194.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaatggttgctcattgcccgccccaggacccttgtcttgtgcacggctgcattgtctgcgcccatgggctgatcaattatcaatgtcacacggccctctccgctttcgtggttgtgttcgtctttagctctgtggccatcatttgcctggctatcctgtacaaggtgctcaaatgtctgaagattgcccccagaaaagttcttaaccctctgatgtggatcaccgcgttcattcggtgggtctataagaagatggtggcccgcgtggctgataatatcaaccaggtcaatagagaaatcggatggatggagggcgggcagctcgccctgggcaaccccgctccgattcctcggcacgcccccatccctcgctactccacataccttatgctgctcctgattgtgagctatgcgtccgcc

SEQ ID NO: 14623 - RNA, 1680 nt, synthetic construct
  misc_feature 1..1680: note = derived and/or modified CDS sequence (opt5) from RVFV(Kenya 57 (Rintoul))__DQ380192.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagatcaaacgggaactgaagtcctttgatattagccagtgcccgaaaatcgggggacatggctctaagaagtgcaccggcgacgctgccttctgttccgcctacgagtgcacagctcagtatgcgaatgcctactgtagccacgctaacgggtccggaatcgttcaaattcaggtgtctggcgtgtggaaaaagcctctttgcgtcgggtatgaacgcgtggttgtgaaaagagagctgagcgccaagcccatccagcgggtcgaaccttgtaccacgtgcattacaaaatgtgagccccacggactcgtggttcgctccaccggctttaagatcagctctgccgtggcttgcgcctccggggtctgtgtgacaggaagccaatctcccagcaccgagattaccctgaagtaccctggcatctcccagtctagcggcggggatattggagtccatatggcgcacgacgatcagtccgtgagctctaaaatcgttgctcattgcccgccccaggacccttgtcttgtgcacggctgcatcgtctgcgcccatgggctgattaattatcaatgtcacacagccctctccgctttcgtggttgtgttcgtctttagctctgtggccatcatttgcctggctatcctgtacaaggtgctcaaatgtctgaagattgcccccagaaaagttcttaaccctctgatgtggatcacggcgttcatccggtgggtctataagaagatggtggcccgcgtggctgataatattaaccaggtcaatagagaaatcggatggatggagggcgggcagctcgtgctgggcaaccccgccccgattcctcggcacgctcccatccctcgctactccacctaccttatgctgctcctgattgttagctatgcctccgcg

SEQ ID NO: 14624 - RNA, 1680 nt, synthetic construct
  misc_feature 1..1680: note = derived and/or modified CDS sequence (opt5) from RVFV(Sudan 2V-2007)__JQ820490.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgttccgtgcacggctgcatcgtctgcgcccatgggcttatcaattatcaatgtcacacggccctgagcgctttcgtggttgtgttcgtcttttcttccattgccatcatttgcctcgctatcctgtacagagtgctgaagtgtctcaaaattgcgccccggaaggtgctgaaccctcttatgtggatcaccgccttcatccgctgggtttataaaaagatggtcgccagagtggctgataatattaaccaggtgaatcgggaaatcggatggatggagggcgggcagctggtcctcggcaaccccgccccgattcctcgccacgctcccatccctagatacagcacatacctgatgcttctgctcattgtgtcccatgcctctgcg

SEQ ID NO: 14625 - RNA, 1680 nt, synthetic construct
  misc_feature 1..1680: note = derived and/or modified CDS sequence (opt5) from RVFV(200803167)__JF311382.1__Gn
  source 1..1680: mol_type = other RNA
atggccggcatcgctatgaccgtgctgcccgccctcgcggtcttcgctctggcccctgttgtgtttgccgaggaccttcacctgagaaaccggccggggaagggacataattacattgatggcatgacacaggaagacgctacgtgcaaacccgtgacctatgccggggcttgtagctccttcgatgtcctcctggagaagggaaaatttcctcttttccaatcttacgcccaccatcgcacactgctcgaagcggtgcacgacaccatcattgccaaggctgatccccctagctgcgacctgcagtccgcccatggcaacccctgtatgaaagagaagctggttatgaagacacactgccctaatgattatcagtctgctcactacctcaacaatgacgggaaaatggccagcgtgaagtgtccgcccaaatatgaactgaccgaggattgcaacttttgtagacagatgacaggagcgtcccttaagaaaggctcttaccctctgcaagacctcttctgccagagctccgaggatgacggcagcaagctgaagaccaaaatgaagggggtctgtgaagtgggagttcaggcccttaaaaagtgcgatggccagctgtctacggctcatgaggtggtcccctttgccgtgttcaaaaattccaagaaagtgtatctcgacaagctggacctgaagaccgaagagaacctcctgcctgatagctttgtctgtttcgagcacaaagggcaatacaagggaacaatggactctggccagaccaaacgggaacttaagtcctttgatatcagccagtgccccaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagccgctgtgcgtcgggtatgaacgcgtggttgtgaaaagagagctcagcgccaagcctattcagcgggtcgaaccctgtacgacatgcatcaccaaatgtgagcctcacggactggtggttcgctccacaggctttaagattagctctgccgtggcttgcgcctccggggtctgtgtgaccggaagccaatctcccagcaccgagatcgcgcttaagtaccccggcatttcccagtctagcggcggggatatcggagtccatatggctcacgacgatcagtccgtgagctctaaaattgttgcccattgccctccgcaggacccctgtctggtgcacggctgcatcgtctgcgcccatgggctcatcaattatcaatgtcacacagctctgtccgccttcgtggttgtgttcgtctttagctctattgctatcatttgcctggccatcctctacagagtgctgaagtgtcttaaaattgcgcctcggaaggtgctgaaccccctcatgtggatcacggccttcatccgctgggtttataaaaagatggtcgctagagtggccgataatattaaccaggtgaatcgggaaatcggatggatggagggcgggcagctggtccttggcaaccctgctcccattccgcgccacgcccctatccccagatactccacctacctgatgctcctgctgattgtgagctatgcgtccgcc

SEQ ID NO: 14626 - RNA, 1680 nt, synthetic construct
  misc_feature 1..1680: note = derived and/or modified CDS sequence (opt5) from RVFV(KEN/Gar-008/06)__HM586965.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctcgcgtgtggaaaaagcctctttgcgtcggctatgaaagagtggttgtgaaacgggagctgagcgccaagcccattcagcgcgtcgaaccttgtacgacatgcatcaccaaatgtgagccccacgggctcgtggttagatccacaggatttaagattagctctgccgtggcttgcgcctccggcgtctgtgtgaccgggagccaatctcccagcaccgagatcacactgaagtaccctggaatttcccagtctagcggcggcgatatcggggtccatatggcgcacgacgatcagtccgtgagctctaaaattgttgctcattgcccgccccaggacccttgtcttgtgcacggatgcatcgtctgcgcccatggcctgatcaattatcaatgtcacacggccctctccgctttcgtggttattttcgtgtttagctctaccgccatcatttgcctggctgtcctgtaccgggtgctcaagtgtctgaaaatcgcgccccgcaaggtgcttaaccctctgatgtggattacagccttcatcagatgggtttataaaaagatggtcgcccgggtggctgataatatcaaccaggtgaatcgcgaaattgggtggatggagggaggccagctcgccctggggaaccccgctccgatccctagacacgcccccattcctcggtactccacctaccttatgctgctcctgatcgtcagctatgcgtccgcc

SEQ ID NO: 14627 - RNA, 1680 nt, synthetic construct
  misc_feature 1..1680: note = derived and/or modified CDS sequence (opt5) from RVFV(ANK-6087)__DQ380216.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaaaactggactctggccagacaaagcgggaacttaaatcctttgatatcagccagtgcccgaagattgggggacatggctctaagaaatgcaccggcgacgctgccttctgttccgcctacgagtgcacagctcagtatgcgaatgcctactgtagccacgctaacgggtccggaatcgttcaaatccaggtgtctggcgtgtggaagaaacctctgtgcgtcgggtatgaacgcgtggttgtgaagagagagctcagcgccaaacccattcagcgggtcgaaccttgtaccacgtgcatcacaaagtgtgagccccacggactggtggttcgctccaccggctttaagattagctctgccgtggcttgcgcctccggggtctgtgtgacaggaagccaatctcccagcaccgagatcacccttaaataccctggcatttcccagtctagcggcggggatatcggagtccatatggcgcacgacgatcagtccgtgagctctaagattgttgctcattgcccgccccaggacccttgtctggtgcacggctgcatcgtctgcgcccatgggctcatcaattatcaatgtcacacagccctgtccgctttcgtggttgtgttcgtctttagctctattgccatcatttgcctggctatcctctacagagtgctgaaatgtcttaagattgcgccccggaaagtgctgaaccctctcatgtggatcacggccttcatccgctgggtttatagaaagatggtcgcccgggtggctgataatattaaccaggtgaatcgcgaaatcggatggatggagggcgggcagctggtccttggcaaccccgccccgattcctagacacgtgcccatccctcggtactccacctacctgatgctcctgctgattgttagctatgcttccgcc

SEQ ID NO: 14628 - RNA, 1680 nt, synthetic construct
  misc_feature 1..1680: note = derived and/or modified CDS sequence (opt5) from RVFV(763/70)__DQ380188.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatggactcaccgaagattgcaacttttgtagacagatgacaggcgcgtccctgaagaaaggctcttacccccttcaagacctgttctgccagagctccgaggatgacgggagcaagctcaagaccaaaatgaagggagtctgtgaggtgggcgttcaggccctgaaaaagtgcgatgggcagctttctacggctcatgaagtggtcccttttgccgtgttcaaaaattccaagaaagtgtatctggacaagctcgacctgaagaccgaggaaaacctgctccccgatagctttgtctgtttcgagcacaaaggacaatacaagggcacaatggactctgggcagaccaaacgggagctgaagtcctttgatatcagccagtgcccgaaaattggaggccatggctctaagaagtgcacaggggacgctgccttctgttccgcctacgaatgcaccgctcagtatgcgaatgcctactgtagccacgctaacggatccggcatcgttcaaatccaggtgtctggggtgtggaaaaagcctctttgcgtcggatatgagcgcgtggttgtgaaaagagaactgagcgccaagcccattcagcgggtcgagccttgtacgacatgcatcaccaaatgtgaaccccacggcctcgtggttcgctccacagggtttaagattagctctgccgtggcttgcgcctccggagtctgtgtgaccggcagccaatctcccagcaccgagatcacactgaagtaccctggcatttcccagtctagcgggggagatatcggcgtccatatggcgcacgacgatcagtccgtgagctctaaaattgttgctcattgcccgccccaggacccttgtcttgtgcacgggtgcatcgtctgcgcccatggactgatcaattatcaatgtcacacggccctctccgctttcgtggttgtgttcgtctttagctctgtggccattatctgcctggctattctgtacaaggtgctcaaatgtctgaagatcgcccccagaaaagttcttaaccctctgatgtggattaccgcgttcatccggtgggtctataagaagatggtggcccgcgtggctgataatatcaaccaggtcaatagagagattggctggatggaagggggccagctcgccctgggaaaccccgctccgatccctcggcacgcccccattcctcgctactccacataccttatgctgctcctgatcgtgagctatgcgtccgcc

SEQ ID NO: 14629 - RNA, 1680 nt, synthetic construct
  misc_feature 1..1680: note = derived and/or modified CDS sequence (opt5) from RVFV(BIME-01)__KX609032.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttgtgttcgtctttagctctgtggccattatctgcctggctattctgtacaaggtgctcagatgtctgaaaatcgcccccaagaaagttcttaaccctctgatgtggattaccgcgttcatccggtgggtctataagaagatggtggcccgcgtggctgataatatcaaccaggtcaatagagaaattggatggatggagggcgggcagctcgccctgggcaaccccgctccgatccctcggcacgcccccattcctcgctactccacataccttatgctgctcctgatcattagctatgcgtccgcc

SEQ ID NO: 14630 - RNA, 1680 nt, synthetic construct
  misc_feature 1..1680: note = derived and/or modified CDS sequence (opt5) from RVFV(KEN07-KUR340)__EF460404.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcaaatccaggtgtctggcgtgtggaaaaagcctctttgcgtcgggtatgaacgcgtggttgtgaaaagagagctgagcgccaagcccattcagcgggtcgaaccttgtacgacatgcatcaccaaatgtgagccccacggactcgtggttcgctccacaggctttaagattagctctgccgtggcttgcgcctccggggtctgtgtgaccggaagccaatctcccagcaccgagatcacactgaagtaccctggcatttcccagtctagcggcggggatatcggagtccatatggcgcacgacgatcagtccgtgagctctaaaattgttgctcattgcccgccccaggacccttgtcttgtgcacggctgcatcgtctgcgcccatgggctgatcaattatcaatgtcacacggccctctccgctttcgtggttattttcgtgtttagctctaccgccatcatttgcctggctgtcctgtacagaatgctcaagtgtctgaaaatcgcgccccggattgtgcttaaccctctgatgtggatcacagccttcatccgctgggtgtataagaaaatggttgccagagtcgctgataatattaaccaggtgaatcgggaaatcggatggatggagggcgggcagctcgccctgggcaaccccgctccgattcctcgccacgcccccatccctagatactccacctaccttatgctgctcctgattgtgagctatgcgtccgcc

SEQ ID NO: 14631 - RNA, 1680 nt, synthetic construct
  misc_feature 1..1680: note = derived and/or modified CDS sequence (opt5) from RVFV(SA-51 (Van Wyck))__DQ380195.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacgcggctctaagaagtgcacaggcgacgctgccttctgttccgcctacgagtgcaccgctcagtatgcgaatgcctactgtagccatgctaacgggtccggaatcgttcaaatccaggtgtctggcgtgtggaaaaagcctctttgcgtcgggtatgaaagagtggttgtgaaacgggagctgagcgccaagcccattcagcgcgtcgaaccttgtacgacatgcatcaccaaatgtgagccccacggactcgtggttagatccacaggctttaagattagctctgccgtggcttgcgcctccggggtctgtgtgaccggaagccaatctcccagcaccgagatcacactgaagtaccctggcatttcccagtctagcggcggggatatcggagtccacatggcgcatgacgatcagtccgtgagctctaaaattgttgctcactgcccgccccaggacccttgtcttgtgcatggctgcatcgtctgcgcccacgggctgatcaattatcaatgtcatacggccctctccgctttcgtggttgtgttcgtctttagctctgtggccattatctgcctggctattctgtacaaggtgctcaaatgtctgaagatcgcgccccggaaagttcttaaccctctgatgtggattaccgccttcatccgctgggtctataagaagatggtggccagagtggctgataatatcaaccaggtcaatcgggaaattggatggatggagggcgggcagctcgccctgggcaaccccgctccgatccctcgccacgcccccattcctagatactccacataccttatgctgctcctgatcgtgagctatgcgtccgcc

SEQ ID NO: 14632 - RNA, 1680 nt, synthetic construct
  misc_feature 1..1680: note = derived and/or modified CDS sequence (opt5) from RVFV(Lunyo)__KU167026.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggtttctggccagaccaaacgggaactgaagtcctttgacatcagccagtgcccgaaaattgggggacatggctctaagaagtgcacaggcgatgctgccttctgttccgcctacgagtgcaccgctcagtatgcgaatgcctactgtagccacgctaacgggtccggaatcgtgcaaatccaggtgtctggcgtctggaaaaagcctctttgcgtggggtatgaacgcgttgtggtcaaaagagagctgagcgccaagcccattcagcgggtggaaccttgtacgacatgcatcaccaaatgtgagccccacggactcgttgtgcgctccacaggctttaagattagctctgccgtcgcttgcgcctccggggtgtgtgtcaccggaagccaatctcccagcaccgagatcacactgaagtaccctggcatttcccagtctagcggcggggacatcggagtgcatatggcgcacgatgaccagtccgttagctctaaaattgtggctcattgcccgccccaggatccttgtcttgtccacggctgcatcgtgtgcgcccatgggctgatcaattatcaatgtcacacggccctctccgctttcgttgtggtcttcgtgtttagctctgtggccattatctgcctggctattctgtacaaggttctcaaatgtctgaagatcgcccccagaaaagtccttaaccctctgatgtggattaccgcgttcatccggtgggtgtataagaagatggtggcccgcgtcgctgacaatatcaaccaggtgaatagagaaattggatggatggagggcgggcagctcgccctgggcaaccccgctccgatccctcggcacgcccccattcctcgctactccacataccttatgctgctcctgatcgttagctatgcgtccgcc

SEQ ID NO: 14633 - RNA, 1680 nt, synthetic construct
  misc_feature 1..1680: note = derived and/or modified CDS sequence (opt5) from RVFV(2269/74)__DQ380222.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaacataagggaacaatggactctggccagaccaaacgggaactgaagtcctttgatatcagccagtgcccgaaaattgggggacacggctctaagaagtgcacaggcgacgctgccttctgttccgcctacgagtgcaccgctcagtacgcgaatgcctattgtagccacgctaacgggtccggaatcgttcaaatccaggtgtctggcgtgtggaaaaagcctctttgcgtcgggtacgaacgcgtggttgtgaaaagagagctgagcgccaagcccattcagcgggtcgaaccttgtacgacatgcatcaccaaatgtgagccccatggactcgtggttcgctccacaggctttaagattagctctgccgtggcttgcgcctccggggtctgtgtgaccggaagccaatctcccagcaccgagatcacactgaagtatcctggcatttcccagtctagcggcggggatatcggagtccacatggcgcatgacgatcagtccgtgagctctaaaattgttgctcactgcccgccccaggacccttgtcttgtgcatggctgcatcgtctgcgcccacgggctgatcaattaccaatgtcacacggccctctccgctttcgtggttgtgttcgtctttagctctgtggccattatctgcctggctattctgtataaggtgctcaaatgtctgaagatcgcccccaaaaaggttcttaaccctctgatgtggattaccgcgttcatcagatgggtctacaagaaaatggtggcccgggtggctgataatatcaaccaggtcaatcgcgaaattggatggatggagggcgggcagctcgccctgggcaaccccgctccgatccctagacatgcccccattcctcggtattccacataccttatgctgctcctgatcgtgagctacgcgtccgcc

SEQ ID NO: 14634 - RNA, 1680 nt, synthetic construct
  misc_feature 1..1680: note = derived and/or modified CDS sequence (opt5) from RVFV(MgH824)__DQ380210.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggatacaattatattgatggcatgacacaggaagacgctacgtgcaaacctgtgacctacgccggggcttgtagctccttcgatgtcctgctcgagaagggaaaatttcccctgttccaatcttatgcccatcaccgcacacttctggaagcggtgcatgacaccatcattgccaaggctgatcctcccagctgcgacctccagtccgcccacggcaacccttgtatgaaagagaagctggttatgaagacacattgcccgaatgattaccagtctgctcactatctgaacaatgacgggaaaatggccagcgtgaagtgtccccctaaatacgaactcaccgaggattgcaacttttgtagacagatgacaggagcgtccctgaagaaaggctcttatccccttcaagacctgttctgccagagctccgaggatgacggcagcaagctcaagaccaaaatgaagggggtctgtgaagtgggagttcaggccctgaaaaagtgcgatggccagctttctacggctcacgaggtggtcccttttgccgtgttcaaaaattccaagaaagtgtacctggacaagctcgacctgaagaccgaagagaacctgctccccgatagctttgtctgtttcgagcggaaagggcaatacaagggaacaatggactctggccagaccaaacgcgaactgaagtcctttgatatcagccagtgcccgaaaattgggggacatggctctaagaagtgcacaggcgacgctgccttctgttccgcctatgagtgcaccacgcagtacgctaatgcgtattgtagccacgccaacgggtccggagttgtgcaaatccaggtgtctggcgtctggaaaaagcctctttgcgtggggtacgaaagagttgtggtcaaacgggagctgagcgctaagcccatccagcgcgtggaaccttgtacaacctgcattacaaaatgtgagccccatggactcgttgtgagatccaccggctttaagatcagctctgccgtcgcctgcgcttccggggtgtgtgtcaccggaagccaatctcccagcacagagattacgctgaagtatcctggcatctcccagtctagcggcggggatattggagtgcacatggcccacgacgatcagtccgttagctctaaaatcgtggcgcattgcccgccccaggacccttgtcttgtccacggctgcattgtgtgcgctcatgggctgatcaattaccaatgtcacaccgccctctccgccttcgttgtggtcttcgtgtttagctctatcgctattatctgcctggccattctgtatcgggtgctcaagtgtctgaaaatcgctccccgcaaggttcttaaccctctgatgtggattacagccttcatcagatggatctacaaaaagatggtcgcgcgggtggccgataatattaaccaggtgaatcgcgaaatcggatggatggagggcgggcagctcgtcctgggcaaccccgctccgattcctagacatgcccccatccctcggtactccacctatcttatgctgctcctgattgtgagctacgcttccgcc

SEQ ID NO: 14635 - RNA, 1680 nt, synthetic construct
  misc_feature 1..1680: note = derived and/or modified CDS sequence (opt5) from RVFV__JQ068143.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatcgactctggccagaccaaacgggaactgaagtcctttgatattagccagtgcccgaaaatcgggggacatggctctaagaagtgcacaggcgacgctgccttctgttccgcctacgagtgcaccgctcagtatgcgaatgcctactgtagccacgctaacgggtccggaatcgttcaaattcaggtgtctggcgtgtggaaaaagcctctttgcgtcgggtatgaacgcgtggttgtgaaaagagagctgagcgccaagcccatccagcgggtcgaaccttgtacgacatgcattaccaaatgtgagccccacggactcgtggttcgctccacaggctttaagatcagctctgccgtggcttgcgcctccggggtctgtgtgaccggaagccaatctcccagcaccgagattacactgaagtaccctggcatctcccagtctagcggcggggatattggagtccatatggcgcacgacgatcagtccgtgagctctaaaatcgttgctcattgcccgccccaggacccttgtcttgtgcacggctgcatcgtctgcgcccatgggctgattaattatcaatgtcacacggccctctccgctttcgtggttgtgttcgtctttagctctgtggccatcatttgcctggctatcctgtacaaggtgctcagatgtctgaaaattgcccccaagaaagttcttaaccctctgatgtggatcaccgcgttcatccggtgggtctataagaagatggtggcccgcgtggctgataatattaaccaggtcaatagagaaatcggatggatggagggcgggcagctcgccctgggcaaccccgctccgattcctcggcacgcccccatccctcgctactccacataccttatgctgctcctgattatcagctatgcgtccgcc

SEQ ID NO: 14636 - RNA, 1680 nt, synthetic construct
  misc_feature 1..1680: note = derived and/or modified CDS sequence (opt5) from RVFV(RVFBJ01/2016)__KX785331.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaacatgaactcaccgaggattgcaacttttgtagacagatgacaggagcgtccctgaagaaaggctcttatccccttcaagacctgttctgccagagctccgaggatgacggcagcaagctcaagaccaaaatgaagggggtctgtgaagtgggagttcaggccctgaaaaagtgcgatggccagctttctacggctcacgaggtggtcccttttgccgtgttcaaaaattccaagaaagtgtacctggacaagctcgacctgaagaccgaagagaacctgctccccgatagctttgtctgtttcgagcataaagggcaatataagggaacaatggactctggccagaccaaacgggaactgaagtcctttgatatcagccagtgcccgaaaattgggggacacggctctaagaagtgcacaggcgacgctgccttctgttccgcctacgagtgcaccgctcagtacgcgaatgcctattgtagccacgctaacgggtccggaatcgttcaaatccaggtgtctggcgtgtggaaaaagcctctttgcgtcgggtacgaacgcgtggttgtgaaaagagagctgagcgccaagcccattcagcgggtcgaaccttgtacgacatgcatcaccaaatgtgagccccatggactcgtggttcgctccacaggctttaagattagctctgccgtggcttgcgcctccggggtctgtgtgaccggaagccaatctcccagcaccgagatcacactgaagtatcctggcatttcccagtctagcggcggggatatcggagtccacatggcgcatgacgatcagtccgtgagctctaaaattgttgctcactgcccgccccaggacccttgtcttgtgcatggctgcatcgtctgcgcccacgggctgatcaattaccaatgtcacacggccctctccgctttcgtggttgtgttcgtctttagctctgtggccattatctgcctggctattctgtataaggtgctcagatgtctgaaaatcgcccccaagaaagttcttaaccctctgatgtggattaccgcgttcatccggtgggtctacaagaagatggtggcccgcgtggctgataatatcaaccaggtcaatagagaaattggatggatggagggcgggcagctcgccctgggcaaccccgctccgatccctcggcatgcccccattcctcgctattccacataccttatgctgctcctgatcattagctacgcgtccgcc

SEQ ID NO: 14637 - RNA, 1680 nt, synthetic construct
  misc_feature 1..1680: note = derived and/or modified CDS sequence (opt5) from RVFV(KEN/Kil-006/07)__HM586966.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgccgatggcaacaaatgtatgaaggagaagctggttatgaaaacacattgccctaatgactatcagtctgctcactacctgaacaatgatgggaagatggccagcgtgaaatgtccgcccaagtatgaactcaccgaggactgcaacttttgtagacagatgacaggagcgtccctgaaaaagggctcttaccctcttcaagatctgttctgccagagctccgaggacgatggcagcaagctcaaaaccaagatgaaaggggtctgtgaagtgggagttcaggccctgaagaaatgcgacggccagctttctacggctcacgaggtggtcccctttgccgtgttcaaaaattccaagaaggtgtatctggacaagctcgatctgaaaaccgaagagaacctgctccctgacagctttgtctgtttcgagcataaggggcaatacaaaggaacaatggattctggccagaccaagcgggaactgaaatcctttgacatcagccagtgccccaagattgggggacacggctctaagaaatgcacaggcgatgctgccttctgttccgcctacgagtgcaccgctcagtatgcgaatgcctactgtagccatgctaacgggtccggaatcgttcaaatccaggtgtctggcgtgtggaagaaaccgctttgcgtcgggtatgaacgcgtggttgtgaagagagagctgagcgccaaacctattcagcgggtcgaaccctgtacgacatgcatcaccaagtgtgagcctcacggactcgtggttcgctccacaggctttaagattagctctgccgtggcttgcgcctccggggtctgtgtgaccggaagccaatctcccagcaccgagatcacactgaaataccccggcatttcccagtctagcggcggggacatcggagtccacatggcgcatgatgaccagtccgtgagctctaagattgttgctcactgccctccgcaggatccctgtcttgtgcatggctgcatcgtctgcgcccacgggctgatcaattatcaatgtcatacggccctctccgctttcgtggttattttcgtgtttagctctaccgccatcatttgcctggctgtcctgtacagagtgctcaaatgtctgaagatcgcccctcggaaagtgcttaaccccctgatgtggattacagcgttcatccgctgggtttataagaagatggtcgccagagtggctgacaatatcaaccaggtgaatcgggaaattggatggatggagggcgggcagctcgccctgggcaaccctgctcccatcccgcgccacgcccctattcccagatactccacctaccttatgctgctcctgatcgtcagctatgcgtccgcc

SEQ ID NO: 14638 - RNA, 1680 nt, synthetic construct
  misc_feature 1..1680: note = derived and/or modified CDS sequence (opt5) from RVFV(SA-75)__DQ380189.1__Gn
  source 1..1680: mol_type = other RNA
atggccagaatcgctatgaccgtgctgcccgccctcgcggtcttcgctctggcccctgttgtgtttgccgaggacccgcaccttcggaaccgccccggcaaggggcataattacattgatggaatgacacaggaagacgctacgtgcaaacctgtgacctatgccggcgcttgtagctccttcgatgtcctgctcgagaaggggaaatttcccctgttccaatcttacgcccaccatagaacacttctggaagcggtgcacgacaccatcattgccaaggctgatcctcccagctgcgacctccagtccgcccatggaaacccttgtatgaaagagaagctggttatgaagacacactgcccgaatgattatcagtctgctcactacctgaacaatgacggcaaaatggccagcgtgaagtgtccccctaaatatgaactcaccgaggattgcaacttttgtcggcagatgacaggggcgtccctgaagaaaggatcttacccccttcaagacctgttctgccagagctccgaggatgacggcagcaagctcaagaccaaaatgaagggcgtctgtgaagtgggggttcaggccctgaaaaagtgcgatggacagctttctacggctcatgaggtggtcccttttgccgtgttcaaaaattccaagaaagtgtatctggacaagctcgacctgaagaccgaagagaacctgctccccgatagctttgtctgtttcgagcacaaaggccaatacaaggggacaatggactctggacagaccaaacgcgaactgaagtcctttgatatcagccagtgcccgaaaattggcgggcatggatctaagaagtgcacaggcgacgctgccttctgttccgcctacgagtgcaccgctcagtatgcgaatgcctactgtagccacgctaacggctccggggttgtgcaaatccaggtgtctggagtctggaaaaagcctctttgcgtgggctatgaaagagttgtggtcaaacgggagctgagcgccaagcccatccagcgcgtggaaccttgtacgacatgcattaccaaatgtgagccccacgggctcgttgtgagatccacaggatttaagatcagctctgccgtcgcttgcgcctccggcgtgtgtgtcaccgggagccaatctcccagcaccgagattacactgaagtaccctggaatctcccagtctagcggcggcgatattggggtgcatatggcgcacgacgatcagtccgttagctctaaaatcgtggctcattgcccgccccaggacccttgtcttgtccacggatgcattgtgtgcgcccatggcctgatcaattatcaatgtcacacggccctctccgctttcgttgtggtcttcgtgtttagctctgtggccatcatttgcctggctatcctgtacaaggttctcaaatgtctgaagattgcgccccggaaagtccttaaccctctgatgtggatcaccgtgttcattcgctgggtgtataagaagatggtcgccagagtggccgataatatcaaccaggttaatcgggaaatcgggtggatggagggaggccagctcgctctggggaaccccgccccgattcctcgccacgctcccatccctagatactccacataccttatgctgctcctgattgtgagctatgcctccgcg

SEQ ID NO: 14639 - RNA, 1680 nt, synthetic construct
  misc_feature 1..1680: note = derived and/or modified CDS sequence (opt5) from RVFV(35/74)__JF784387.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggagttgtgcaaatccaggtgtctggcgtctggaaaaagcctctttgcgtggggtatgaacgcgttgtggtcaaaagagagctgagcgccaagcccatccagcgggtggaaccttgtacgacatgcattaccaaatgtgagccccacggactcgttgtgcgctccacaggctttaagatcagctctgccgtcgcttgcgcctccggggtgtgtgtcaccggaagccaatctcccagcaccgagattacactgaagtaccctggcatctcccagtctagcggcggggatattggagtgcatatggcgcacgacgatcagtccgttagctctaaaatcgtggctcattgcccgccccaggacccttgtcttgtccacggctgcattgtgtgcgcccatgggctgatcaattatcaatgtcacacggccctctccgctttcgttgtggtcttcgtgtttagctctgtggccatcatttgcctggctatcctgtacaaggttctcaaatgtctgaagattgcccccagaaaagtccttgatcctctgatgtggatcaccgtgttcattcggtgggtgtataagaagatggtcgcgcgcgtggccgacaacatcaatcaggttaacagagaaatcggatggatggagggcgggcagctcgctctgggcaatcccgccccgattcctcggcacgctcccatccctcgctactccacataccttatgctgctcctgattgtgagctatgcctccgcg

SEQ ID NO: 14640 - RNA, 1680 nt, synthetic construct
  misc_feature 1..1680: note = derived and/or modified CDS sequence (opt5) from RVFV__M11157.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatggactcaccgaagattgcaacttttgtagacagatgacaggcgcgtccctgaagaaaggctcttacccccttcaagacctgttctgccagagctccgaggatgacgggagcaagctcaagaccaaaatgaagggagtctgtgaggtgggcgttcaggcccataaaaagtgcgatgggcagctgtctacggctcacgaagtggtcccttttgccgtgttcaaaaattccaagaaagtgtatcttgacaagctggacctcaagaccgaggaaaacctgctgcccgatagctttgtctgtttcgagcataaaggacaatacaagggcacaatggactctgggcagaccaaacgggagctcaagtcctttgatatcagccagtgcccgaaaattggaggccacggctctaagaagtgcacaggggacgctgccttctgttccgcctacgaatgcaccgctcagtatgcgaatgcctactgtagccacgctaacggatccggcatcgttcaaatccaggtgtctggggtgtggaaaaagcctctgtgcgtcggatatgagcgcgtggttgtgaaaagagaacttagcgccaagcccattcagcgggtcgagccttgtacgacatgcatcaccaaatgtgaaccccatggcctggtggttcgctccacagggtttaagattagctctgccgtggcttgcgcctccggagtctgtgtgaccggcagccaatctcccagcaccgagatcacactcaagtaccctggcatttcccagtctagcgggggagatatcggcgtccacatggcgcatgacgatcagtccgtgagctctaaaattgttgctcactgcccgccccaggacccttgtctggtgcatgggtgcatcgtctgcgcccacggacttatcaattatcaatgtcacacggccctgtccgctttcgtggttgtgttcgtctttagctctattgccatcatttgcctcgctgtgctgtacagagtgctgaagtgtctcaaaatcgcgccccggaaggttctgaaccctcttatgtggattaccgccttcatccgctggatctataaaaagatggtcgccagagtggctcataatattaaccaggtgaatcgggagatcggctggatggaagggggccagctggtcctcggaaaccccgccccgattcctcgccacgctcccatccctagatactccacatacctgatgcttctgctcattgtgagctatgcctccgcg

SEQ ID NO: 14641 - RNA, 1680 nt, synthetic construct
  misc_feature 1..1680: note = derived and/or modified CDS sequence (opt5) from RVFV(KEN/Bar-035/07)__HM586969.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggccgcctgcaggaagacgctacatgcaaacctgtgacgtatgccggggcttgtagctccttcgatgtcctcctggagaagggaaaatttccccttttccaatcttacgcccaccatagaaccctgctcgaagcggtgcacgacacaatcattgccaaggctgatcctcccagctgcgacctgcagtccgccgatggcaacaaatgtatgaaggagaagctggttatgaaaacccattgccctaatgactatcagtctgctcactacctcaacaatgatgggaagatggccagcgtgaaatgtccgcccaagtatgaactgacagaggactgcaacttttgtcggcagatgaccggagcgtcccttaaaaagggctcttaccctctgcaagatctcttctgccagagctccgaggacgatggcagcaagctgaaaacaaagatgaaaggggtctgtgaagtgggagttcaggcccttaagaaatgcgacggccagctgtctaccgctcacgaggtggtcccctttgccgtgttcaaaaattccaagaaggtgtatctcgacaagctggatctgaaaacggaagagaacctcctgcctgacagctttgtctgtttcgagcataaggggcaatacaaaggaaccatggattctggccagacaaagcgcgaacttaaatcctttgacatcagccagtgccccaagattgggggacacggctctaagaaatgcaccggcgatgctgccttctgttccgcctacgagtgcacagctcagtatgcgaatgcctactgtagccatgctaacgggtccggaatcgttcaaatccaggtgtctggcgtgtggaagaaaccgctgtgcgtcgggtatgaaagagtggttgtgaagcgggagctcagcgccaaacctattcagcgcgtcgaaccctgtaccacgtgcatcacaaagtgtgagcctcacggactggtggttagatccaccggctttaagattagctctgccgtggcttgcgcctccggggtctgtgtgacaggaagccaatctcccagcaccgagatcacccttaaataccccggcatttcccagtctagcggcggggacatcggagtccacatggcgcatgatgaccagtccgtgagctctaagattgttgctcactgccctccgcaggatccctgtctggtgcatggctgcatcgtctgcgcccacgggctcatcaattatcaatgtcatacagccctgtccgctttcgtggttattttcgtgtttagctctacggccatcatttgcctggctgtcctctaccgggtgctgaaatgtcttaagatcgcccctcgcaaagtgctgaaccccctcatgtggattaccgcgttcatcagatgggtttataagaagatggtcgcccgggtggctgacaatatcaaccaggtgaatcgcgaaattggatggatggagggcgggcagctggcccttggcaaccctgctcccatcccgagacacgcccctattccccggtactccacatacctgatgctcctgctgatcgtcagctatgcgtccgcc

SEQ ID NO: 14642 - RNA, 1680 nt, synthetic construct
  misc_feature 1..1680: note = derived and/or modified CDS sequence (opt5) from RVFV(Kenya 56 (IB8))__DQ380190.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacagggggacgctacgtgcaaacctgtgacctatgccggagcttgtagctccttcgatgtcctgctcgaaaagggcaaatttcccctgttccaatcttacgcccaccatcgcacacttctggaggcggtgcacgacaccatcattgccaaggctgatcctcccagctgcgacctccagtccgcccatgggaacccttgtatgaaagaaaagctggttatgaagacacactgcccgaaagattatcagtctgctcactacctgaataacgacggaaagatggccagcgtgaaatgtccccctaagtatgagctcaccgaagattgcaatttttgtagacagatgacaggcgcgtccctgaaaaagggctcttacccccttcaagacctgttctgccagagctccgaggatgacgggagcaagctcaaaaccaagatgaaaggagtctgtgaggtgggcgttcaggccctgaagaaatgcgatgggcagctttctacggctcatgaagtggtcccttttgccgtgttcaagaactccaaaaaggtgtatctggacaagctcgacctgaaaaccgaggaaaatctgctccccgatagctttgtctgtttcgagcacaagggacaatacaaaggcacaatggactctgggcagaccaagcgggagctgaaatcctttgatatcagccagtgcccgaagattggaggccatggctctaagaaatgcacaggggacgctgccttctgttccgcctacgaatgcaccgctcagtatgcgaacgcctactgtagccacgctaatggatccggcatcgttcaaatccaggtgtctggggtgtggaagcgccctctttgcgtcggatatgagagagtggttgtgaaacgggaactgagcgccaagcccattcagcgcgtcgagccttgtacgacatgcatcaccaaatgtgaaccccacggcctcgtggttagatccacagggtttaagattagctctgccgtggcttgcgcctccggagtctgtgtgaccggcagccaatctcccagcaccgagatcacactgaagtaccctggcatgtcccagtctagcgggggagatattggcgtccatatggcgcacgacgatcagtccgtgagctctaaaatcgttgctcattgcccgccccaggacccttgtcttgtgcacgggtgcattgtctgcgcccatggactgatcaactatcaatgtcacacggccctctccgctttcgtggttgtgttcgtctttagctctgtggccatcatttgcctggctatcctgtacaaggtgctcaaatgtctgaagattgcgccccggaaagttcttaatcctctgatgtggatcaccgccttcattcgctgggtctataagaagatggtggccagagtggctgataacatcaatcaggtcaaccgggagatcggctggatggaagggggccagcccgccctcggaaatccggctcctattccccgccacgcccctatccccagatactccacatacctgatgcttctgctcattgtgagctatgcgtccgcc

SEQ ID NO: 14643 - RNA, 1680 nt, synthetic construct
  misc_feature 1..1680: note = derived and/or modified CDS sequence (opt5) from RVFV(KEN/Bar-032/07)__HM586968.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggccgcctgcaggaagacgctacatgcaaacctgtgacgtatgccggggcttgtagctccttcgatgtcctcctggagaagggaaaatttccccttttccaatcttacgcccaccatagaaccctgctcgaagcggtgcacgacacaatcattgccaaggctgatcctcccagctgcgacctgcagtccgccgatggcaacaaatgtatgaaggagaagctggttatgaaaacccattgccctaatgactatcagtctgctcactacctcaacaatgatgggaagatggccagcgtgaaatgtccgcccaagtatgaactgacagaggactgcaacttttgtcggcagatgaccggagcgtcccttaaaaagggctcttaccctctgcaagatctcttctgccagagctccgaggacgatggcagcaagctgaaaacaaagatgaaaggggtctgtgaagtgggagttcaggcccttaagaaatgcgacggccagctgtctaccgctcacgaggtggtcccctttgccgtgttcaaaaattccaagaaggtgtatctcgacaagctggatctgaaaacggaagagaacctcctgcctgacagctttgtctgtttcgagcataaggggcaatacaaaggaaccatggattctggccagacaaagcgcgaacttaaatcctttgacatcagccagtgccccaagattgggggacacggctctaagaaatgcaccggcgatgctgccttctgttccgcctacgagtgcacagctcagtatgcgaatgcctactgtagccatgctaacgggtccggaatcgttcaaatccaggtgtctggcgtgtggaagaaaccgctgtgcgtcgggtatgaaagagtggttgtgaagcgggagctcagcgccaaacctattcagcgcgtcgaaccctgtaccacgtgcatcacaaagtgtgagcctcacggactggtggttagatccaccggctttaagattagctctgccgtggcttgcgcctccggggtctgtgtgacaggaagccaatctcccagcaccgagatcacccttaaataccccggcatttcccagtctagcgtcggcgacatcggggtgcacatggcgcatgatgaccagtccgttagctctaagattgtggctcactgccctccgcaggatccctgtctggtccatggatgcatcgtgtgcgcccacggcctcatcaattatcaatgtcatacagccctgtccgctttcgttgtgattttcgtctttagctctacggccatcatttgcctggctgtgctctaccgggtgctgaaatgtcttaagatcgcccctcgcaaagttctgaaccccctcatgtggattaccgcgttcatcagatgggtctataagaagatggtggcccgggtggctgacaatatcaaccaggtcaatcgcgaaattgggtggatggagggaggccagctggcccttgggaaccctgctcccatcccgagacacgcccctattccccggtactccacatacctgatgctcctgctgatcgtgagctatgcgtccgcc

SEQ ID NO: 14644 - RNA, 1680 nt, synthetic construct
  misc_feature 1..1680: note = derived and/or modified CDS sequence (opt5) from RVFV(Beijing-01)__KX611606.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcgtgacacaggaagacgctacgtgcaaacctgtcacctatgccggggcttgtagctccttcgatgtgctgctcgagaagggaaaatttcccctgttccaatcttacgcccaccatcgcacacttctggaagcggttcacgacaccatcattgccaaggctgatcctcccagctgcgacctccagtccgcccatggcaacccttgtatgaaagagaagctggtgatgaagacacactgcccgaatgattatcagtctgctcactacctgaacaatgacgggaaaatggccagcgtcaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtgtgtgaagttggagtgcaggccctgaaaaagtgcgatggccggctttctacggctcatgaggtcgtgccttttgccgtgttcaaaaattccaagaaagtctatctggacaagctcgacctgaagaccgaagagaacctgctccccgatagctttgtttgtttcgagcacaaagggcagtacaagggaacaatggactctggccaaaccaaacgcgaactgaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgtgcagatccaagtgtctggcgtctggaaaaagcctctttgcgtggggtatgaaagagttgtggtcaaacgggagctgagcgccaagcccattcagcgcgtggaaccttgtacgacatgcatcaccaaatgtgagccccacggactcgttgtgagatccacaggctttaagattagctctgccgtcgcttgcgcctccggggtgtgtgtcaccggaagccagtctcccagcaccgagatcacactgaagtaccctggcatttcccaatctagcggcggggatatcggagtgcatatggcgcacgacgatcagtccgttagctctaaaattgtgttcgactgcccgccccaggatccttgtcttgtccatggctgcatcgtgtgcgctcacgggctgatcaattatcagtgtcatacggccctctccgccttcgttgtggtctttgtgttcagctctgtggctattatctgcctggccattctgtacaaggttctccggtgtctgaaaatcgctcccaagaaagtccttaaccctctgatgtggattaccgcctttatccgctgggtgtataagaagatggtggcgagagtcgccgacaatatcaaccaagtgaatcgggaaattggatggatggagggcgggcagctcgctctgggcaaccccgccccgatccctcgccacgctcccattcctagatactccacataccttatgctgctcctgatcattagctatgcctccgcg

SEQ ID NO: 14645 - RNA, 1680 nt, synthetic construct
  misc_feature 1..1680: note = derived and/or modified CDS sequence (opt5) from RVFV(Smithburn)__DQ380193.1__Gn
  source 1..1680: mol_type = other RNA
atggccggcatcgctatgaccgtgttccccgccctggtcgtttttgcgctcgctcctgtggtgttcgccgaggacccgcacctgagaaaccggcccgggaagggacataattacattgatggcatgacacaggaagacgccacgtgcaaacctgtcacctatgctggggcctgtagctcctttgatgtgcttctggagaagggaaaattccccctctttcaatcttacgctcaccatcgcacactgcttgaagccgttcacgacatcattatcgcgaaggccgatcctcccagctgcaacctgcagtccgctcatggcaatccttgtatgaaagagaagctcgtgatgaagacctattgcccgaacgactaccagtctgcccactatctgaataacgatgggaaaatggctagcgtcaagtgtccccctaaacacgaactgacagaggactgcaatttctgtagacagatgaccggagcctccctcaaggagggctcttaccccctgcaagatctgttttgccagagctccgaagacgatggcagcaaacttaagacaaagatgaaaggggtgtgtgaggttggagtgcaggtcctcaagaaatgcgacggccagctgtctaccgcgcatgaagtggtgcctttcgccgtctttaagaactccaaaaaggtttatcttgataaactggacctcaagacggaggagaatctgctgcccgacagcttcgtgtgttttgaacacaaggggcaatacaaaggaaccatggattctggccagattaagcgggagctcaaatccttcgacatcagccagtgcccgaagatcgggggacatggctctaaaaagtgcacaggcgatgctgccttttgttccgcttacgaatgcaccgcccagtatgccaacgcttactgtagccacgcgaatgggtccggaattgtgcaaatccaggtctctggcgtgtggaagaaacctctgtgcgttgggtatgagcgcgtggtcgtgaagagagaacttagcgccaaacccattcagcgggttgagccttgtacaacctgcatcacgaagtgtgagccccacggactggtggtccgctccacaggcttcaaaattagctctgctgtggcctgcgcctccggggtctgtgtgaccggaagccaatctcccagcacagaaatcaccctcaagtaccctggcatttcccagtctagcggcggggacatcggagttcatatggctcacgatgaccagtccgtgagctctaagatcgtcgcccattgcccgccccaggatccttgtctggtgcacggctgcattgtttgcgcgcatgggcttatcaactatcaatgtcacaccgctttctccgcctttgtggtcgtgttcgtgtttagctctgttgtcattatctgcctggccattctctacaaagtgctgaagtgtctgaaaatcgctcccagaaaggtgctcaatcctctgatgtggatcacagccttcattcggtgggtctataaaaagatggtggctcgcgttgccgacaacatcaatcaggtgaacagagagattggatggatggaaggcgggcagcttgtcctgggcaaccccgcgccgatccctcggcacgcccccattcctcgctactccacgtacctcatgctgcttctgatcgtgagctatgcttccgcc

SEQ ID NO: 14646 - RNA, 1680 nt, synthetic construct
  misc_feature 1..1680: note = derived and/or modified CDS sequence (opt5) from RVFV(TAN/Dod-002/07)__HM586971.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattccaagaaagtgtatctggacaagctcgacctgaagaccgaagagaacctgctccccgatagctttgtctgtttcgagcacaaagggcaatacaagggaacaatggactctggccagaccaaacgggaactgaagtcctttgatatcagccagtgcccgaaaattgggggacatggccgcaagaagtgcacaggcgacgctgccttctgttctgcctacgagtgcaccgctcagtatgcgaatgcctactgttcccacgctaacgggagcggaatcgttcaaatccaggtgtccggcgtgtggaaaaagcctctttgcgtcgggtatgaaagagtggttgtgaaacgggagctgtctgccaagcccattcagcgcgtcgaaccttgtacgacatgcatcaccaaatgtgagccccacggactcgtggttagaagcacaggctttaagatttccagcgccgtggcttgcgcctctggggtctgtgtgaccggatcccaaagcccctctaccgagatcacactgaagtaccctggcattagccagtcctctggcggggatatcggagtccatatggcgcacgacgatcagagcgtgtccagcaaaattgttgctcattgcccgccccaggacccttgtcttgtgcacggctgcatcgtctgcgcccaagcctggatcatttctcagtggcatacggctctgtccgccttcgtggttatcttcgtgtttagctctaccgctattatctgtctcgccgtcctgtatcgggtgctgaagtgcctcaaaattgcgccccgcaaggtgctgaatcctcttatgtggatcacagccttcatcagatgggtttacaaaaagatggtcgctcgggtggccgataacattaatcaggtgaaccgcgaaatcgggtggatggagggaggccagctggctctcgggaatcccgccccgattcctagacacgcgcccatccctcggtattccacctacctgatgcttctgctcattgtcagctacgcctccgct

SEQ ID NO: 14647 - RNA, 1680 nt, synthetic construct
  misc_feature 1..1680: note = derived and/or modified CDS sequence (opt5) from RVFV(KEN/Gar-004/06)__HM586964.1__Gn
  source 1..1680: mol_type = other RNA
atggccggcatcgctatgaccgtgctgcccgccctcgcggtcttcgctctggcccctgttgtgtttgccgaggacccgcaccttagaaaccggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctccagtccgcccatggcaacccttgtatgaaagagaagctggttatgaagacacactgcccgaatgattatcagtctgctcactacctgaacaatgacgggaaaatggccagcgtgaagtgtccccctaaatatgaactcaccgaggattgcaacttttgtagacagatgacaggagcgtccctgaagaaaggctcttacccccttcaagacctgttctgccagagctccgaggatgacggcagcaagctcaagaccaaaatgaagggggtctgtgaagtgggagttcaggccctgaaaaagtgcgatggccagctttctacggctcatgaggtggtcccttttgccgtgttcaaaaattcccaaaaggtgtatctggacaaactcgacctgaagaccgaagagaacctgctccccgatagctttgtctgtttcgagcacaaggggcagtacaaaggaacaatggactctggccagaccaagcgggaactgaaatcctttgatatcagccagtgcccgaagattgggggacatggccgcaaaaagagaacaggcgacgctgccttctgctctgcctacgagtgtaccgctcaatatgcgaatgcctactgctcccgggctaacgggagcggaatcgttcagatccaggtgtcccgcgtgtggaagaaacctctttgtgtcggctatgaaagagtggttgtgaagcgggagctgtctgccaaacccattcaacgcgtcgaaccttgcacgacatgtatcaccaagtgcgagccccacgggctcgtggttagaagcacaggatttaaaatttccagcgccgtggcttgtgcctctggcgtctgcgtgaccgggtcccagagcccctctaccgagatcacactgaagtaccctggaattagccagtcctctggcggcgatatcggggtccacatggcgcatgacgatcagagcgtgtccagcaagattgttgctcactgtccgccccaagacccttgccttgtgcatggatgtatcgtctgcgcccacggcctgatcaataaccagtctcattccgccctcagcgctttcgtggttattttcgtgttttcttccacggccatcatttgcctggctgtcctgtatcgggtgctcaaatgtctgaagatcgcgccccgcaaagtgcttaatcctctgatgtggattaccgccttcatcagatgggtttacaagaaaatggtcgcccgggtggctgataacatcaatcaggtgaaccgcgaaattgggtggatggagggaggccagctcgccctggggaaccccgctccgatccctagacacgcccccattcctcggtatagcacataccttatgctgctcctgatcgtctcctacgcgtctgcc

SEQ ID NO: 14648 - RNA, 1521 nt, synthetic construct
  misc_feature 1..1521: note = derived and/or modified CDS sequence (opt5) from RVFV(ZH-548)__DQ380206.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctgatttcttataagcctatgatcgaccagctggagtgcacgacaaatctcattgatcccttcgtcgttttcgaaagaggatccctgcctcagacccggaacgacaaaacatttgccgctagcaagggcaatcgcggggtgcaggccttctccaagggatctgtgcaagctgatcttaccctgatgtttgacaacttcgaggtcgattttgtgggcgccgcggttagctgtgacgccgctttcctcaatctgaccgggtgctactcctgtaacgccggagctagagtgtgcctttctatcacaagcacgggcaccggctccctgagcgcccataacaaagacgggtctctccacatcgtcctgccgtccgaaaatggaacaaaggatcagtgtcagattctgcactttaccgtgcccgaggttgaggaagagttcatgtatagctgcgacggcgatgaacggcctctcctggtgaaagggacacttatcgccattgacccctttgatgacagacgcgaggctggaggcgaatctaccgtcgtgaaccctaagtccgggagctggaatttctttgattggttctctggcctgatgagctggtttggaggccccctcaaaacgatcctgcttatttgtctgtacgtcgcgctctccatcgggctgttcttcctgctcatctatctgggacggacaggccttagcaagatgtggctggccgctaccaaaaaggcctct

SEQ ID NO: 14649 - RNA, 1521 nt, synthetic construct
  misc_feature 1..1521: note = derived and/or modified CDS sequence (opt5) from RVFV(35/74)__JF784387.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctgatttcttataagcctatgatcgaccagctggagtgcacgacaaatctcattgatcccttcgtcgttttcgaaagaggatccctgcctcagacccggaacgacaaaacatttgccgctagcaagggcaatcgcggggtgcaggccttctccaagggatctgtgcaagctgatcttaccctgatgtttgacaacttcgaggtcgattttgtgggcgccgcggttagctgtgacgccgctttcctcaatctgaccgggtgctactcctgtaacgccggagctagagtgtgcctttctatcacaagcacgggcaccggcacactgtccgcccataacaaagacgggagcctccacatcgtcctgccgtctgaaaatggaaccaaggatcagtgtcagattctgcactttacagtgcccgaggttgaggaagagttcatgtattcctgcgacggcgatgaacggcctctcctggtgaaagggacccttatcgccattgacccctttgatgacagacgcgaggctggaggcgaaagcacggtcgtgaaccctaagtctgggtcctggaatttctttgattggttcagcggcctgatgtcttggtttggaggccccctcaaaacaatcctgcttatttgtctgtacgtcgcgctcagcatcgggctgttcttcctgctcatctatctgggacggaccggcctttccaagatgtggctggccgctaccaaaaaggccagc

SEQ ID NO: 14650 - RNA, 1521 nt, synthetic construct
  misc_feature 1..1521: note = derived and/or modified CDS sequence (opt5) from RVFV(200803162)__JF311377.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctggtctcttataagcctatgattgaccagctggagtgcacgacaaatctcatcgatcccttcgttgtgttcgaaagaggatccctgcctcagacccggaacgacaaaacatttgccgctagcaagggcaatcgcggggtgcaggccttctccaagggatctgtccaagctgatcttaccctgatgtttgacaacttcgaggtggattttgttggcgccgcggtgagctgtgacgccgctttcctcaatctgaccgggtgctactcctgtaacgccggagctagagtctgcctttctattacaagcacgggcaccggcacactgtccgcccataacaaagacgggagcctccacatcgtgctgccgtctgaaaatggaaccaaggatcagtgtcagatcctgcactttacagttcccgaggtggaggaagagttcatgtattcctgcgacggcgatgaacggcctctcctggtcaaagggacccttattgccatcgacccctttgatgacagacgcgaggctggaggcgaaagcacggtggtcaaccctaagtctgggtcctggaatttctttgattggttcagcggcctgatgtcttggtttggaggccccctcaaaacaattctgcttatctgtctgtacgtggcgctcagcattgggctgttcttcctgctcatctatctgggacggaccggcctttccaagatgtggctggccgctaccaaaaaggccagc

SEQ ID NO: 14651 - RNA, 1521 nt, synthetic construct
  misc_feature 1..1521: note = derived and/or modified CDS sequence (opt5) from RVFV(200803166)__JF311381.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctgatttcttataagcctatgatcgaccagctggagtgcacgacaaatctcattgatcccttcgtcgttttcgaaagaggatccctgcctcagacccggaacgacaaaacatttgccgctagcaagggcaatcgcggggtgcaggccttctccaagggatctgtgcaagctgatcttaccctgatgtttgacaacttcgaggtcgattttgtgggcgccgcggttagctgtgacgccgctttcctcaatctgaccgggtgctactcctgtaacgccggagctagagtgtgcctttctatcacaagcacgggcaccggcacactgtccgcccataacaaagacgggagcctccacgtcgtgctgccgtctgaaaatggaaccaaggatcagtgtcagatcctgcactttacagttcccgaggtggaggaagagttcatgtattcctgcgacggcgatgaacggcctctcctggtcaaagggacccttattgccatcgacccctttgatgacagacgcgaggctggaggcgaaagcacggtggtcaaccctaagtctgggtcctggaatttctttgattggttcagcggcctgatgtcttggtttggaggccccctcaaaacaattctgcttatctgtctgtacgtggcgctcagcattgggctgttcttcctgctcatctatctgggacggaccggcctttccaagatgtggctggccgctaccaaaaaggccagc

SEQ ID NO: 14652 - RNA, 1521 nt, synthetic construct
  misc_feature 1..1521: note = derived and/or modified CDS sequence (opt5) from RVFV(SA-51 (Van Wyck))__DQ380195.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaagtgaccgatttcgacggcagcgtctccacaattgatctgggggcttctagctcccgctttaccaattggggaagcgtgtctctctccctggacgccgagggcatcagcgggtctaacagcttctcctttatcgaatctccgggaaaaggctacgctattgtggatgagcccttcagcgaaatccctagacaaggctttcttggggagattcggtgcaattccgagagctctgtcctgtccgcccacgaaagctgtctccgcgcgcccaacctgatctcttataagcctatgattgaccagctggagtgcacgacaaatctcatcgatcccttcgttgtgttcgaaagaggatccctgcctcagacccggaacgacaaaacatttgccgctagcaagggcaatcgcggggtgcaggccttctccaagggatctgtccaagctgatcttaccctgatgtttgacaacttcgaggtggattttgttggcgccgcggtgagctgtgacgccgctttcctcaatctgaccgggtgctactcctgtaacgccggagctagagtctgcctttctattacaagcacgggcaccggcacactgtccgcccataacaaagacgggagcctccacatcgtgctgccgtctgaaaatggaaccaaggatcagtgtcagatcctgcactttacagttcccgaggtggaggaagagttcatgtattcctgcgacggcgatgaacggcctctcctggtcaaagggacccttattgccatcgacccctttgatgacagacgcgaggctggaggcgaaagcacggtggtcaaccctaagtctgggtcctggaatttctttgattggttcagcggcctgatgtcttggtttggaggccccctcaaaacaattctgcttatctgtctgtacgtggcgctcagcattgggctgttcttcctgctcatctatctgggacggaccggcctttccaagatgtggctggccgctaccaaaaaggccagc

SEQ ID NO: 14653 - RNA, 1521 nt, synthetic construct
  misc_feature 1..1521: note = derived and/or modified CDS sequence (opt5) from RVFV(ZINGA J83 R1)__KU978776.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctgatttcttataagcctatgatcgaccagctggagtgcacgacaaatctcattgatcccttcgtcgttttcgaaagaggatccctgcctcagacccggaacgacaaaacatttgccgctagcaagggcaatcgcggggtgcaggccttctccaagggatctgtgcaagctgatcttaccctgatgtttgacaacttcgaggtcgattttgtgggcgccgcggttagctgtgacgccgctttcctcaatctgaccgggtgctactcctgtaacgccggagctagagtgtgcctttctatcacaagcacgggcaccggcacactgtccgcccataacaaagacgggagcctccacatcgtcctgccgtctgaaaatggaaccaaggatcagtgtcagattctgcactttacagtgcccgaggttgaggaagagttcatgtattcctgcgacggcgatgaacggcctctcctggtgagagggacccttatcgccattgacccctttgatgaccgccgggaggctggaggcgaaagcacggtcgtgaaccctaaatctgggtcctggaatttctttgattggttcagcggcctgatgtcttggtttggaggccccctcaagacaatcctgcttatttgtctgtacgtcgcgctcagcatcgggctgttcttcctgctcatctatctgggaagaaccggcctttccaaaatgtggctggccgctaccaagaaagccagc

SEQ ID NO: 14654 - RNA, 1521 nt, synthetic construct
  misc_feature 1..1521: note = derived and/or modified CDS sequence (opt5) from RVFV(Entebbe)__DQ380191.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacagtcgatctgggggcttctagctcccgctttaccaattggggaagcgtgtctctctccctggacgccgagggcatcagcgggtctaacagcttctcctttatcgaatctccgggaaaaggctacgctattgtggatgagcccttcagcgaaatccctagacaaggctttcttggggagattcggtgcaattccgagagctctgtcctgtccgcccacgaaagctgtctccgcgcgcccaacctgatctcttataagcctatgattgaccagctggagtgcacgacaaatctcatcgatcccttcgttgtgttcgaaagaggatccctgcctcagacccggaacgacaaaacatttgccgctagcaagggcaatcgcggggtgcaggccttctccaagggatctgtccaagctgatcttaccctgatgtttgacaacttcgaggtggattttgttggcgccgcggtgagctgtgacgccgctttcctcaatctgaccgggtgctactcctgtaacgccggagctagagtctgcctttctattacaagcacgggcaccggcacactgtccgcccataacaaagacgggagcctccacatcgtgctgccgtctgaaaatggaaccaaggatcagtgtcagatcctgcactttacagttcccgaggtggaggaagagttcatgtattcctgcgacggcgatgaacggcctctcctggtcaaagggacccttattgccatcgacccctttgatgacagacgcgaggctggaggcgaaagcacggtggtcaaccctaagtctgggtcctggaatttctttgattggttcagcggcctgatgtcttggtttggaggccccctcaaaacaattctgcttatctgtctgtacgtggcgctcagcattgggctgttcttcctgctcatctatctgggacggaccggcctttccaagatgtggctggccgctaccaaaaaggccagc

SEQ ID NO: 14655 - RNA, 1521 nt, synthetic construct
  misc_feature 1..1521: note = derived and/or modified CDS sequence (opt5) from RVFV(Sudan 2V-2007)__JQ820490.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctgatttcttataagcctatgatcgaccagctggagtgcacgacaaatctcattgatcccttcgtcgttttcgaaagaggatccctgcctcagacccggaacgacaaaacatttgccgctagcaagggcaatcgcggggtgcaggccttctccaagggatctgtgcaagctgatcttaccctgatgtttgacaacttcgaggtcgattttgtgggcgccgcggttagctgtgacgccgctttcctcaatctgaccgggtgctactcctgtaacgccggagctagagtgtgcctttctatcacaagcacgggcaccggcacactgtccgcccataacaaagacgggagcctccacatcgtcctgccgtctgaaaatggaaccaaggatcagtgtcagattctgcactttacagtgcccgaggttgaggaagagttcatgtattcctgcgacggcgatgaacggcctctcctggtgaaagggacccttatggccatcgacccctttgatgacagacgcgaggctggaggcgaaagcacggtcgtgaaccctaagtctgggtcctggaatttctttgattggttcagcggcctgatgtcttggtttggaggccccctcaaaacaattctgcttatctgtctgtacgtcgcgctcagcattgggctgttcttcctgctcatctatctgggacggaccggcctttccaagatgtggctggccgctaccaaaaaggccagc

SEQ ID NO: 14656 - RNA, 1521 nt, synthetic construct
  misc_feature 1..1521: note = derived and/or modified CDS sequence (opt5) from RVFV(Sudan 86-2010)__JQ820489.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctgatttcttataagcctatgatcgaccagctggagtgcacgacaaatctcattgatcccttcgtcatcttcgaaagaggatccctgcctcagacccggaacgacaaaacatttgccgctagcaagggcaatcgcggggttcaggccttctccaagggatctgtgcaagctgatcttaccctgatgtttgacaacttcgaggtggattttgtcggcgccgcggtgagctgtgacgccgctttcctcaatctgaccgggtgctactcctgtaacgccggagctagagtttgcctttctatcacaagcacgggcaccggcacactgtccgcccataacaaagacgggagcctccacattgtgctgccgtctgaaaatggaaccaaggatcagtgtcagatcctgcactttacagtccccgaggtggaggaagagttcatgtattcctgcgacggcgatgaacggcctctcctggttaaagggacccttattgccatcgacccctttgatgacagacgcgaggctggaggcgaaagcacggtggtcaaccctaagtctgggtcctggaatttctttgattggttcagcggcctgatgtcttggtttggaggccccctcaaaacaattctgcttatctgtctgtacgtggcgctcagcatcgggctgttcttcctgctcatttatctgggacggaccggcctttccaagatgtggctggccgctaccaaaaaggccagc

SEQ ID NO: 14657 - RNA, 1521 nt, synthetic construct
  misc_feature 1..1521: note = derived and/or modified CDS sequence (opt5) from RVFV(Kenya 56 (IB8))__DQ380190.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctgatttcttataagcctatgatcgaccagctggagtgcacgacaaatctcattgatcccttcgtcgccttcgaaagaggatccctgcctcagacccggaacgacaaaacatttgctgccagcaagggcaatcgcggggttcaggctttctccaagggatctgtgcaagccgatcttaccctgatgtttgacaacttcgaggtggattttgtcggcgcggccgtgagctgtgacgctgccttcctcaatctgaccgggtgctactcctgtaacgctggagccagagtttgcctttctatcacaagcacgggcaccggcacactgtccgcccataacaaagacgggagcctccacatcgtgctgccgtctgaaaatggaaccaaggatcagtgtcagattctgcactttacagtccccgaggtggaggaagagttcatgtattcctgcgacggcgatgaacggcctctcctggttaaagggacccttatcgctattgacccctttgatgacagacgcgaggcgggaggcgaaagcacggtggtcaaccctaagtctgggtcctggaatttctttgattggttcagcggcctgatgtcttggtttggaggccccctcaaaacaatcctgcttatttgtctgtacgtggccctcagcatcgggctgttcttcctgctcatctatctgggacggaccggcctttccaagatgtggctggctgccaccaaaaaggccagc

SEQ ID NO: 14658 - RNA, 1521 nt, synthetic construct
  misc_feature 1..1521: note = derived and/or modified CDS sequence (opt5) from RVFV(ARD-38388)__DQ380187.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttatcggagaaagcaccacgatgcgcgaaaataagtgtttcgagcagtgcggcggctgggggtgtggatgctttaacgtgaatccttcttgcctgttcgttcacacctatctgcagtccgtgagaaaagaggccctccgggtctttaactgtattgactgggtgcataagctgacacttgaaatcaccgatttcgacggcagcgtttccacaatcgatctgggggcttctagctcccgctttaccaattggggaagcgtgtctctctccctggacgccgagggcattagcgggtctaacagcttctcctttatcgaatctccgggaaaaggctacgctattgtcgatgagcccttcagcgaaatccctagacaaggctttcttggggagattcggtgcaattccgagagctctatcctgtccgcccacgaaagctgtctccgcgcgcccaacctgatttcttataagcctatgatcgaccagctggagtgcacgacaaatctcatcgatcccttcgtggtgttcgaaagaggatccctgcctcagacccggaacgacaaaacatttgccgctagcaagggcaatcgcggggtccaggccttctccaagggatctgttcaagctgatcttaccctgatgtttgacaacttcgaggtggattttgtgggcgccgcggtcagctgtgacgccgctttcctcaatctgaccgggtgctactcctgtaacgccggagctagagtgtgcctttctattacaagcacgggcaccggcacactgtccgcccataacaaagacgggagcctccacatcgttctgccgtctgaaaatggaaccaaggatcagtgtcagattctgcactttacagtgcccgaggtcgaggaagagttcatgtattcctgcgacggcgatgaacggcctctcctggtgaaagggacccttatcgccattgacccctttgatgacagacgcgaggctggaggcgaaagcacggttgtgaaccctaagtctgggtcctggaatttctttgattggttcagcggcctgatgtcttggtttggaggccccctcaaaacaatcctgcttatctgtctgtacgtcgcgctcagcattgggctgttcttcctgctcatctatctgggacggaccggcctttccaagatgtggctggccgctaccaaaaaggccagc

SEQ ID NO: 14659 - RNA, 1521 nt, synthetic construct
  misc_feature 1..1521: note = derived and/or modified CDS sequence (opt5) from RVFV(Sudan 28-2010)__JQ820491.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctgatttcttataagcctatgatcgaccagctggagtgcacgacaaatctcattgatcccttcgtcgttttcgaaagaggatccctgcctcagacccggaacgacaaaacatttgccgctagcaagggcaatcgcggggtgcaggccttctccaagggatctgtgcaagctgatcttaccctgatgtttgacaacttcgaggtcgattttgtgggcgccgcggttagctgtgacgccgctttcctcaatctgaccgggtgctactcctgtaacgccggagctagagtgtgcctttctatcacaagcacgggcaccggcacactgtccgcccataacaaagacgggagcctccacatcgtcctgccgtctgaaaatggaaccaaggatcagtgtcagattctgcactttacagtgcccgaggttgaggaagagttcatgtattcctgcgacggcgatgaacggcctctcctggtgaaagggacccttatcgccattgacccctttgatgacagacgcgaggctggaggcgaaagcacggtcgtgaaccctaagtctgggtcctggaatttctttgattggttcagcggcctgatgtcttggtttggaggccccctcaaaacaatcctgcttatttgtctgtacgtcgtgctcagcatcgggctgttcttcctgctcatctatctgggacggaccggcctttccaagatgtggctggcggccaccaaaaaggctagc

SEQ ID NO: 14660 - RNA, 1521 nt, synthetic construct
  misc_feature 1..1521: note = derived and/or modified CDS sequence (opt5) from RVFV(200803167)__JF311382.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctgatttcttataagcctatgatcgaccagctggagtgcacgacaaatctcattgatcccttcgtcgttttcgaaagaggatccctgcctcagacccggaacgacaaaacatttgccgctagcaagggcaatcgcggggtgcaggccttctccaagggatctgtgcaagctgatcttaccctgatgtttgacaacttcgaggtcgattttgtgggcgccgcggttagctgtgacgccgctttcctcaatctgaccgggtgctactcctgtaacgccggagctagagtgtgcctttctatcacaagcacgggcaccggcacactgtccgcccataacaaagacgggagcctccacatcgtcctgccgtctgaaaatggaaccaaggatcagtgtcagattctgcactttacagtgcccgaggttgaggaagagttcatgtattcctgcgacggcgatgaacggcctctcctggtgaaagggacccttatcgccattgacccctttgatgacagacgcgaggctggaggcgaaagcacggtcgtgaaccctaagtctgggtcctggaatttctttgattggttcagcggcctgatgtcttggtttggaggccccctcaaaacaatgctgcttatctgtctgtacgtcgcgctcagcattgggctgttcttcctgctcatctatctgggacggaccggcctttccaagatgtggctggccgctaccaaaaaggccagc

SEQ ID NO: 14661 - RNA, 1521 nt, synthetic construct
  misc_feature 1..1521: note = derived and/or modified CDS sequence (opt5) from RVFV(73HB1230)__DQ380221.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccatcatgcgcgaaaataagtgtttcgagcagtgcggcggctgggggtgtggatgctttaacgttaatccttcttgcctgttcgtgcacacgtatctgcagtccgtcagaaaagaggccctccgggtgtttaactgtattgactgggttcataagctgacccttgaaatcacagatttcgacggcagcgtgtccaccatcgatctgggggcttctagctcccgctttacaaattggggaagcgtctctctctccctggacgccgagggcattagcgggtctaacagcttctcctttatcgaatctccgggaaaaggctacgctattgtggatgagcccttcagcgaaatccctagacaaggctttcttggggagattcggtgcaattccgagagctctgtgctgtccgcccacgaaagctgtctccgcgcgcccaacctgatctcttataagcctatgattgaccagctggagtgcaccacgaatctcatcgatcccttcgtcgttttcgaaagaggatccctgcctcagacacggaacgacaaaacctttgccgctagcaagggcaatcgcggggtgcaggccttctccaagggatctgtgcaagctgatcttacactgatgtttgacaacttcgaggtcgattttgtgggcgccgcggttagctgtgacgccgctttcctcaatctgaccgggtgctactcctgtaacgccggagctagagtgtgcctttctatcaccagcacaggcacgggcaccctgtccgcccataacaaagacgggagcctccacattgtcctgccgtctgaaaatggaacaaaggatcagtgtcagatcctgcactttaccgtgcccgaggttgaggaagagttcatgtattcctgcgacggcgatgaacggcctctcctggtgaaagggacacttattgccatcgacccctttgatgacagacgcgaggctggaggcgaaagcaccgtcgtgaaccctaagtctgggtcctggaatttctttgattggttcagcggcctgatgtcttggtttggaggccccctcaaaacgattctgcttatctgtctgtacgtcgcgctcagcatcgggctgttcttcctgctcatttatctgggacggacaggcctttccaagatgtggctggccgctaccaaaaaggccagc

SEQ ID NO: 14662 - RNA, 1521 nt, synthetic construct
  misc_feature 1..1521: note = derived and/or modified CDS sequence (opt5) from RVFV(2250/74)__DQ380209.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctgatttcttataagcctatgatcgaccagctggagtgcacgacaaatctcattgatcccttcgtcgttttcgaaagaggatccctgcctcagacccggaacgacaaaacatttgccgctagcaagggcaatcgcggggtgcaggccttctccaagggatctgtgcaagctgatcttaccctgatgtttgacaacttcgaggtcgattttgtgggcgccgcggttagctgtgacgccgctttcctcaatctgaccgggtgctactcctgtaacgccggagctaaagtgtgcctttctatcacaagcacgggcaccggctccctgagcgcccataacaaggacgggtctctccacatcgtcctgccgtccgaaaatggaacaaaagatcagtgtcagattctgcactttaccgtgcccgaggttgaggaagagttcatgtatagctgcgacggcgatgaaagacctctcctggtgaaggggacacttatcgccattgacccctttgatgaccggagagaggctggaggcgaatctaccgtcgtgaaccctaaatccgggagctggaatttctttgattggttctctggcctgatgagctggtttggaggccccctcaagacgatcctgcttatttgtctgtacgtcgcgctctccatcgggctgttcttcctgctcatctatctgggacgcacaggccttagcaaaatgtggctggccgctaccaagaaggcctct

SEQ ID NO: 14663 - RNA, 1521 nt, synthetic construct
  misc_feature 1..1521: note = derived and/or modified CDS sequence (opt5) from RVFV(SAUDI 200010901)__KU978778.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctgatttcttataagcctatgatcgaccagctggagtgcacgacaaatctcattgatcccttcgtcgttttcgaaagaggatccctgcctcagacccggaacgagaaaacatttgccgctagcaagggcaatcgcggggtgcaggccttctccaagggatctgtgcaagctgaccttaccctgatgtttgataacttcgaagtcgactttgtgggcgccgcggttagctgtgatgccgctttcctcaatctgaccgggtgctactcctgtaacgccggagctagagtgtgcctttctatcacaagcacgggcaccggcacactgtccgcccataacaaagacgggagcctccacatcgtcctgccgtctgagaatggaaccaaggaccagtgtcagattctgcactttacagtgcccgaggttgaagaggagttcatgtattcctgcgatggcgacgaacggcctctcctggtgaaagggacccttatcgccattgatccctttgacgatagacgcgaagctggaggcgagagcacggtcgtgaaccctaagtctgggtcctggaatttctttgactggttcagcggcctgatgtcttggtttggaggccccctcaaaacaatcctgcttatttgtctgtacgtcgcgctcagcatcgggctgttcttcctgctcatctatctgggacggaccggcctttccaagatgtggctggccgctaccaaaaaggccagc

SEQ ID NO: 14664 - RNA, 1521 nt, synthetic construct
  misc_feature 1..1521: note = derived and/or modified CDS sequence (opt5) from RVFV(Lunyo)__KU167026.1__Gc
  source 1..1521: mol_type = other RNA
tgcagcgagctgatccaggcctcctctagaattaccacatgtagcacggaaggcgtgaacacccggtgccgcctctccgggacagctctgatcagagccggatctgtcggcgcggaggcttgtcttatgctgaagggggttaaagaagaccaaaccaagttcctcaaaattaagacagtgagctccgagctgtcttgccgggaaggacagagctactggaccggctcctttagccccaaatgtctttcttcccgcagatgccacctggtgggggagtgtcatgtcaatcggtgcctcagctggcgcgataacgagacatctgccgagttctcctttgtgggagaaagcaccacgatgagagaaaataagtgtttcgagcagtgcggcggctgggggtgtggatgctttaacgttaatccttcttgcctgttcgtgcacacctatctgcagtccgtccggaaggaggccctccgcgtgtttaactgtatcgactgggttcataaactgacacttgaaattaccgatttcgacggcagcgtgtccacaatcgatctgggggcttctagctccagatttaccaattggggaagcgtctctctctccctggacgccgagggcatcagcgggtctaacagcttctcctttattgaatctccgggaaagggctacgctatcgtggatgagcccttcagcgaaattcctcggcaaggctttcttggggagatccgctgcaattccgagagctctgtgctgtccgcccacgaaagctgtctcagagcgcccaacctgatttcttataaacctatgatcgaccagctggagtgcacgacaaatctcattgatcccttcgtcgttttcgaacggggatccctgcctcagacccgcaacgacaagacatttgccgctagcaaaggcaatagaggggtgcaggccttctccaagggatctgtgcaagctgatcttaccctgatgtttgacaacttcgaggtcgattttgtgggcgccgcggttagctgtgacgccgctttcctcaatctgaccgggtgctactcctgtaacgccggagctcgggtgtgcctttctatcacaagcacgggcaccggcacactgtccgcccataacaaggacgggagcctccacatcgtcctgccgtctgaaaatggaaccaaagatcagtgtcagattctgcactttacagtgcccgaggttgaggaagagttcatgtattcctgcgacggcgatgaaagacctctcctggtgaaggggacccttatcgccattgacccctttgatgaccgccgggaggctggaggcgaaagcacggtcgtgaaccctaaatctgggtcctggaatttctttgattggttcagcggcctgatgtcttggtttggaggccccctcaagacaatcctgcttatttgtctgtacgtcgcgctcagcatcgggctgttcttcctgctcatctatctgggaagaaccggcctttccaaaatgtggctggccgctaccaagaaagccagc

SEQ ID NO: 14665 - RNA, 1521 nt, synthetic construct
  misc_feature 1..1521: note = derived and/or modified CDS sequence (opt5) from RVFV(25010-24)__KM210509.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggacgatcaaaccaaattcctcaagattaaaacagtgagctccgaactgtcttgcagagagggacagagctactggaccggctcctttagccccaagtgtctttcttcccggcgctgccacctggtgggggaatgtcatgtcaatagatgcctcagctggcgggacaacgagacatctgccgagttctcctttgtgggagaaagcaccacgatgcgcgagaataagtgtttcgaacagtgcggcggctgggggtgtggatgctttaacgttaatccttcttgcctgttcgtgcacacctatctgcagtccgtcagaaaagaggccctccgggtgtttaactgtatcgattgggttcataagctgacacttgagattaccgacttcgatggcagcgtgtccacaatcgacctgggggcttctagctcccgctttaccaattggggaagcgtctctctctccctggatgccgaaggcatcagcgggtctaacagcttctcctttattgagtctccgggaaaaggctacgctatcgtggacgaacccttcagcgagattcctagacaaggctttcttggggaaatccggtgcaattccgagagctctgtgctgtccgcccacgagagctgtctccgcgcgcccaacctgatttcttataagcctatgatcgatcagctggaatgcacgacaaatctcattgaccccttcgtcgttttcgagagaggatccctgcctcagacccggaacgataaaacatttgccgctagcaagggcaatcgcggggtgcaggccttctccaagggatctgtgcaagctgaccttaccctgatgtttgataacttcgaagtcgactttgtgggcgccgcggttagctgtgacgccgctttcctcaatctgaccgggtgctactcctgtaacgccggagctagagtgtgcctttctatcacaagcacgggcaccggcacactgtccgcccataacaaagatgggagcctccacatcgtcctgccgtctgagaatggaaccaaggaccagtgtcagattctgcactttacagtgcccgaagttgaggaggagttcatgtattcctgcgatggcgacgaacggcctctcctggtgaaagggacccttatcgccattgatccctttgacgatagacgcgaagctggaggcgagagcacggtcgtgaaccctaagtctgggtcctggaatttctttgactggttcagcggcctgatgtcttggtttggaggccccctcaaaacaatcctgcttatttgtctgtacgtcgcgctcagcatcgggctgttcttcctgctcatctatctgggacggaccggcctttccaagatgtggctggccgctaccaaaaaggccagc

SEQ ID NO: 14666 - RNA, 1521 nt, synthetic construct
  misc_feature 1..1521: note = derived and/or modified CDS sequence (opt5) from RVFV(2007000253)__JF326192.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgcgggcgctgaggcctgtcttatgctgaaaggggtcaaggaagaccaaaccaaattcctcaagattaaaacagttagctccgagctgtcttgcagagaaggacagagctactggaccggctcctttagccccaagtgtctttcttcccggcgctgccacctggtgggggagtgtcatgtgaatagatgcctcagctggcgggataacgagacatctgccgagttctcctttgtcggagaaagcaccacgatgcgcgaaaataagtgtttcgagcagtgcggcggctgggggtgtggatgctttaacgtgaatccttcttgcctgttcgttcacacctatctgcagtccgtgagaaaagaggctctccgggtctttaactgtatcgactgggtgcataagctgacacttgaaattaccgatttcgacggcagcgtttccacaatcgatctgggggcctctagctcccgctttaccaattggggaagcgtgtctctctccctggacgctgagggcatcagcgggtctaacagcttctcctttattgaatctccgggaaaaggctacgccatcgtcgatgagcccttcagcgaaattcctagacaaggctttcttggggagatccggtgcaattccgagagctctgtgctgtccgcgcacgaaagctgtctccgcgcccccaacctggtgtcttataagcctatgattgaccagctggagtgcacgacaaatctcatcgatcccttcgtcgttttcgaaagaggatccctgcctcagacccggaacgacaaaacatttgctgccagcaagggcaatcgcggggtgcaggctttctccaagggatctgtgcaagccgatcttaccctgatgtttgacaacttcgaggtcgattttgtgggcgcggccgttagctgtgacgctgccttcctcaatctgaccgggtgctactcctgtaacgctggagccagagtgtgcctttctattacaagcacgggcaccggcacactgtccgcccataacaaagacgggagcctccacatcgtcctgccgtctgaaaatggaaccaaggatcagtgtcagatcctgcactttacagtgcccgaggttgaggaagagttcatgtattcctgcgacggcgatgaacggcctctcctggtgaaagggacccttattgctatcgacccctttgatgacagacgcgaggcgggaggcgaaagcacggtcgtgaaccctaagtctgggtcctggaatttctttgattggttcagcggcctgatgtcttggtttggaggccccctcaaaacaattctgcttatctgtctgtacgtcgccctcagcattgggctgttcttcctgctcatctatctgggacggaccggcctttccaagatgtggctggctgccaccaaaaaggccagc

SEQ ID NO: 14667 - RNA, 1521 nt, synthetic construct
  misc_feature 1..1521: note = derived and/or modified CDS sequence (opt5) from RVFV(ZC-3349)__DQ380207.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctcaaggcgcccaacctgatttcttataaacctatgatcgaccagctggagtgcacgacaaatctcattgatcccttcgtcgttttcgaacgcggatccctgcctcagaccagaaacgacaagacatttgccgctagcaagggcaatcgcggggtgcaggccttctccaaaggatctgtgcaagctgatcttaccctgatgtttgacaacttcgaggtcgattttgtgggcgccgcggttagctgtgacgccgctttcctcaatctgaccgggtgctactcctgtaacgccggagctcgggtgtgcctttctatcacaagcacgggcaccggctccctgagcgcccataacaaggacgggtctctccacatcgtcctgccgtccgaaaatggaacaaaagatcagtgtcagattctgcactttaccgtgcccgaggttgaggaagagttcatgtatagctgcgacggcgatgaaagacctctcctggtgaaggggacacttatcgccattgacccctttgatgaccggagagaggctggaggcgaatctaccgtcgtgaaccctaaatccgggagctggaatttctttgattggttctctggcctgatgagctggtttggaggccccctcaagacgatcctgcttatttgtctgtacgtcgcgctctccatcgggctgttcttcctgctcatctatctgggacgcacaggccttagcaaaatgtggctggccgctaccaagaaggcctct

SEQ ID NO: 14668 - RNA, 1521 nt, synthetic construct
  misc_feature 1..1521: note = derived and/or modified CDS sequence (opt5) from RVFV(OS-1)__DQ380186.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctcaaggtgtttaactgtatcgactgggttcataaactgacacttgaaattaccgatttcgacggcagcgtgtccacaatcgatctgggggcttctagctcccggtttaccaattggggaagcgtctctctctccctggacgccgagggcatcagcgggtctaacagcttctcctttattgaatctccgggaaagggctacgctatcgtggatgagcccttcagcgaaattcctcgccaaggctttcttggggagatcagatgcaattccgagagctctgtgctgtccgcccacgaaagctgtctccgggcgcccaacctgatttcttataaacctatgatcgaccagctggagtgcacgacaaatctcattgatcccttcgtcgttttcgaacgcggatccctgcctcagaccagaaacgacaagacatttgccgctagcaagggcaatcgcggggtgcaggccttctccaaaggatctgtgcaagctgatcttaccctgatgtttgacaacttcgaggtcgattttgtgggcgccgcggttagctgtgacgccgctttcctcaatctgaccgggtgctactcctgtaacgccggagctcgggtgtgcctttctatcacaagcacgggcaccggcacactgtccgcccataacaaggacgggagcctccacatcgtcctgccgtctgaaaatggaaccaaagatcagtgtcagattctgcactttacagtgcccgaggttgaggaagagttcatgtattcctgcgacggcgatgaaagacctctcctggtgaaggggacccttatcgccattgacccctttgatgaccggagagaggctggaggcgaaagcacggtcgtgaaccctaaatctgggtcctggaatttctttgattggttcagcggcctgatgtcttggtttggaggccccctcaagacaatcctgcttatttgtctgtacgtcgcgctcagcatcgggctgttcttcctgctcatctatctgggacgcaccggcctttccaaaatgtggctggccgctaccaagaaggccagc

SEQ ID NO: 14669 - RNA, 1521 nt, synthetic construct
  misc_feature 1..1521: note = derived and/or modified CDS sequence (opt5) from RVFV(KEN/Gar-004/06)__HM586964.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctggtctcttataagcctatgattgaccagctggagtgcacgacaaatctcatcgatcccttcgttgtgttcgaaagaggatccctgcctcagacccggaacgacaaaacatttgccgctagcaagggcaatcgcggggtgcaggccttctccaagggatctgtccaagctgatcttaccctgagatttgacaacttcgaggtggattttgttggcgccgcggtgagctgtgacgccgctttcctcaatctgaccgggtgctactcctgtaacgccggagctcgggtctgcctttctattacaagcacgggcaccggcacactgtccgcccataacaaagacgggagcctccacatcgtgctgccgtctgaaaatggaaccaaggatcagtgtcagatcctgcactttacagttcccgaggtggaggaagagttcatgtattcctgcgacggcgatgaaagacctctcctggtcaaagggacccttattgccatcgacccctttgatgaccgccgggaggctggaggcgaaagcacggtggtcaaccctaagtctgggtcctggaatttctttgattggttcagcggcctgatgtcttggtttggaggccccctcaaaacaattctgcttatctgtctgtacgtggcgctcagcattgggctgttcttcctgctcatctatctgggaagaaccggcctttccaagatgtggctggccgctaccaaaaaggccagc

SEQ ID NO: 14670 - RNA, 1521 nt, synthetic construct
  misc_feature 1..1521: note = derived and/or modified CDS sequence (opt5) from RVFV(Smithburn)__DQ380193.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacagtcgatctgggggcttctagctcccgctttaccaattggggaagcgtgtctctctccctggacgccgagggcatcagcgggtctaacagcttctcctttatcgaatctccgggaaaaggctacgctattgtggatgagcccttcagcgaaatccctagacaaggctttcttggggagattcggtgcaattccgagagctctgtcctgtccgcccacgaaagctgtctccgcgcgcccaacctgatctcttataagcctatgattgaccagctggagtgcacgacaaatctcatcgatcccttcgttgtgttcgaaagaggatccctgcctcagacccggaacgacaaaacatttgccgctagcaagggcaatcgcggggtgcaggccttctccaagggatctgtccaagctgatcttaccctgatgtttgacaacttcgaggtggattttgttggcgccgcggtgagctgtgacgccgctttcctcaatctgaccgggtgctactcctgtaacgccggagctagagtctgcctttctattacaagcacgggcaccggcacactgtccgcccataacaaagacgggagcctccacatcgtgctgccgtctgaaaatggaaccaaggatcagtgtcagatcctgcactttacagttcccgaggtggaggaagagttcatgtattcctgcgacggcgatgaacggcctctcctggtcaaagggacccttattgccatcgacccctttgatgacagacgcgaggctggaggcgaaagcacggtggtcaaccctaagtctgggtcctggaatttctttgattggttcagcggcctgatgtcttggtttggaggccccctcaaaacaattctgcttatctgtctgtacgtggcgctcagcattgggctgttcttctttctgatctatctcggacggaccggcctgtccaagatgtggcttgccgctaccaaaaaggccagc

SEQ ID NO: 14671 - RNA, 1521 nt, synthetic construct
  misc_feature 1..1521: note = derived and/or modified CDS sequence (opt5) from RVFV(2008/00101)__HE687306.1__Gc
  source 1..1521: mol_type = other RNA
tgcagcgagctgatccaggcctcctctagaattacaacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctggtctcttataagcctatgattgaccagctggagtgcacgacaaatctcatcgatcccttcgttgtgttcgaaagaggatccctgcctcagacccggaacgacaaaacatttgccgctagcaagggcaatcgcggggtgcaggccttctccaagggatctgtccaagctgatcttaccctgatgtttgacaacttcgaggtggattttgttggcgccgcggtgagctgtgacgccgctttcctcaatctgaccgggtgctactcctgtaacgccggagctagagtctgcctttctattacaagcacgggcaccggcacactgtccgcccataacaaagacgggagcctccacatcgtgctgccgtctgaaaatggaaccaaggatcagtgtcagatcctgcactttacagttcccgaggtggaggaagagttcatgtattcctgcgacggcgatgaacggcctctcctggtcaaagggacccttattgccatcgacccctttgatgacagacgcgaggctggaggcgaaagcacggtggtcaaccctaagtctgggtcctggaatttctttgattggttcagcggcctgatgtcttggtttggaggccccctcaaaacaaccctgcttatttgtctgtacgtggcgctcagcatcgggctgttcttcctgctcatttatctgggacggaccggcctttccaagatgtggctggccgctaccaaaaaggccagc

SEQ ID NO: 14672 - RNA, 1521 nt, synthetic construct
  misc_feature 1..1521: note = derived and/or modified CDS sequence (opt5) from RVFV(2007001292)__EU574046.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctggtctcttataagcctatgattgaccagctggagtgcacgacaaatctcatcgatcccttcgttgtgttcgaaagaggatccctgcctcagacccggaacgacaaaacatttgccgctagcaagggcaatcgcggggtgcaggccttctccaagggatctgtccaagctgatcttaccctgatgtttgacaacttcgaggtggattttgttggcgccgcggtgagctgtgacgccgctttcctcaatctgaccgggtgctactcctgtaacgccggagctagagtctgcctttctattacaagcacgggcaccggcacactgtccgcccataacaaagacgggagcctccacatcgtgctgccgtctgaaaatggaaccaaggatcagtgtcagatcctgcactttacagttcccgaggtggaggaagagttcatgtattcctgcgacggcgatgaacggcctctcctggtcaaagggacccttattgccatcgacccctttgatgacagacgcgaggctggaggcgaaagcacggtggtcaaccctaagtctgggtcctggaatctgttcgattggtttagcggcctcatgtcttggttcggaggccccctgaaaacaattcttctgatctgtctctacgtggcgctgagcattgggctgtttttcctcctgatctatcttggacggaccggcctgtccaagatgtggctcgccgctaccaaaaaggccagc

SEQ ID NO: 14673 - RNA, 1521 nt, synthetic construct
  misc_feature 1..1521: note = derived and/or modified CDS sequence (opt5) from RVFV(2007002445)__EU574037.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctggtctcttataagcctatgattgaccagctggagtgcacgacaaatctcatcgatcccttcgttgtgttcgaaagaggatccctgcctcagacccggaacgagaaaacatttgccgctagcaagggcaatcgcggggtgcaggccttctccaagggatctattcaagctgaccttaccctgatgtttgataacttcgaagtcgactttgtgggcgccgcggttagctgtgatgccgctttcctcaatctgaccgggtgctactcctgtaacgccggagctagagtgtgcctttctatcacaagcacgggcaccggcacactgtccgcccataacaaagacgggagcctccacatcgtcctgccgtctgagaatggaaccaaggaccagtgtcagattctgcactttacagtgcccgaggttgaagaggagttcatgtattcctgcgatggcgacgaacggcctctcctggtgaaagggacccttatcgccattgatccctttgacgatagacgcgaagctggaggcgagagcacggtcgtgaaccctaagtctgggtcctggaatttctttgactggttcagcggcctgatgtcttggtttggaggccccctcaaaacaatcctgcttatttgtctgtacgtcgcgctcagcatcgggctgttcttcctgctcatctatctgggacggaccggcctttccaagatgtggctggccgctaccaaaaaggccagc

SEQ ID NO: 14674 - RNA, 1521 nt, synthetic construct
  misc_feature 1..1521: note = derived and/or modified CDS sequence (opt5) from RVFV(Ken 199800523)__KU978777.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgaacgcccacgaatcctgtctccgcgcgcccaatctgattagctataagcctatgatcgaccagctggagtgcacgacaaacctcattgatcccttcgtcgttttcgaaagaggatctctgcctcagacccggaatgacaaaacatttgccgcttccaagggcaaccgcggggtgcaggccttcagcaagggatccgtgcaagctgatcttaccctgatgtttgacaatttcgaggtcgattttgtgggcgccgcggtttcttgtgacgccgctttcctcaacctgaccgggtgctacagctgtaacgccggagctagagtgtgcctttccatcacatctacgggcaccggcacactgagcgcccataataaagaagggtccctccacatcgtcctgccgagcgagaacggaaccaaggaccagtgtcagattctgcactttacagtgcccgaggttgaagaggagttcatgtattcttgcgatggcgacgaacggcctctcctggtgaaagggacccttatcgccattgatccctttgacgatagacgcgaagctggaggcgagtccacggtcgtgaatcctaagagcgggtcttggaacttctttgactggttctccggcctgatgagctggtttggaggccccctcaaaacaatcctgcttatttgtctgtacgtcgcgctctctatcgggctgttcttcctgctcatctatctgggacggaccggccttagcaagatgtggctggccgctaccaaaaaggcctcc

SEQ ID NO: 14675 - RNA, 1521 nt, synthetic construct
  misc_feature 1..1521: note = derived and/or modified CDS sequence (opt5) from RVFV(clone 13)__DQ380213.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggacgatcaaaccaaattcctcaagattaaaacagtgagctccgaactgtcttgcagagagggacagagctactggaccggctcctttagccccaagtgtctttcttcccggcgctgccacctggtgggggaatgtcatgtcaatagatgcctcagctggcgggacaacgagacatctgccgagttctcctttgtgggagaaagcaccacgatgcgcgagaataagtgtttcgaacagtgcggcggctgggggtgtggatgctttaacgttaatccttcttgcctgttcgtgcacacctatctgcagtccgtcagaaaagaggccctccgggtgtttaactgtatcgattgggttcataagctgacacttgagattaccgacttcgatggcagcgtgtccacaatcgacctgggggcttctagctcccgctttaccaattggggaagcgtctctctctccctggatgccgaaggcatcagcgggtctaacagcttctcctttattgagtctccgggaaaaggctacgctatcgtggacgaacccttcagcgagattcctagacaaggctttcttggggaaatccggtgcaattccgagagctctgtgctgtccgcccacgagagctgtctccgcgcgcccaacctgatttcttataagcctatgatcgatcagctggaatgcacgacaaatctcattgaccccttcgtcgttttcgagagaggatccctgcctcagacccggaacgagaaaacatttgccgctagcaagggcaatcgcggggtgcaggccttctccaagggatctgtgcaagctgatcttaccctgatgtttgacaacttcgaagtcgattttgtgggcgccgcggttagctgtgacgccgctttcctcaatctgaccgggtgctactcctgtaacgccggagctagagtgtgcctttctatcacaagcacgggcaccggcacactgtccgcccataacaaagacgggagcctccacatcgtcctgccgtctgaaaatggaaccaaggatcagtgtcagattctgcactttacagtgcccgaggttgaggaagagttcatgtattcctgcgacggcgatgaacggcctctcctggtgaaagggacccttatcgccattgacccctttgatgacagacgcgaggctggaggcgaaagcacggtcgtgaaccctaagtctgggtcctggaatttctttgattggttcagcggcctgatgtcttggtttggaggccccctcaaaacaatcctgcttatttgtctgtacgtcgcgctcagcatcgggctgttcttcctgctcatctatctgggacggaccggcctttccaagatgtggctggccgctaccaaaaaggccagc

SEQ ID NO: 14676 - RNA, 1521 nt, synthetic construct
  misc_feature 1..1521: note = derived and/or modified CDS sequence (opt5) from RVFV(2373/74)__DQ380194.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacactggatctcggggcttctagctcccgctttaccaattggggaagcgtctctctgtcccttgacgccgagggcatcagcgggtctaacagcttctcctttatcgaatctccgggaaaaggctacgctattgtggatgagcccttcagcgaaatccctagacaaggctttctgggggagattcggtgcaattccgagagctctgtgctctccgcccacgaaagctgtctgcgcgcgcccaacctgatctcttataagcctatgattgaccagctcgagtgcacgacaaatctgatcgatcccttcgtcgttttcgaaagaggatcccttcctcagacccggaacgagaaaacatttgccgctagcaagggcaatcgcggggtgcaggccttctccaagggatctgtgcaagctgacctgaccctcatgtttgataacttcgaagtcgactttgtgggcgccgcggttagctgtgatgccgctttcctgaatcttaccgggtgctactcctgtaacgccggagctagagtgtgcctgtctattacaagcacgggcaccggcacactctccgcccataacaaagacgggagcctgcacatcgtcctgccgtctgagaatggaaccaaggaccagtgtcagatcctccactttacagtgcccgaggttgaagaggagttcatgtattcctgcgatggcgacgaacggcctctgcttgtgaaagggaccctgattgccatcgatccctttgacgatagacgcgaagctggaggcgagagcacggtcgtgaaccctaagtctgggtcctggaatttctttgactggttcagcggcctcatgtcttggtttggaggccccctgaaaacaattcttctgatctgtctctacgtcgcgctgagcattgggctgttcttcctcctgatctatcttggacggaccggcctgtccaagatgtggctcgccgctaccaaaaaggccagc

SEQ ID NO: 14677 - RNA, 1521 nt, synthetic construct
  misc_feature 1..1521: note = derived and/or modified CDS sequence (opt5) from RVFV(OS-8)__DQ380185.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcagaattaagacagtgagctccgagctgtcttgccgggaaggacagagctactggaccggctcctttagccccaaatgtctttcttcccgcagatgccacctggtgggggagtgtcatgtcaatcggtgcctcagctggcgcgataacgagacatctgccgagttctcctttgtgggagaaagcaccacgatgagagaaaataagtgtttcgagcagtgcggcggctgggggtgtggatgctttaacgttaatccttcttgcctgttcgtgcacacctatctgcagtccgtccggaaggaggccctccgcgtgtttaactgtatcgactgggttcataaactgacacttgaaattaccgatttcgacggcagcgtgtccacaatcgatctgggggcttctagctccagatttaccaattggggaagcgtctctctctccctggacgccgagggcatcagcgggtctaacagcttctcctttattgaatctccgggaaagggctacgctatcgtggatgagcccttcagcgaaattcctcggcaaggctttcttggggagatccgctgcaattccgagagctctgtgctgtccgcccacgaaagctgtctcagagcgcccaacctgatttcttataaacctatgatcgaccagctggagtgcacgacaaatctcattgatcccttcgtcgttttcgaacggggatccctgcctcagacccgcaacgacaagacatttgccgctagcaaaggcaatagaggggtgcaggccttctccaagggatctgtgcaagctgatcttaccctgatgtttgacaacttcgaggtcgattttgtgggcgccgcggttagctgtgacgccgctttcctcaatctgtccgggtgctactcttgtaacgccggagctcgggtgtgccttagcatcacctccacaggcacgggcaccctgagcgcccataacaaggacgggtctctccacatcgtcctgccgtccgaaaatggaacaaaagatcagtgtcagattctgcactttaccgtgcccgaggttgaggaagagttcatgtatagctgcgacggcgatgaaagacctctcctggtgaaggggacacttatcgccattgacccctttgatgaccgccgggaggctggaggcgaatctaccgtcgtgaaccctaaatccgggagctggaatttctttgattggttctctggcctgatgagctggtttggaggccccctcaagacgatcctgcttatttgtctgtacgtcgcgctctccatcgggctgttcttcctgctcatctatctgggaagaacaggccttagcaaaatgtggctggccgctaccaagaaagcctct

SEQ ID NO: 14678 - RNA, 1521 nt, synthetic construct
  misc_feature 1..1521: note = derived and/or modified CDS sequence (opt5) from RVFV(KEN/Bar-035/07)__HM586969.1__Gc
  source 1..1521: mol_type = other RNA
tgcagcgagctgatccaggcctcctctagaattaccacatgtagcacggaaggcgtgaacaccaagtgccggctctccgggacagctctgatccgcgccagatctgtcggagcggaggcttgtcttatgctgaaaggcgttaaggaagaccaaaccaaattcctcaagattaaaacagtgagctccgagctgtcttgccgggaagggcagagctactggaccggatcctttagccccaagtgtctttcttcccgcagatgccacctggtgggcgagtgtcatgtcaatcggtgcctcagctggcgcgataacgagacatctgccgagttctcctttgtgggggaaagcaccacgatgagagaaaataagtgtttcgagcagtgcggaggctggggctgtgggtgctttaacgttaatccttcttgcctgttcgtgcacacctatctgcagtccgtccggaaagaggccctccgcgtgtttaactgtatcgactgggttcataagctgacacttgaaattaccgatttcgacggaagcgtgtccacaatcgatctgggcgcttctagctccagatttaccaattgggggagcgtctctctctccctggacgccgagggaatcagcggctctaacagcttctcctttattgaatctccggggaaaggatacgctatcgtggatgagcccttcagcgaaattcctcggcaaggctttcttggcgagatccgctgcaattccgagagctctgtgctgtccgcccacgaaagctgtctcagagcgcccaacctggtctcttataagcctatgattgaccagctggagtgcacgacaaatctcatcgatcccttcgttgtgttcgaacgggggtccctgcctcagacccgcaacgacaaaacatttgccgctagcaagggaaatagaggcgtgcaggccttctccaaggggtctgtccaagctgatcttaccctgatgtttgacaacttcgaggtggattttgttggagccgcggtgagctgtgacgccgctttcctcaatctgaccggctgctactcctgtaacgccggggctcgggtctgcctttctattacaagcacgggaaccggcacactgtccgcccataacaaagacggcagcctccacatcgtgctgccgtctgaaaatgggaccaaggatcagtgtcagatcctgcactttacagttcccgaggtggaggaagagttcatgtattcctgcgacggagatgaaagacctctcctggtcaaaggcacccttattgccatcgacccctttgatgaccgccgggaggctgggggagaaagcacggtggtcaaccctaagtctggctcctggaatttctttgattggttcagcgggctgatgtcttggtttggcggacccctcaaaacaattctgcttatctgtctgtacgtggcgctcagcattggcctgttcttcctgctcatctatctggggagaaccggactttccaagatgtggctggccgctaccaaaaaggccagc

SEQ ID NO: 14679 - RNA, 1521 nt, synthetic construct
  misc_feature 1..1521: note = derived and/or modified CDS sequence (opt5) from RVFV(MgH824)__DQ380210.1__Gc
  source 1..1521: mol_type = other RNA
tgcagcgagctgatccaggcctcctctagaattaccacatgtagcacggaaggcgtggacaccaagtgccggctctccgggacagctctgatccgcgccggatctgtcggcgcggaggcttgtcttatgctgaaaggggttaaggaagatcaaaccaaattcctcaagattaaaacagtgagctccgagctgtcttgcagagaaggacagagctactggaccggctcctttagccccaagtgtctttcttcccggcgctgccacctggtgggggagtgtcatgtcaacagatgcctcagctggcgggacaatgagacatctgccgagttctcctttgtgggagaaagcaccacgatgcgcgaaaacaagtgtttcgagcagtgcggcggctgggggtgtggatgctttaatgttaacccttcttgcctgttcgtgcacacctatctgcagtccgtcagaaaagaggccctccgggtgtttaattgtatcgattgggttcataagctgacacttgaaattaccgacttcgatggcagcgtgtccacaatcgacctgggggcttctagctcccgctttaccaactggggaagcgtctctctctccctggatgccgagggcatcagcgggtctaatagcttctcctttattgaatctccgggaaaaggctacgctatcgtggacgagcccttccctgaaattcccagacaaggctttcttggggagatccggtgcaacagcgagtccagcgtgctgtctgcccacgaatcctgtctccgcgcgcctaatctgattagctataagcccatgatcgatcagctggagtgcacgacaaacctcattgaccctttcgtcgttttcgaaagaggatctctgccgcagacccggaatgataaaacatttgccgcttccaagggcaaccgcggggtgcaggccttcagcaagggatccgtgcaagctgaccttaccctgatgtttgataatttcgaggtcgactttgtgggcgccgcggtttcttgtgacgccgctttcctcaacctgaccgggtgctacagctgtaatgccggagctagagtgtgcctttccatcacatctacgggcaccggcagcctgtccgcccataacaaagatgggagcctccacatcgtcctgccctctgaaaacggaacaaaggaccagtgtcagattctgcactttaccgtgcctgaggttgaggaagagttcatgtattcctgcgatggcgacgaacggcccctcctggtgaaagggacacttatcgccattgatccttttgacgatagacgcgaggctggaggcgaaagcaccgtcgtgaatcccaagtctgggtcctggaacttctttgactggttcagcggcctgatgtcttggtttggaggcccgctcaaaacgatcctgcttatttgtctgtacgtcgcgctcagcatcgggctgttcttcctgctcatctatctgggacggacaggcctttccaagatgtggctggccgctaccaaaaaggccagc

SEQ ID NO: 14680 - RNA, 1521 nt, synthetic construct
  misc_feature 1..1521: note = derived and/or modified CDS sequence (opt5) from RVFV(200803169)__JF311384.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggtggaccaaaccaaattcctcaagattaaaacagtgagctccgaactgtcttgcagagagggacagagctactggaccggctcctttagccccaagtgtctttcttcccggcgctgccacctggtcggggaatgtcatgtgaatagatgcctcagctggcgggataacgagacatctgccgagttctcctttgttggagaaagcaccacgatgcgcgagaataagtgtttcgaacagtgcggcggctgggggtgtggatgctttaacgtgaatccttcttgcctgttcgtccacacctatctgcagtccgtgagaaaagaggccctccgggtttttaactgtatcgactgggtgcataagctgacacttgagattaccgatttcgacggcagcgtctccacaatcgatctgggggcttctagctcccgctttaccaattggggaagcgtgtctctctccctggacgccgaaggcatcagcgggtctaacagcttctcctttattgagtctccgggaaaaggctacgctatcgtggatgaacccttcagcgagattcctagacaaggctttcttggggaagtccggtgcaattccgagagctctgttctgtccgcccacgagagctgtctccgcgcgcccaacctggtgtcttataagcctatgatcgaccagctggaatgcacgacaaatctcattgatcccttcgtggtcttcgagagaggatccctgcctcagacccggaacgacaaaacatttgccgctagcaagggcaatcgcggggtgcaggccttctccaagggatctgttcaagctgatcttaccctgatgtttgacaacttcgaagtggattttgtcggcgccgcggtgagctgtgacgccgctttcctcaatctgaccgggtgctactcctgtaacgccggagctagagtttgcctttctatcacaagcacgggcaccggcacactgtccgcccataacaaagacgggagcctccacattgtgctgccgtctgagaatggaaccaaggatcagtgtcagatcctgcactttacagtccccgaagtggaggaggagttcatgtattcctgcgacggcgatgaacggcctctcctggtcaaagggacccttatcgccattgacccctttgatgacagacgcgaagctggaggcgagagcacggtggttaaccctaagtctgggtcctggaatttctttgattggttcagcggcctgatgtcttggtttggaggccccctcaaaacaatcctgcttatttgtctgtacgtggcgctcagcatcgggctgttcttcctgctcatttatctgggacggaccggcctttccaagatgtggctggccgctaccaaaaaggccagc

SEQ ID NO: 14681 - RNA, 1521 nt, synthetic construct
  misc_feature 1..1521: note = derived and/or modified CDS sequence (opt5) from RVFV(2007001811)__EU574040.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcatgattaagacagtgagctccgagctgtcttgcagagaaggacagagctactggaccggctcctttagccccaaatgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaggaggccctccgggtgtttaactgtatcgactgggttcataaactgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaagggctacgctatcgtggatgagcccttcagcgaaattcctagacaaggctttcttggggagatccggtgcaattccgagagctctgtgctgtccgcccacgaaagctgtctccgcgcgcccaacctgatttcttataaacctatgatcgaccagctggagtgcacgacaaatctcattgatcccttcgtcgttttcgaaagaggatccctgcctcagacccggaacgagaagacatttgccgctagcaaaggcaatcgcggggtgcaggccttctccaagggatctgtgcaagctgaccttaccctgatgtttgataacttcgaagtcgactttgtgggcgccgcggttagctgtgatgccgctttcctcaatctgaccgggtgctactcctgtaacgccggagctagagtgtgcctttctatcacaagcacgggcaccggcacactgtccgcccataacaaggacgggagcctccacatcgtcctgccgtctgagaatggaaccaaagaccagtgtcagattctgcactttacagtgcccgaggttgaagaggagttcatgtattcctgcgatggcgacgaacggcctctcctggtgaaggggacccttatcgccattgatccctttgacgatagacgcgaagctggaggcgagagcacggtcgtgaaccctaaatctgggtcctggaatttctttgactggttcagcggcctgatgtcttggtttggaggccccctcaagacaatcctgcttatttgtctgtacgtcgcgctcagcatcgggctgttcttcctgctcatctatctgggacggaccggcctttccaaaatgtggctggccgctaccaagaaagccagc

SEQ ID NO: 14682 - RNA, 1521 nt, synthetic construct
  misc_feature 1..1521: note = derived and/or modified CDS sequence (opt5) from RVFV(Kenya 57 (Rintoul))__DQ380192.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacagtcgatctgggggcttctagctcccgctttaccaattggggaagcgtgtctctctccctggacgccgagggcatcagcgggtctaacagcttctcctttatcgaatctccgggaaaaggctacgctattgtggatgagcccttcagcgaaatctccagacaaggctttcttggggagattcggtgcaatagcgagtcttccgtcctgagcgcccacgaatcttgtctccgcgcgcctaacctgatctcctataagcccatgattgaccagctggagtgcacgacaaatctcatcgatcctttcgttgtgttcgaaagaggaagcctgccccagacccggaacgacaaaacatttgccgcttccaagggcaatcgcggggtgcaggccttctctaagggaagcgtccaagctgatcttaccctgatgtttgacaacttcgaggtggattttgttggcgccgcggtgtcctgtgacgccgctttcctcaatctgaccgggtgctactcttgtaacgccggagctagagtctgccttagcattacatccacgggcaccggcacactgagcgcccataacaaagacgggtctctccacatcgtgctgccttccgaaaatggaaccaaggatcagtgtcagatcctgcactttacagttccggaggtggaggaagagttcatgtatagctgcgacggcgatgaacggcccctcctggtcaaagggacccttattgccatcgacccttttgatgacagacgcgaggctggaggcgaatctacggtggtcaaccccaagtccgggagctggaatttctttgattggttctctggcctgatgagctggtttggaggccctctcaaaacaattctgcttatctgtctgtacgtggcgctctccattgggctgttcttcctgctcatctatctgggacggaccggccttagcaagatgtggctggccgctaccaaaaaggcctct

SEQ ID NO: 14683 - RNA, 1521 nt, synthetic construct
  misc_feature 1..1521: note = derived and/or modified CDS sequence (opt5) from RVFV(Beijing-01)__KX611606.1__Gc
  source 1..1521: mol_type = other RNA
tgcagcgagctgatccaggcctcctctagaattaccacatgtagcacggaaggcgtgaataccaagtgccggctctccgggacagctctgatccgcgccggatctgtcggcgcggaggcttgtcttatgttcgaaggggttaaagaggaccaaaccaagtttctgaaaattaagacagtgagctccgaactctcttgcagagagggacagagctactggaccggctccttcagccccaaatgtctgtcttcccggcgctgccaccttgtgggggagtgtcatgtcaatagatgcctgagctggcgggataacgaaacatctgccgagttttccttcgtgggagaaagcaccacgatgcgcgagaataagtgttttgagcagtgcggcggctgggggtgtggatgcttcaacgttaatccttcttgcctctttgtgcacacctatctgcagtccgtcagaaaggaagccctgcgggtgttcaactgtatcgactgggttcataaactcacactggagattaccgattttgacggcagcgtgtccacaatcgatcttggggcttctagctcccgcttcaccaattggggaagcgtctctctgtccctcgacgccgaaggcatcagcgggtctaacagcttttccttcattgagtctccgggaaagggctacgctatcgtggatgaaccctttagcgagattcctagacaaggcttcctgggggagatccggtgcaattccgaaagctctgtgctttccgcccacgagagctgtctgcgcgcgcccaacctcatttcttataaacctatgatcgaccagctggaatgcacgacaaatctgattgatcccttcgtcgtttttgagagaggatccctccctcagacccggaacgacaagacattcgccgctagcaaaggcaatcgcggggtgcaggccttttccaagggatctgtgcaagctgatctgacccttatgttcgacaactttgaagtcgatttcgtgggcgccgcggttagctgtgacgccgcttttctgaatctcaccgggtgctactcctgtaacgccggagctagagtgtgcctgtctatcacaagcacgggcaccggcacactttccgcccataacaaggacgggagcctgcacatcgtcctcccgtctgagaatggaaccaaagatcagtgtcagattctgcacttcacagtgcccgaggttgaagaggaatttatgtattcctgcgacggcgatgagcggcctctgctcgtgaaggggaccctgatcgccattgaccccttcgatgacagacgcgaagctggaggcgagagcacggtcgtgaaccctaaatctgggtcctggaactttttcgattggtttagcggccttatgtcttggttcggaggccccctgaagacaatcctcctgatttgtctttacgtcgcgctgagcatcggactcttctttctgctgatctatctcgggcggaccggcctgtccaaaatgtggcttgccgctaccaagaaagccagc

SEQ ID NO: 14684 - RNA, 1521 nt, synthetic construct
  misc_feature 1..1521: note = derived and/or modified CDS sequence (opt5) from RVFV(ANK-6087)__DQ380216.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagattaaaacagtgagctccgagctgtcttgcagagaaggacagagctactggaccggctcctttagccccaagtgtctttcttcccggcgctgccacctggtgggggagtgtcatgtcaatagatgcctcagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctgcagtccgtcagaaaagaggccctccgggtgtttaactgtatcgactgggttcataagctgacacttgaaattaccgatttcgacggcagcgtgtccacaatcgatctgggggcttctagctcccgctttaccaattggggaagcgtctctctctccctggacgccgagggcatcagcgggtctaacagcttctcctttattgaatctccgggaaaaggctacgctatcgtggatgagcccttcagcgaaattcctagacaaggctttcttggggagatccggtgcaattccgagagctctgtgctgtccgcccacgaaagctgtctccgcgcgcccaacctgatttcttataagcctatgatcgaccagctggagtgctccacgaatctcattgatcccttcgtcgttttcaaaagaggaagcctgcctcagacacggaacgacaagacctttgccgcttccaagggcaatcgcggggtgcaggccttctctaaaggaagcgtgcaagctgatcttacactgatgtttgacaacttcgaagtcgattttgtgggcgccgcggtttcctgtgacgccgctttcctcaatctgaccgggtgctactcttgtaacgccggagctagagtgtgccttagcatcacctccacaggcacgggcaccctgagcgcccataacaaggacgggtctctccacatcgtcctgccgtccgagaatggaacaaaagatcagtgtcagattctgcactttaccgtgcccgaagttgaggaggagttcatgtatagctgcgacggcgatgaacggcctctcctggtgagagggacacttatcgccattgacccctttgatgaccgccgggaagctggaggcgagtctaccgtcgtgaaccctaagtccgggagctggaatttctttgattggttctctggcctgatgagctggtttggaggccccctcaaaacgatcctgcttatttgtctgtacgtcgcgctctccatcgggctgttcttcctgctcatctatctgggaagaacaggccttagcaagatgtggctggccgctaccaaaaaggcctct

SEQ ID NO: 14685 - RNA, 1521 nt, synthetic construct
  misc_feature 1..1521: note = derived and/or modified CDS sequence (opt5) from RVFV(MP12)__Z30318.1__Gc
  source 1..1521: mol_type = other RNA
tgcagcgagctgatccaggcctcctctagaattaccacatgtagcacggaaggcgtgaacaccaagtgccggctctccgggacagctctgatccgcgccggatctgtcggcgcggaggcttgtcttatgctgaaaggggttaaggaagaccaaaccaaattcctcaagctgaaaacagtgagctccgagctttcttgcagagaaggacagagctactggaccggctcctttagccccaagtgtctgtcttcccggcgctgccacctcgtgggggagtgtcatgtcaatagatgcctgagctggcgggataacgagacatctgccgagttctcctttgtgggagaaagcaccacgatgcgcgaaaataagtgtttcgagcagtgcggcggctgggggtgtggatgctttaacgttaatccttcttgcctgttcgtgcacacctatctccagtccgtcagaaaagaggccctgcgggtgtttaactgtattgactgggttcataaacttacactggaaatcaccgatttcgacggcagcgtgtccacaattgatctcggggcttctagctcccgctttaccaattggggaagcgtctctctgtcccttgacgccgagggcatcagcgggtctaacagcttctcctttatcgaatctccgggaaagggctacgctattgtggatgagcccttcagcgaaatccctagacaaggctttctgggggagattcggtgcaattccgagagctctgtgctctccgcccacgaaagctgtctgcgcgcgcccaacctgatctcttataagcctatgattgaccagctcgagtgcacgacaaatctgatcgatcccttcgtcgttttcgaaagaggatcccttcctcagacccggaacgacaaaacatttgccgctagcaagggcaatcgcggggtgcaggccttctccaagggatctgtgcaagctgatctgaccctcatgtttgacaacttcgaggtcgattttgtgggcgccgcggttagctgtgacgccgctttcctgaatcttaccgggtgctactcctgtaacgccggagctagagtgtgcctgtctattacaagcacgggcaccggctccctcagcgcccataacaaagacgggtctctgcacatcgtcctgccgtccgaaaatggaacaaaggatcagtgtcagatcctccactttaccgtgcccgaggttgaggaagagttcatgtatagctgcgacggcgatgaacggcctctgcttgtgaaagggacactgattgccatcgacccctttgatgacagacgcgaggctggaggcgaatctaccgtcgtgaaccctaagtccgggagctggaatttctttgattggttctctggcctcatgagctggtttggaggccccctgaaaacgattcttctgatctgtctctacgtcgcgctgtccattgggctgttcttcctcctgatctatcttggaggcacagggctgagcaagatgtggctcgccgctaccaaaaaggcctct

SEQ ID NO: 14686 - RNA, 1521 nt, synthetic construct
  misc_feature 1..1521: note = derived and/or modified CDS sequence (opt5) from RVFV(KEN/Bar-032/07)__HM586968.1__Gc
  source 1..1521: mol_type = other RNA
tgcagcgagctgatccaggcctcctctagaattaccacatgtagcacggaaggcgtgaacaccaagtgccggctctcccacacagctctgatccgcgccgggtctgtcggagcggaggcttgtcttatgctgaaaggcgttaaggaagaccaaaccaaattcctcaagattaaaacagtgagctccgagctgtcttgcagagaagggcagagctactggaccggatcctttagccccaagtgtctttcttcccggcgctgccatctggtgggcgagtgtcacgtcaatagatgcctcagctggcgggataacgagacatctgccgagttctcctttgtgggggaaagcaccacgatgcgcgaaaataagtgtttcgagcagtgcggaggctggggctgtgggtgctttaacgttaatccttcttgcctgttcgtgcatacctatctgcagtccgtcagaaaagaggccctccgggtgtttaactgtatcgactgggttcacaagctgacacttgaaattaccgatttcgacggaagcgtgtccacaatcgatctgggcgcttctagctcccgctttaccaattgggggagcgtctctctctccctggacgccgagggaatcagcggctctaacagcttctcctttattgaatctccggggaaaggatacgctatcgtggatgagcccttcagcgaaattcctagacaaggctttcttggcgagatccggtgcaattccgagagctctgtgctgtccgcccatgaaagctgtctccgcgcgcccaacctggtctcttataagcctatgattgaccagctggagtgcacgacaaatctcatcgatcccttcgttgtgttcgaaagagggtccctgcctcagacccggaacgacaaaacatttgccgctagcaagggaaatcgcggcgtgcaggccttctccaaggggtctgtccaagctgatcttaccctgagatttgacaacttcgaggtggattttgttggagccgcggtgagctgtgacgccgctttcctcaatctgaccggctgctactcctgtaacgccggggctcgggtctgcctttctattacaagcacgggaaccggcacactgtccgcccacaacaaagacggcagcctccacatcgtgctgccgtctgaaaatgggaccaaggatcagtgtcagatcctgcattttacagttcccgaggtggaggaagagttcatgtattcctgcgacggagatgaaagacctctcctggtcaaaggcacccttattgccatcgacccctttgatgaccgccgggaggctgggggagaaagcacggtggtcaaccctaagtctggctcctggaatttctttgattggttcagcgggctgatgtcttggtttggcggacccctcaaaacaattctgcttatctgtctgtacgtggcgctcagcattggcctgttcttcctgctcatctatctggggagaaccggactttccaagatgtggctggccgctaccaaaaaggccagc

SEQ ID NO: 14687 - RNA, 4020 nt, synthetic construct
  misc_feature 1..4020: note = derived and/or modified CDS sequence (opt5) from SFNV(Toscana)__NC_006320.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatattacagagtccatcggcctgacctctgggacatgcaaggtcggaagcctcgaaaaccgcgattgtaaaagagacatcatgtccaattatgttgcggaggtgcacagcaacctgcatggcctgggggctatgatgcacaattacggagatgacaagcgggtggaagtcctcaacgatgtgattcccgacgagctgaatcctggccgccataactgctctgatcttgacagaaaaccgttctggaccgagtttatcaatgttgccaagcccgccaacaagattgctcctatctccgtgattccccctcccatcgtcaaacctattccgatcgccgaaagcacaatcaagaaaaccattcccttcgataagctgctctctgaggctgaaaaagagctgaatcaaacgaagatccggcttgagaccgaacgcagatccaacgccgaggaagcggcccgggagcgcgctagaatgcgggaaattgaggacaagctgcgcaaaaattgggagctcgaaagagagcggaaggatgccgtggctgacgatctggccaaagaaatcgcgcgcagacgggagattgaaagaaaggcccacgagctggacaaaatgctcaagaaaaaggagcgcgaagaccaggttgctatcgagcgggtgagcgaagatatgagaaaccatgtccgccggcctaatacaaccatcgcccccgctcctacaattatcaccacgctgcttatggcctctgccgtgatggctggccccctggagaacagagaaacaaaccacctcctgaatcgcccggggaacggagcgtataccctttccgactttgccgagagcacatgtaccctggcttacggctccaagtgcaaatcttgggagcaccagctcgatgaactgagcttcccctttttccattccaatctggacaagtatagcatgctcgaggccgccaccgaaacaattcctatcctgaacaaatcttccgctgtgtgtacgattagcccttctacccacagctccaatgcctgcgggcgggaggcgtctcttatcaagaaaaagtgtggaaacaatatgagcgcctttttctacgtcaacctggctggccaaatcacagttgtgaagtgcgataccaatcatgtgctctccaacgactgtgggaattgcattagcaaaacactgtctggacagaagatctacacccccgtccaggatatgttttgccagagaggctggacggagtccattcccagcacacgctattctaaagacctttgttccatcggcctgcacaccgtgaaggaatgcaaaaccgggacaaccaacttcgagcgggttggatttattgtggtcaagagcagaaagatgtacatcgaacaaatgaaaatgcgctcccggcaggagttctctgaagatcagttcctctgttataagagcgagtcctctagcggctccagcgtgaaactgaagaaagttaaggtggagtcttgcaagggggtcacaacgtccagcgcctctaaatgttccggagacgaatacttttgcagcagatatccttgtgagaccgctaatgtggaagcccactgcattctgcggcgccattctgctgtcatcgaggtgaacgttaatggcgtgtgggtcgtgccgagatgtatcgggtacgaagaggttctcgtgcggagaacaagcctgaagatggaggatacctccagccgcgaatgcgacacatgtctttgggagtgcgggaaaaacaagctgattgtcaaaacccacggccccaagatcgtgtatgccacggcgtgctctcatggctcctgtaaaagcgtgatgcagaagcctgccaccttcgtttacctcccctaccctgggaactccgaaattgtcggaggcgacatcggggtgcacatgacagaggaatctagcccctccaatattcatatggtggctcactgcccggccaaggattcttgtgaggtcagctcctgcctgttttgtgtgcacggactgcttaactatcaatgccataccctcttctctgctctgctgatcagcacaaccgttatgtccatcctcacgctgcttctgctcctggtgaaaggcgccaaggacctggtcaaaaagctcttttactggctcattacacctctgtgttggctgagcgtgttctgcgggtggatgatcaaatcttggaagaagaaagttggctccgcgattagccggaccaatgatacaatcggatggagagacaaccgcagatatggccgggatgtggagcgcgcccagtacaccgggggagctcccggcgccaagtattctttttacggggtcatgattctcggactgcttggcaatgtgcactcctgtagcgaatctgttatcgctgactccaaagtgatgcagtgcaccacaagcgggtccagcacgctgtgtaaggcctctggcaccgtcatcatgaaactcggacctattggcagcgagtcctgcctgatcctgaaggggcttaaggataacgaaaaacaattcatttctatcaagacaattagctccgagcttacctgcagagagggagaatctttttggacaaccctgtatacgcccgtgtgtctgagctcccggcgctgccatctcatgggcgagtgttgctctgacagatgtctgaaatggaagacaaatgaaaccagcgccgagttcaccgggaaagctcacggagaagtgatgcacgagaaccggtgctttgagcagtccggcgggatcggctacggatgtttcaatgtcaaccctagctgcctttacgttcattctatcctgaagtccgtgtataagaatggctttaaaattttccgctgtgtggcgtggaaccacagaatccggctcgaagtcacaacccatagccgcaagttccccatggtgctgatggccatgtctacacagccgacggattgggggtccattggactgatccttgacagcgagggcattaccgggacaaatgcttactcctttatgaaacacggatctggcagcctcgccatcattgatgacccttattcccccgaacccagaaaggggttcctgggcgaggttcggtgccctaccgaagagacagccatcagagctagcccgtcttgtaaaatggcccccaacctgatcgagtaccagcctgaaatggataccgcggagtgcacgaccaatatgattgaccccatggctatctttaaccgcggatccctccctcaagtgcgggacggcatgacattcacccagagcattgaaaagaacacagtccaggccctgaccacaggggaggtgagagcctctatccgccttaccctggatgactatgatgttgtgtaccataatagccagtccgactgctctgctacgtttaaaaacctcacaggatgttatagctgcgatgaaggctcccggatgtgttaccaagtcaaggccgagggggagaccattttccactttgtgaatgaagacgagtctatcaacgttatcaataaggtgagccccgatgtctccgactactgcaccgtgctgcacttcagcagacctgtgatttctatcgaaggacgctatgattgtggcctgtccaaaagccccatggtcattaagggcacacttatcgcgaccgctccgcatgacgatcggaaacacgagggaggatcctctctggttgtgaaccctaagggcgggacggtggactttttcggatgggtcagcggcctcacatcctggctcgggggacccctgaaaacctttctgacaattcttggcttcctggccctcggcctgctgcttgtggttatcatcattaccatcgccagaacaggggtggagcaggctctgaagaagaaaaataagtga

SEQ ID NO: 14688 - RNA, 3972 nt, synthetic construct
  misc_feature 1..3972: note = derived and/or modified CDS sequence (opt5) from SFNV__HM566171.1__GP
  source 1..3972: mol_type = other RNA
atgctgaacaccaagagcatcattctcatcacatgcctggtgcagcaagtccaccttaaatacacgattatctccgaggttaccaagggcgccagagaagtgtcttgttatagctccacaacccggctggaccagctcctggaggcttgggaaaataaatctgcccttatggggctgcgcaagggaaactgcaaactcggcgcgatggaacaggtggattgtaatctggacctgatgagcaactacgtctccaatgtgtatgataacccccatgggctcggagctatgatgtacaatgacaagagaattgaggttctgaacgatcagatccctgactctatgatcccgggcgggcacaattgcagccttctggagcggaagcccttctgggccgatctcattccttccaaaaaggagaacccccgccctagcctgatctctcttgtgcccacacctagatccgactttaaacggaagttcgaagaggccgaagaggagatgaaaaagattcgcaaggaactgcaagatgagagacaggctcagctcagcgtcatcgaagagggacggaaacgcatgagagacctggaagataagctgatgcggcagtggaatgaggagaaacaaaagaaaggcctcctggaagagacccttgaaaagaaacgccagctgaagaacaaggccctcctggacgctcataatcttgataaacagctgaaggagaaagacagagaatttaagacagccatggaggagcaccagaacgaacggcatcgcattaattctaacatgatcagaccgcccattaccacgcctgcggccgtgatcctcacctccctgctgagcgcttctgttgtgctcggcttcgagctggaaaaccggaatacaaaccacgcccttaatagacccgggaacggaggctattccatcagcgacaataacctgattgaggctaaatgtatgatcacctacgggaataagtgcccttcctgggaaatgcaactcgatcccgtctcttatccgtttttcagctccaactttgagaagtacagcctgcttgagtctatttccgaaacaagccctatcattggaaaattctctgaggtgtgtgtgctgagcaatctccccggcgcccagaagacctgcgcgaaagaagcctccctgatcaagaaacagtgttctgacgatatgcgcgcttacttttatatcaacagcctggggaagctcgccattgtcacgtgccctgagaataacgttctgtcccaagactgtaatttctgccttcggaaggctaaaggagagcagtacgtgtataagcccatccaggatggcttttgccagaacggcggggtgagctctgtcccctccattagatacagcaaagacatctgttctattggacctacaaaggtgaaaaattgccacaagggcacctcccgctatgaacggacagccttcatcagcaccggggataagaaagtttacctggaggaaatcaagattagatcccgccaagagtatgaaccggaccagtttctctgttacaaagtgaaggattctagctcctctcccctggcctacgagaaagtccaggtgagcaagtgcaaaggaatcgagaccaactcccctaagaagtgtacaggcgacgaatatttctgcagcaaatacccctgtgagtctacgtcccctgaagctaactgcttcctgcggaagcatagcgcgattcttgaggttaatatcgggggaatgtggattaaacccaagtgtatcggctatgaaatggccctcgtgaaaagagtcggcctgcgctctgaggatgtgtccagcaaggagtgcgctacctgtctgtgggaatgctctagcgggtacatttccatcacaacccacggaccgaagatcagctatgccacagcctgctctcatggctcctgtaaaagcattgtccagaacccttccacctctatccggattagctaccccggaaattccgagatcgtgggaggcgacattgggatccacctcacggaagactctagccctatcaacctgcaccttaagattcattgctcccccaaagattcttgtgaggttagcgactgcatcttttgtgtgcacggcctgctcaattatcaatgccattccgtcgctagcgccctgctgctttctacaattaccgcgtccctcatcgtgctgatgatttacatgctgagcaagaccaaattcgttatgaagaagctcatccctatcatgctgacacccctttgttggtgctttgtgctgctcgcttggctgaccaaatcttggaagggaaaaatgagaaacgccattcagtccgccaatagcacaatcggctggacggaacgcgaggagcggattgtcgctgaaagaccgcggtctcgcaacaccgtgagatactccttctatggggtggttatcctggccatgcttgagagcgcttttggatgttccgaaagcctcattgccgagtctaaggtcatgcagtgcaatatcgcgaacggcaaaacaagctgtcgggcctccgggaccatcattatgaagctgggacctatcggctctgaggcttgcctgattctcaaggggctgagagatagcgacaaacagtacatctccgtgaagacagaatctagcgagcttatttgccgcgaaggcgagtccttctggacctctctgtatacgcccgtgtgtctcagctcccggagatgccacctgatgggagaatgtaccggcgatctgtgccttaaatggaaaagcaataagacatctctcgagtttgccgggaagacccgctccgacgtcatcaacgagaataaatgtttcgaacaaagcggaggcctggggtacggatgctttaacgtgaatccctcttgtctgtatacacatgcttacctcaagtccgtttatagaaacggcttccgggtgtttaagtgcgccagctggacccaccgcgtcaaactgacgattacaacccactccagaacattccctatgacccttgcggccatgtctacccagccgacagattgggggagcatcggcctgatcctcgactccgagggaattagcggcacgaactctttttccttcatgaagcatgggctggggagcttcgctatcattgatgaaccctactctatggagcctcggaaaggctttatcggggaagtgcgctgtcccaccgaggaggccgctattaaggccagcacactgtgcaaaaccgcccctcagcttatcgaataccagcccgagatggactccgctgaatgtacaaccaatatgatcgatcctatgtctgttttcaacagaggaagcctgccccaagtgcgggagggcatgacgtttacacagtccatggaaaagaataccgtccaggcgatgaccacaggggaggtgcacgcctctattcgcatcgttctcgacgattatgaggtggaatacctgagctcccaagtcgactgcgacgctaccttcaagaacctcacaggctgctatagctgtgatgagggagccagagtgtgcatgcagattatcgcccatggcgacacgatttttcacttccggaatccggatgtgtctatcaacatcctgcagaaagtcaataccaacacacttatttactgttccgttgtgcactttagcaagcctgtgatcaaagaagaggggacctatgactgcggagctggcgagaagcccatgattctgaaagggacactcgtcgccgtgtcccctcataatgatcgcctggaacagggaggctctagcatcgttattaaccccaagggcgggggagtggacttcctgggctggctttccgggttttctagctggttcggaggcccgctgaaggcgatcctcatggtcattgggtttctgctcctgggacttatcctgttcgtgaccatcgctattggcctcaaatttgccctgagacaaatgatcgttaagcggatgaaatga

SEQ ID NO: 14689 - RNA, 3873 nt, synthetic construct; identical to SEQ ID NO: 14372
  misc_feature 1..3873: note = derived and/or modified CDS sequence (opt5) from SFNV(Namru)__HM566169.1__GP
  source 1..3873: mol_type = other RNA

SEQ ID NO: 14690 - RNA, 3990 nt, synthetic construct
  misc_feature 1..3990: note = derived and/or modified CDS sequence (opt5) from SFNV/SFNV-like(Poona)__HM566177.1__GP
  source 1..3990: mol_type = other RNA
atgctgaacgtcaagagcgtgatcctcattacctgcctggttcagcaagcccaccttaaatacacaatcatttccgaggtggctaagggcgccagagaagtgtcttgttatagctccacgacccggctggaccagctcctggaggcgtgggaaaataaatctgctcttatcgggctgaagcgcggaaactgcaaactcggcgccatggagcagattaattgtaacctggatctgatgagcaattacgtctccaacgtgtatgacaatccccatgggctcggagccatgatgtacaacacagattctgacaagagaatcgaagttctgaatgatcagatccctgacagcatgattccgggcgggcacaactgctcccttctggagcggaagcccttctgggctgatctcatccctcccaaaaaggagaaagaactggaccctaagcccagccttatttctctggtgcctaccccgcgcgatgactttaaaaagaagttcgaggaagccgaggaggaaatgaaaaagatcagaaaagagctccaaaatgaacggcaggctcagctgtccgtcatggaggatagccgcaagaaaatgagagacctggaagatcggctcatgcgccagtgggaggaggaaaagcagaaaaagggactgcttgaggaaacactggagaaggaaagacaactcaaaaacaaggccctgcttgacgcgcatgacctggataaacagctcaaggagcgggaccgcgagtttaaaaccgccatggaggaacaccagaatgaaagacggcgcattaactctaatatgatcagaccctatgtgacaacccctgctgccattatcctgacgtccctgctcagcgcttctgttgtggtcggcttcgagctggaaaaccggaacaccaatcatgtgcttaacagacccggcaatgggggatactccatcagcgataacaatctgattgaggccaagtgtatgatcacatatggcaccaagtgcctctcctgggagatgcaactgaaccctgtgtcttacccctttttcagctccaattttgaaaaatacagccttctggagtctgtctccgaaacaaccccgattatcgggaagttcagcgaggtttgtgtgctctctaacctgagcggagcgcagaaaacgtgcgccaaggaggcttccctgattaaaaagcagtgtcctgacgatatccgcgcctatttttacatcaattctctcggcaagctggctattgtgacatgccccgaaaacaatgtccttagccaagactgtaacttctgcgtgcctaaagccaagggggagcggtatatctacaaacccattcaggatggattttgccagaatggcggcgtttccaccgtgcccagcgtcagatattctaaggacatctgttccattgggcctctgaaagtgaagaactgccacaagggaacaagccgctacgaacggaccgccttcatctctaccggcgataaaaaggtttatctcgaggaagtgaaaatcagatcccgccaggagtacgagccggaccaatttctgtgttacaaggtcaaagatgggagctcctctcccctggtgtatgaaaaggtccaggtgagcaaatgcaagggaattgagacaaattcccctaagaaatgtacgggcgacgaatacttctgctctaagtatccctgtgagagcacctcccctgaagctaactgctaccttcggaaacacagcgcgatcattgaggttaacatcgggggaatgtgggtgaagcccaaatgtgtcggctatgagatggccctcgtgaagagagttggcctgcgctctgaagacgtgtccctgaaggagtgcgctacatgtctctgggaatgctctagctcctacattagcatcaccacacatgggccgaaaatttcttatgccaccgcctgcagccacggatcctgtaagagcgtcgtgcagtctccttccacgagcatcaaaatctcctaccccggcaattctgagattgtgggcggagatatcggcattcatctgacagaagacagctcccctgttaaccttcacctgaagatccactgcccgcctaaagattcttgtgaggtcagcgactgcattctctgtgtgcatgggctgctgaattaccagtgccactccgtggcttctgcccttctcctgagcaccatcatcgcgtccctgattgctctcgtcgtgtatatgctgagcaagacccggttcgttatgagaaagatcgtgcccattatgtttatcccgttctgttggtgctttgtccttctggcctggctcacacgctcttggaaaggcaaggtgcggaacgccattcaatccgctaataacaccatcggatggacagagagagaggaacgggttatcgccgaacgccctggcgggagaaatacgattcggtacagcttctatggagtggtcatcctggctattctggagtctgcctttggctgttccgagagccttatcgcggaatctaaaattatgcagtgcaacatcgccaatgggaagacctcctgtagagctagcggaacaatcattatgaaactcggccccatcgggtccgaggcctgcctgattctgaagggcctccgcgatagcgacaagcagtacatctctgtgaaaaccgaaagctccgagctgatttgccgggaaggagagtctttctggacaagcctttatacccccgtttgtctgtcctctagacgctgccatctcatgggcgagtgtacgggggatctgtgcctgaagtggaaaagcaacaagacctcccttgaatttgctggaaaaacacactctgaggtgatgaatgaaaacagatgtttcgagcagagcggcgggctcggatacggctgctttaatatcaacccttcctgtctgtatacccatgcctacctcaagagcgtctaccggaatgggttccgcgtgtttaaatgcgcgtcttggacacacagagtgcggctgaccattacgacacactcccgcaccttcccgatgacactggccgctatgagcacccaacccaccgactggggctctatcggacttatcctggattccgaaggcattagcgggacaaactccttttctttcatgaagcatggactcggcagcttcgccatcattgacgagccttattccatggagcccagaaaggggtttatcggagaagtccggtgtcctacggaggaagctgccattaaagccagcaccctgtgcaagacagctccccagctgatcgagtaccagcctgaaatggattctgttgagtgtaccacaaacatgatcgaccccatgtccattttcaatcgcggcagccttccccaggtgagagaggggatgacctttacgcaatctatggagaaaaacacagtgcaggcgatgaccaccggcgaagtccacgccagcatccggctggtgctcgatgactatgaagttgagtacctgtccaatcaggtggactgcgatgctacattcaagaacctcaccggatgctattcttgtgacgagggcgcccgcgtctgcatgcaaattaaagcccatggggatacaatctttcacttcaagaatagcgacatgtccatgaacattctgcagaaggtgtctacgaatacccttatctactgtagcgttgtgcacttttccaaacctgtcatcaaggaagagggagtgtatgattgcggcgctggggaaaaacccatgattctgaagggaacactcgttgccgtgagccctcataacgacagactggagcagggcgggtcttccatcgtcattaatcccaaagggagcggagtggatttcctgggctggctttccgggttttctagctggttcggaggcccgctgaaggcgatcctcaccgtgattgggtttctgctcctgggattccttctgtttatgctcgtcacaatcggcctgcggtacgctctgtcccaggttgtgaccaagaaaatgaagtga

SEQ ID NO: 14691 - RNA, 4002 nt, synthetic construct
  misc_feature 1..4002: note = derived and/or modified CDS sequence (opt5) from Arrabida virus(PoSFPhlebV/126/2008)__KP863800.1__GP
  source 1..4002: mol_type = other RNA
atgttctacgccaagtttatcctgctcctgtgcttcgtgcagggagcccttctgaaatataccattatcagcaaggtcgggtcctctacatacaaaagagtttgtctcagccacacgaccgacctggatacacttctggacatgacctcccgggagatgtctaacattaagctcacaggaggcagctgctccctgggggatctgaccaaacccgactgttctcctgactttttcagcaattatgtggctaacatccaatccagcaatacaaagattaccggaaagtttcaggatatcatcggcgaacgcgagatggaagtgacgaacgatgtcgtgccggactctttcgggcccggacctcatgattgcgtttcctttgacaaaaagcccttctggagcgatctcctgcctacctctgtgtccaaagaggaacccaagcctattatcagcacactttctgtcctgccggcggctccccctattaaagacttttcccacaaggtggttgaggccgaggaaatggtgaaggagatcgaaggcgagctcatgaaagagaaggaaagaaatagcgccaaagaggaagaggctcggcagcgcatgagagaactggaggatgaccttcggaagcagtgggccgctgagcgcatggccaaacaaaacatgtcctctgtcctggaaagagagcggcaggaaaagcagagcctcgagcgcagaatgcatgaagtggacaaaaagctgcgggcgtccgaggatcgcgcccagaagtaccaagagagagctgaacaggccgagaaaagccactctaagctgctctcccggagcggcgctgccaccacaatggcgaccgtggtcttcacgtctctgcttgccagcgggctggctgttgtgacagaactcgagaaacgcgacaccaatcatctgcttaacagacccggaaatggcgtgtatatggccaacgctgattccctgattcagacagaatgtaccctcaattacgggcagcggtgcctggcctgggagctgcaaatcacccctgtcagatatccctttttcacatctaacgtggacaagtacagcctcctggagtccattacggaaaccccgagcatccttgagaaaaataacgaatcttgtcagctggccacaacctccggaagcctcaagacatgcgctaaggaggcgtctaccatcaaaaagcactgtacggatgacgttcgcgcctttttcttcattaattccgtgggcaaactgacaatcgtccggtgcgctgataaccacattcttagcgaggactgtaacttttgcatctccaaggccagaaattctaaccagaatatgttcatgcctgtgcaagatgccttttgccagcgccaggggagcgacaccgctcccgccattcggtactccaaagatatctgttctatcggagcgattaagatcaagcagtgccataaagctaccagcaagttcgaaagaatgggctttatttccgttggccagaaaaagctgtatatcgaggaactcaaactgcgctaccggcaagagtatgaccctgaccagttcatgtgttacaagattaagagctctagccccctgaaatatgaaaaggtgagctctaaaaagtgcaaagaggtcgatacagggggaaaccagaagtgttccggcgacgagcacttttgcaatagatacccctgtgataccgccaaccctgaagcccattgcctcacacgcaaacacagcgctatcgccgaggtgaatatcgggggagtctggattcggccgaagtgtgtgggctatgaaatggttctggtgaagagatctgggcttaaaagcgaggacctgtccatccgcgattgccccagctgtctctgggaatgcaagaaatctcggattacgatcaagacccacggacctaaaattgtctccgctacagcctgcagccatggctcctgtaagtctgtgatgcaaaagcccagcaccttcgttgagatcccttaccccggcaactccgagattatcgggggagacatcggcgtgcacatgacagaaagagggtctccgagcaatattcatgtccggacccactgccctccccgcgattcctgtgacgtgtctgattgcatgttttgtgtgcatggaatcctgaactaccagtgccacacgctggcgagcgcccttaccattgctacaatcgtttccgccgtcctcgtggtggtctatttcctgctggctagaagcaaacgggccgtgaagtttattacctctctcctgatcgttcctttcaaatggcttacactgctctccatctgggtggtcaagaattggaaaagaaagatgagcaagctggcgcgcgccaccaacaatgctattggctgggaccaggatgtggagcgggggagaccccgcgccgctgccggccaccagaaccaagttgccagatacacgttttatggagctacaatcctgtctcttatgacctccggcctctgttgcacagaaagcgtgattgcggagtctaatatcatgcagtgtaccacctccgacagcacaacgacctgcaaagcctccgggacaattatcctgcggctgggacctatcggcagcgaatcttgtctcattctgaaggggcttcgcgatagcgagaaacagttcatctccattagaaccgtctctagcgagctgacatgccgggaaggagactccttctggacctctctctacacgcccatctgcctgagctcccgcagatgtcatctgatgggcgagtgcacaggggacaactgtcttaagtggcaggataacaaaacctctagcgaatttaccggccggacacactccgaggtgctccatgagaataagtgcttcgaacaaagcggaggcattgggtatggatgttttaacgttaatccgtcttgcctgatggtgcactcctacctgaagcctatctataaaaacgctttcaaggtctttcgctgtgtggcctggaatcacagagtgaaactcgccatcaccacacataagaaatccttcgacgtcacgctgatggctatgtctacccagcccacagattggggctccattgggcttatcctggacagcgagggaattaccggcacaaactcctactcttttatgaagtacggggttggcagcttcgccatcattgatgaacccttttccatcgagcctcggaaaggattcctcggcgaagtgcgctgcccgaccgaggagacggcggtgaaggctagcccctcttgtaaggccgcccctcagattatcgaatatcaccccgagatggacaccgtcgaatgcatcacaaatatgatggatcctatggctatttttaacagagggtccctgccccaagtgcgggacggagttaccttcgcccagagcatcgagaaaaattctgtgcaggcgctgacaaccggcgaaattaaggctagcgtcagacttgtgctcgatgactacgaggttgagtataaagtgtccgaaaacgattgtgactctacatttatcaatattaccgggtgctacagctgcgatgagggagcccgcctgtgtgtccggatcagaacgctgggcgactccatctatcatttcacagactctgaagatatgatgaacgtgatgttcaaggttaatagctccgtgaccgagtactgcaccgtcctccactttagcaaacctgtggtgaacttcgaagggaagtatgactgtggcaagtctcgcaaacccatgattatcaagggaacactgattgccatggctccgcatgatgaccgggtccactccggcgggagctccatcgttgtgaatcctaaatctaagggagtggattttcttggctggctgagcgggctctcctcttggctgggaggccccctgaaaaccgtccttacggtgctgggcttcctcattctggggctcgtttttgtgatcgtcgtgatcttcctggttagagtgggcattcgccaggcccttctgaagaagatgaaatga

SEQ ID NO: 14692 - RNA, 4005 nt, synthetic construct
  misc_feature 1..4005: note = derived and/or modified CDS sequence (opt5) from Massilia virus(127)__KT906100.1__GP
  source 1..4005: mol_type = other RNA
atgttctacgccaagtttgtgatcagcctgtgcctcgagcccggcttctccctgaaatataccattatctctaagagcgggtccggaacaattagacagatctgtctttctcacagcacggacattgataaagtcctggaactctcctctggcgagatgaacaccatcgggatcctgggaggcctttgcacatttggggaactgaagcgggaggactgtagccctgatgttttctccaattacgtggctaacatgtatggaaccgcccatccgagctcttgcaaatttgtggacattacaggcgatcgctccatcgaagtcctcaatgacgcggtgcccgatagcttcacccctggcgctcacaactgttcttcctttgagaagaagcccttctggacagacctgattcctgccaaaaatagctctggggccatcccctccgttgtgagcgtcctgccttccgtggctgagcatgattttaacctcaaggttaaagaagccaatgacaagctggaggtgattcaaagagaacttgctgccgagaaagcgcggtctggacgcctggaggatgaagccagagctaagatgaaggccctcgaggacgaactgcggaacggctggcttgctgagcgcgaagccaaagagctggccaagagcgcgctcgagaaagaaagaatcaataagctggaggtcgaacggaaactgcacgatctcgggaagaaactgcgccagtccgaggacgacgtggaaaagatgagagtgcatcacaagaaaggacggaaggagagcgatgaggaaatgaaaattgctcgcaccacggccccgtctgtctccaccacacttgctaccgttgtgttcacaagcctgctcgccaccggcctggccgctatcgagcccatcgaagacagaaacgtgaatcacattcttaaccggcctgggtctggagtctacatggcgagccccacgctgacacagaatgagtgctccctcgattatggcaaggaatgtaaagcctgggagctccaggtgtctcctctgcattacccctttttcaccagcaacgttgacaagtatacatttctcgagtccatcaccctgcttccgcctattctgctcatcaataacgagttctgcgaactgaccacaagctctggcccccttaagcaatgtcagaaagaatccagcctgattaagaaatgctgtacggaggatgctcgcgcctacttctttatcgacctcgaggggaagctgtctatcgtgcactgctccaacaatcaggtcctgagcgaagattgcaacttctgtgtgaccaaatccggaggcgtttctcataagatttttatgcctatccaggacgccttctgccaaaaagggggaagcgagtccattcccgtggtcagatactctaaagatatctgtagcattggcctctccaaggtgaaaagctgccacaagtctacatcccggtatgaaagaatggggtttatcgtcgctggaaagaagaagctgtacatcgaggaccttaaaatgcgctatcggcaggaatacgatgaggaccagttcttttgttataaggtgaataaaaccagccccctggagtacggcaaggaatctccttccaaatgcaagggcgttgggagcaacgagcagaaatgtaatggagacgaatatttctgcaacagatacccgtgtgagacaaattctcccgaagcccactgcagcctccgccggcatgcggctgtggtcgaggtgtacgttggcggggcctggattaagcctaagtgtgtgggatatgagaaagtcctggtgaagagaggcgggctgaaaaccgaagatctttccgtgcgcgagtgcacgagctgcctctgggaatgtgagaagaacaaaatcgttattaagacacacggccccaagatcgtctctgccaccgcttgcggaggccggtcctggaaaagcgtgatgcaaaagccttccacctttctggacctgccctacccggggaatagcgaaattatcggaggcgatagagggaaccatctcagcgagcgcggatccccttataatattcactctacaatccattctccccctgaggactcccgggatgcctctgactgtatctactgcagacacggcctgcttaactatcagagccactccgtggaaagcgctattctgctctctaccgtcgtggccacaatcctggcgctgacgggggttgtgctttcccgcagcaaatctgccgtccggttcctcgcttccgccgtggctgttccctttagatgggtgagcctgctggtcgtgtgggttatgaagaaatggaaggcccgggtggcgaccgccattcgcgctacaaataacgccatcggctgggataatggactcgagcaggctagagtcgaaaacgccgcccggagacaacagaccgctggccgctggcggtctctggacgcgtccacaattcttagcgtgctgtccaccgggctctgttgcacggagagcctgatcgccgagtctagcatcatgcagtgtaccacaggagaaggctccaccacatgcaaggctaccgggacggtggtcctgaaacttggacctattggctctgagagctgtctcatcctgaaggggctgagagataacgaacgccagttcatttccatcaaaacaatttctagcgagctgacctgcagagaaggcgagtccttttggacacccctgtacaccccggtttgtctttctagccggcgctgccatctgatgggagagtgcaccggcgacatgtgtctcaagtggaaatccaataagacaagctctgagttcacggggaagacccactccgaagtgatccatgaaaacaaatgcttcgagcaaagcggaggcatcgggtatatgtgttttaatgtgaacccttcttgcctgatggtccactcctacctgaagcccatttacaaaaatgccttcaaggtgtttagatgtatcgcctggaaccaccgggttcgccttggaattacaacccataaaagaaagttcgaagtgacactcatggctatgagcacccagcaggccgattggggctccatcgggctgattctggactctgagggcatcagcggaacaaattcctatagctttatgaaacacggcctcgggtcttacgcgatcattgatgagccctattccgtcgaacctcggaagggatacctgggcgaggtgcgctgcccgacggaagagaccgctatcaaggccagcccctcttgtaaagttgcccctgggcttgtggaatatcagcccgagatggacaccctggagtgcacaaccaacatgatggaccctatggctattttcaatagaggaagcctcccccaagtccggggcggctggacattttcccagtctatcgaaaagaacagccgccaggccctgaatacgggggcgattaacgcttccgtgagacatgttctggatgagtacgagttcgactataaagtgaagaccaatgattgtgactctacatttgtcaacatcaccggatgctacagctgtgatgaaggcgcccggctttgcgtgaaagtgagaacatccagcgaggccatttaccacttcaccgactctgggtataatatcaacgtcctgtttaaggttgaatccggagtgcatgatcactgcacgatcctccacttcagcaagcctgtgatttccatcgagggcaaatacgactgtgggaagaacaaaaagcccatgctgattaaaggaaccctcatcgctatggccccgcatgatgaccgcgtcgtgtctggcggcagctccacagttgtgaatcctaaggggcagggagtcgattttctgggctggctttctcggctgagctcctggttcgggggaggccccctcaagaccttcctgatggtgacagggtttctgatgaccggagttattggcggcatcgtgacaatcattcttatcagaattgtcctgcaacaggctctcgccaaaaaggtgaaatga

SEQ ID NO: 14693 - RNA, 4005 nt, synthetic construct
  misc_feature 1..4005: note = derived and/or modified CDS sequence (opt5) from Massilia virus(130)__KT906101.1__GP
  source 1..4005: mol_type = other RNA
atgttctacgccaagtttgtgatcagcctgtgcctcgagcccggcttctccctgaaatataccattatctctaagagcgggtccggaacaattagacagatctgtctttctcacagcacggacattgataaagtcctggaactctcccggggcgagatggacaccatctctatccttgggggactgtgcacatttggcgaactgaagcgcgaggattgtagccctgacgttttctccaactacgtggctaatatgtatgggaccacacatccgagctcttgcaaatttgtggatattatcggagacagatccattgaagtcctcaacgatgccgtgcccgacagcttcacccctggcgcgcacaattgttcttcctttgagaagaagcccttctggacagatctgatccctgctaaaaacagctctggcgccattccctccgttgtgagcgtcctgccttccgtggccgagcatgactttaatctcaaggttaaagaagctaacgagaagctggaagtgatccaacgggagcttgccgctgagaaagcccgctctgggagactggaagatgaggcgcgggccaagatgaaggctctcgaagacgagctgcgcaatggatggcttgccgaaagagaggctaaagagctggccaagagcgcgctcgaaaaagagcggattaacaagctggaagtcgagcgcaaactgcacgatctcggcaagaaactgagacagtccgaagacgacgtggagaagatgcgggtgcatcacaagaaacgcagaaaggagagcgatgaagagatgaaaatcgccaagaccacggctccgtctgtctccaccacacttgccaccgttgtgttcacaagcctgctcgctaccgggctggccgccatcgaacccattgaggaccggaatgtgaaccacatccttaatcgccctggatctggcgtctacatggctagccccacgctgacacagaacgaatgctccctcgattatgggaaagagtgtaaggcgtgggagctccaggtgtctcctctgcattacccctttttcaccagcaatgttgacaagtattccattctggaaagcatcacacaatcttccccgattctgcttaaaaacaataacagctgcgagctgaccacctctcctggaacacagaagcagtgtcagaaagaatccagcacgatcaagaaatactgcaccgatgacgccagagcttactttttcatcgatctcgagggcaagctgtccattgtgcactgtacaaacaattatatcctttctgaggactgcaacttctgcgtcagcaagctgggcgaagtggggcataaaatttttatgcccatccaagatgccttctgtcagaagggaggctccgagtctattcctatcgttcggtacagcaaagacatctgctccattgggctctttaagatcaaaaattgtcacaagagcacctctagatatgaacgcatgggattcattgtggccggcaagaaaaagctgtacatcgaggaactgaaaatgcggtatagacaggagtacgatgaggaccagtttttctgctataaggtcaaaaagacaagccccctcgaatacgctaaagtgtccccctctaagtgtaagggggtcggatccaacgagcaaaaatgcaatggcgacgaatacttttgtaaccgctatccttgcgagaccaatagcccggaagcccactgttctctgcggagacatgcggctgtggttgaggtgtacgtcggcggggcctggattaagcccaaatgcgtgggatatgagaaggttcttgtgaaacgcggcgggctgaagacggaagatctcagcgtccgggagtgtacatcctgcctgtgggaatgcgagaagaacaaaatcgtgattaagacccacggacctaaaatcgtgagcgccaccgcttgtggccatgggtcttgcaagtccgttatgcagaaacccagcacattcctggaccttccttaccccggcaattccgaaatcattggaggcgatagagggaaccacctctctgagcgcggaagcccgtataatatccattccaccattcactgtcctcccgaggactctcgggatgccagcgactgcatctactgtagacacggcctgctgaactatcagtcccattctgtcgctagcgccattctcctgtccacagtggtggcgacgatccttgccctgaccggggtcgtgctcagccgctctaagtccgctgttcggtttctggccagcgctgtggccgtccctttcagatgggtgtctctgcttgttgtgtgggtcatgaagaaatggaaggcgcgggtgacaaccgccatccgcgctacaaataacgccattggatgggataatggcctcgaacaagttagagtggagaacgctgcccggagacagcagcccgccgtccgctggcggtccctggacgctagcaccatcctgtctattctcgggacgggcctgtgctgtaccgaatcccttatcgcggagagctccattatgcagtgcacaaccgaggaaggaagcacaacctgtaaagccacgggcacagtggtgctgaagctcgggcctatcggatctgagagctgcctgatcctgaaaggccttagagataacgaaaagcaatttatttccatcaagaccatttctagcgagctcacatgtcgcgaaggggagtccttctggacctctctgtacacccccgtctgcctgagctccagacggtgccacctcatgggagagtgtacaggcgacatctgcctgaaatggaagtctaataaaacgagctccgaatttaccgggaagacacatagcgaggttattcacgaaaacaaatgtttcgagcagtctggcggaatcggctacatgtgcttcaatgtgaacccgtcctgtcttatggtgcacagctatctgaagcctatctacaaaaatgcttttaaggtcttccgctgcattgcctggaaccatagagtgcggctcgggatcaccacacacaagcgcaaatttgaaattaccctgatggccatgtctacgcagcagacagattggggatccatcggcctgattcttgacagcgagggggttgctggaaccaatgcctattccttcatgaagcatggcctcgggtcttttgcgatcattgatgagccctacagcgtggaacccagaaaaggctatctgggagaggtcaagggccctcgggaagagaccgctatcaaagcctccccgagctgtcaagtggcccccgggctggttgaataccagcctgtgatggacacagtcgagtgcaccacaaacatgatggaccccctcgctatcttcaatcgcggatctctgcctcaggtgagaggcgggtggacgttttcccagagcattgagaagaactctcttcaagccctgaataccggagcgatccacgctagcgttcggcatgtgctcgatgaatatgagttcgaatacaaggtcaaatccaacgactgtgattctacatttgtgaatattaccggctgctacagctgtgacgagggcgcccgcctgtgcgtgaaggtcagaacatcctctgaggccatctatcacttcaccgatagcgggtacaacattaatgttctgtttaaagtggactccggagtgcacgatcattgcacgatccttcacttcagcaagcccgtcatctctattgaaggcaaatatgactgtgggaagaacaagaaacctatgctgatcaagggaaccctcattgctatggctccccatgatgaccgggtggtttccggcgggagctccacagtggtcaacccgaaaggacagggcgtggattttctgggctggctctctgggctgagctcctggttcggaggcgggcctcttaagaccttcctgatggttacaggatttctcatgaccggcgtgatctctgggattgtcacaatcatcctgattagaatcgtgctgcagcaggcccttgccaaaaaggtcaagtga

SEQ ID NO: 14694 - RNA, 3999 nt, synthetic construct
  misc_feature 1..3999: note = derived and/or modified CDS sequence (opt5) from Massilia virus(W)__EU725772.1__GP
  source 1..3999: mol_type = other RNA
atgttctacgccaagtttgtgatcattctgtgcctcgtccagggcttcagcctgaaatataccatcatttccaagtctgggagcggaacaatcagacaaatttgtctttcccactctacggacatcgataaagttctggagctcagctccggcgaaatggacaccatcaacattcaagggggactgtgcacatttggcgagcttaagcgggaagattgttctcccgacgtgttcagcaattacatcgctaacatgtatgggaccacacatccttccagctgccgctttctggatattatcggagacagatctattgaggtgatgaatgatgcctccccggacagcttcacccccggcgcgcacaactgttcttcctttgaaaaagctcctttctggagcgatctcatccccgccaagaatggctctgggccttcccccagcgtcgtgtccgttctgccttctgccacagagagcgacttttccctgaaggtgaaaaaggctaacgagcggctcgaagtcattcagcgcgagctggccgctgaaaaagccagaagcggacggcttgaggatgaggcgcgcaccaagatgagagccctggaagacgagctccggaatggctggctggctgaacgcgaggccaaagaacttgctaagtctgatctggagaaggagagagtgaacaaactcgaagttgagcggaagctgcatgacctgaataaaaagctccgccagtccgaagacgaggccgaaagactgcgggagtaccacaacaaacgcagaaaggagagcgatgagaaaatgaagatgacgaagaccgtggcgccgaatgtctctacaacccttgccacagtggtgctgaccagcctcctggctacggggcttgccgctatcgagcccatcgaagaccggaacacaaatcatattctgaacagacctggaaccggcgtctatatggcctcccccacactcaccgagaatgattgctctctggactacgggaaagaatgtaaggcctgggagctgcaggttagccctctccactatcccttctttacctccaacgtggataaatacagcctgcttgagtctatcacacaggcttccccgattctgatcaagaacaataacagctgcgaactcacgacctctcctggatcccagaaacagtgtcaaaaggagagctccacaattaagaaatactgcaccgacgatgcgcgcgcctatttctttgtggacctggaaggcaatctttctatcgtccactgtagcaacaataacatcctgtccgaggattgcaatttctgcatttctaagagcggcgtgacagggcagaaaatcttcatgcccattcaggacgctttttgtcagcggggaggctccgagagcctccctgttatcagatactctaaggatatttgctccatcgggctgttcaaaatcaagagctgtcataagtctacctcccgctatgaacggatgggatttattgtggtcggccgcaaaaagctgtacctcgaggaactgaaaatgagatatcggcaagagtacgacgaagaccagttctattgctacaaggccaaaacgacaagccagcttcaataccagaaggtgtctcccagcaagtgtaaaggggttggatccaaggatcagaaatgcaacggcgacgagtatttttgtaatagattcccctgcgagaccaacaatcctgatgcccactgtagcctgcgccggcatgctgccgtggtcgaagtgaacgtcggcggggcgtgggtgaagccgaaatgcgttggatacgagaaggtgctcgtcaaaagaggcgggctgaagaccgaagacctgtctgtgcgcgagtgtacatcctgcctttgggaatgcgagaagaataaaatcgttattaagacccacggacccaaaatcgtgagcgctacagcctgttcccacggctcttgcaagagcgtcatgcagaaaccttccacgtttctcgatctgccctatcctgggaactctgagattatcggcggagacattggcatccatatgagcgaacgggggtccccctctaatatccacattaccatccattgtccgcctaaggatagctgcgacgtgtccgattgtattttctgcagacacggaatcctgaactaccaatgtcatagcgtggcctctgctattctcctgtccacagttgtcgccaccatccttgctctgacaggcgtgatcattagccggtctaagtttgccgtgcgcttcctcgcgtccgccgtcgctatcccctttagatgggtgagcctgctggttgtgtgggtcatgaaaaagtggaaatctcggattgccaccgctatcagagccacgaacaatgcgattgggtgggacaacggacttgaacaggtgcgcgttgaaaatgccgctcggagacctcagcccgccgtgcgctatgctttctacgccaccacaatcctctccatcctgggcagcgggctgtgctgtaccgagtccctcattgccgaaagctctatcatgcagtgcacaaccgaggatagctccacgacatgtaaggctaccggcacagtcgtgctgaaacttggacctattggctctgagagctgcctgatcctcaaggggctgagagacaacgaaaagcaatttatttccatcaaaaccatctctagcgagctgacctgccgggaaggagagtccttctggacatctctttatacgcccgtttgtctcagctcccgcagatgccacctgatgggcgagtgtaccggggatatttgcctgaagtggaaaagcaataagacatcttccgagttcaccggaaaagcgcacagcgaagtgatccatgaaaacaagtgttttgagcagtctggcgggattggctacggatgcttcaatgtcaacccgtcctgtctcatggtgcacagctacctgaagcctatctataaaaatgcctttcgggtgttccgctgcattgcttggaaccatagagtccggcttggcgttacaacccacaagcgcaaatttgaaatcacgctgatggccatgtccacacagcagaccgactgggggtctattggactcatcctggacagcgagggcatcgaggggaccaatgcctactccttcatgaagcacggactgggcagctttgctattgtggatgaaccctattctgtggagcccagaaaagggtaccttggcgaagtccggtgtcctacagaggaaaccgccatcaaggcgtccccgagctgcaaagtggctcccggactcattgagtatcaacctgagatggacacagttgaatgtacgaccaacatgatggatcccatggccatcttcaatcgcggctctctgcctcaggtgagagaggggaagacatttacccagagcattgaaaagaactccgtccaggccctgacaaccggagagatccatgcttctgtgcggctcgttctggacgaatacgagatcgagtataaagtgacgagcaatgattgcgactccaccttcgtcaacattacaggctgctactcttgtgatgaaggggccagactttgcgtgaaggttaaaagctccagcgaggcgatctaccactttaccgactcttccttcagcgtgaacgtcctgtttaaggtgacaccctccgtgcatgattattgtaccattctccacttctctcgccctgtcatcagcattgaaggaaaatacgactgcggcaagaataagaaacccatgctgatcaagggcacactgatcgctatggccccgcatgatgaccgggttattaacgggggatcctctaccgtggtgaatcctaaaggccacggggtcgatttccttggatggctgagcggcctctccagctggtttgggggacccctgaagacgttcctcatggtgatgggctttctgatgatcggcgttattatcgtgattgtcacaatcattcttatcagaatcgggctgcaacaggccctcgctaaaaagttcaagtga

SEQ ID NO: 14695 - RNA, 3996 nt, synthetic construct
  misc_feature 1..3996: note = derived and/or modified CDS sequence (opt5) from Punique virus(PI-B4-2008)__JF920134.1__GP
  source 1..3996: mol_type = other RNA
atgttctacgccaagtttgtgatcattctgtgcctcgtccagggcttcagcctgaaatataccatcatttccaaacttgggtctggaacaacgagacaagtttgtctgagccactccaccgacctcgataaggtgctggagatctctaacatggaaatggacgctattaatcttctgggcgggttttgcacactcggagagctgcggcgcgaagattgtagccccaacgtgttctccaattacgtcgtgaacgttcatggcaccatccactctagcaattgcaagtttgtggacatcgtcggggatagatccattgaggtgctgaacgacgccacacctgatagcttcaccccgggagcgcataattgttcttcctttgaaaaaccccctttctggacagacctcgttcccaagaagaacgataccgaccctagcccctctctgctttccgtgctgcctgctgccgccgagctcgattttaatctgaaacttaaggaggctaacgacaaagtcgaagccatccagcgggagctggtggctgaaaaggcccgcagcggcagaattgaggatgaggcgcggacgaaaatgcgcgaactcgaggacgaactgagacggggctggatcgccgagcgcgaagctaaggagctggcccacaagaatctcgaggaagagagagtgtctaaactggaaattgagcggcgcatgcatgaccttgataagaaactgagacagtccgaaaacgacgctgatcggctccgcgagcagtataataagaaaagaaagagcgaggaagaggtcaaaaccccgaaggcctccacactgaacgcgaccacaacccttgccacggttgtgctgacatctctcctggctaccgggctggccgctatcgaacaaattgaggaacggaatacaaaccacatcctcaacagacccggaaccggcgtgtacatggccagccctaccctgacacagacggagtgctcccttgggtatggaaaggagtgtaaaagctgggaactgcaggtctctcccctccactaccctttctttacctccaatgtggacaagtatagcatcctggagtctattacacaggaacccacccttctgatcaaaaacaataacagctgcgagctcacaacctccccgggctctcaaaagcagtgtcagaaagagagctccacgattaagaagtactgcacagatgacgcccgcgcttacttctttatcgatctgggaggaaatctgagcattgttcattgttctaacaatttcgtgctctccgaagactgcaacttctgcatcagcaaatctggcggcgtcgggcagaagatctttatgcctattcaagatgcgttctgtcagcggggaggctccgagagccctcccgtggttagatattccaaagacctgtgctctatcgggctttttaagattaaaagctgtcacaagtccacctctcgctacgaacggatgggattcatcgtggccggccagaagaaactgtatctcgaggaactgaagatgagataccgccaagagtatgatgaggaccagtttttctgctacaaagtcaagagcaatagccccctgcagtatgaaaaagtgagcccctctaagtgtaagggggtcggatcccaggaccaaaaatgcaacggcgatgagtacttttgtaatcggtacccttgcgacaccaacaatccggatgctcattgtagccttagacgccacgccgccgtggttgaagtgaacgtcggcggggtgtggattaagcccaaatgcgttggatatgagaaggtgctcgtcaaacggggcgggctgaagacagaagacctgtctgtgagagagtgtacctcctgcctctgggagtgcgaacgcaataaagtggttgtcaagacacacggacctaagatcgtgagcgctacggcctgttctcatggcagctgcaaatccgtgatgcagaagcccagcaccttcctggagatcccttaccccgggaactctgaaattatcggcggagatattggcatccacatgtccgagcgggggagcccgtccaacattcatgtcgtggttcactgtaaacctaaggactcttgcgatatcagcgactgtattttctgcaaacatggaatccttaattatcagtgtcactccgtggcgtctgctgtcctgctcagcacaatgatcgccgcctgcctggctctggtgggcgttattgtgtccagatctaagcacgccgtcaagttccttgctagcgtggttgccatcccctttaaatgggtgtccctcctgaccgtctgggtggtgaagaactggaaactgcggattacacgcgtcatcagagcgaccaatgatgccattgggtgggaaaacaatctcgagcaggttcgggtggagaacgctgccagacgccctcaacccgctgtgcggtacgccttctatggaacgaccatcctgagcatcctttctacaggcctgtgttgctccgaaagcctcattgcggagtcttccatcatgcagtgtaccacagaagacagctctaccgtctgcaaggccacggggacagtggttctgaaactgggccctattggatccgagagctgccttatcctcaagggcctgagagataatgagaagcagtttatttccatcaaaaccatcagctctgaactgacatgtcgcgagggggaatccttctggacctccctctacacccccgtgtgcctgtctagcagacggtgtcatcttatgggagagtgcacaggcgacatttgtctgaagtggaaaacgaacaagacctccgctgaatttacagggaaaacccactctgaggtcatccatgagaataagtgctttgaacagagcggaggcatggggtatggctgtttcaacgtgaatccgtcctgcctcatggttcactcttacctgaagcctatttacaaaaacgcctttaaggtgttccgctgtgtcgcttggaatcacagagtgcggctgggaatcacaacccataaacgcaactttgagattacgcttatggccatgagcacacaacagaccgattggggctccatcgggctcatcctggacagcgaaggaattaccggcacaaattcttattccttcatgaagcacgggctggggagctttgccatcattgacgagccctacgttaccgaacccagaaaaggctatctcggggaggtgcggtgccctacagaggaaacggctgtcaaggcgtctccgtcctgtaaagtggcccccggcctgatcgagtaccagcctgaaatggatgtggtcgagtgcaccacaaacatgatggaccccatggctattttcaaccgcggaagccttcctcaggttagagatggcaagacctttacacaatccatcgaaaagtctagcgtgcaggccctgaccacgggggagattcatgcctccgtgcggctcgtcctggacgagtatgaagtggagtacaaagttgtgaataacgattgcgacagcaccttcgtcaatatcacaggatgttattcttgcgatgaaggcgctcgcctgtgtgtgaaggttaaagcctccagcgacgtgatctaccactttaccgattctgacaacagcatgaatgtccttttcaaggtgtcctctaacattcaggattactgcatcgtcctgcattttagcaaacccgtggttaatgtggaggggaagtatgactgtggaagatccaagaaacctatgctcattaagggcacactgatcgcgatggctccccacgatgaccgggtcaccaacggcgggtctagcattatcatcaatccgaaaggaggcggggtggacttcctcggatggctgtccggccttagctcttggttcgggggacctctgaagacatttctcattatcgccggcttcctgattgttggcatcattatcgtgatcattatcattatcctggccagacttgggattcaacaggctctggccaaaaagctcaagtga

SEQ ID NO: 14696 - RNA, 4020 nt, synthetic construct
  misc_feature 1..4020: note = derived and/or modified CDS sequence (opt5) from TOSV(9028)__KU904264.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaggcctgggacaatgtcacagagtccattggcctgacctctgggacatgcaaggttggaagcctcgaaaaccgcgattgtagaaaagacatcatgtccaattatgtggcggaggtgcacagcgatctgcatggcctgggggctatgatgcacaactacggagacgataagcgggtcgaaatcctcaatgacgtgattcccgatgagctgaaccctggccatcacaattgctctgaccttgatcgcaaaccgttctggaccgagtttatcaacgttgccaagcccctgtccgaaattgtgcctatgagcgtcattccccctcccgtggttaagctccaacctccggccgagccctcttccaaaaagcatgtgcctttcgacgtcctgcttagcgaagctgagaaagagctgaatcagacaaagatcagactcgaagatgagcggaaatctaacgccgaagagaccgctaaggaacgcgccagaatgaaggagatcgaggacgaactgcggcgcgagtgggaactggagagaaaacggaaggatgcgatggccgacgacctcgctaaagaaacggcccgcagacgggagattgagcgcaaggctcacgaactggataaaatgcttaagaaaaaggagagagaatccctgatcgccaaggagaaagcggacgaagatatgcggagccacgtgcataagcccaataccacaagagcccctgctcccaccatcattacaaccctcctgatggcctccgctgcccttgccggcccgctggagaaccgcgagacgaatcacctcctgaaccggcctgggaatggagcttatacactgtctgactttgcggaaagcacctgtacactcgcctacggctccgagtgcaaaagctgggaacatctgcttaacgaggagctgttcccctttttccactctaacctcgataagtattccatgctggaagctgccaccgagaccgtgcctatccttaataaaagctctgccgtctgtacaattagcccctccacgcactctagcaacgcttgcgggagagaagcctccgttatccgcaagaagtgttacagcaatatgtctgcgtttttctacattaacctggctggacagatcaccgtgatcaaatgcgagacaaatcatgtgctctccagcgactgtggcaactgcatttctaagtccctgagcgggcaaaaagtctatacccccgtgcaggatgtgttttgccagaagggatggacacagtccatcccttctacccggtacagcaaagacatttgttccatcggcctgcacacggtgaaggaatgcaagattggcacaacctctttcgagagagtcgggtttatcgtggttaaaggacgcaagatgtatatcgagcaaatgaaaatgcggagcagacaggaatactccgaggatcagttcctctgttataagagcgaatctggctccgggagctctgtgaaactgaagaagttcaaagtcgagtcctgcaagggagtgaccacaagctctgccagcaaatgttccggcgacgaatacttttgcagccgctatccgtgtgagaccgccaatgtcgaggctcattgcattcttcggagacactctgccatcgtggaagttaacgtgaatggggtctgggtggttccccgctgtattggatacgaggaagtgctggtcaagcggacatccctcaaagtggaggatacgaccggcagagaatgcgacagctgtctgtgggagtgcggcaagaacaaactgatcgtgaagacacatgggcctaaggttgtctacgctaccgcctgctcccacggatcttgtaaaagcgtgatgcagaagcccgcgacattcgtgtatcttccttaccccggcaattccgagattgtcgggggagacatcggcattcacatgaccgaagagtctagcccgtccaacatccatctcgtggcccactgccctgctcgggattcttgtgacgttagcgattgcctgttttgtgtgcatgggctgctcaattatcaatgccacacgctgttctccgcccttctgatcagcaccacagtcatgtctattctcaccctgctgcttctcctggtgaaaggcgctaaggacctggttaaaaagctctttcactggctgatcacacccctttgttggctgtccgtgttctgctgttgggtcgttaagagctggaaacgcagagttggatctgccatttcccggaccaacgatacgatcggctggagagaaaatcgccggcatgcgcaggacattgagagagcccagtacacagggggagctcctggcgccaagtatagcttttacggggtgatgatcctcggactgctgtcttccgctcaaagctgctccgagagcgtcatcgccgattctaaaattatgcagtgtaccacaagcggctcctctaccctttgcaaggccagcgggaccgtgatcatgcgcctcggccccattggatccgaatcttgcctgatcctgaaaggcctcaaggacagcgagaagcagttcatttccatcaaaacaatctctagcgaactgacgtgtagagagggggaatccttttggaccacactttatacccctatttgcctgagctctcggcgctgtcacctcatgggagagtgcgtgtccgatagatgtctgaagtggaaaacaaaccagaccagcgctgagctgacgggcaaggcgcatggggacgtcatgcacgaaaaccggtgcttcgagcaatctggaggcatcgggtacggctgttttaatgttaacccctcctgcctttacgtgcatagctatctcaaatccgtgtaccgcaatggattcaaggtctttagatgtgtggcctggaaccaccggattcgcctggaagttacaacccactctagaaagttcccgatggtgctgatggctatgagcacccagcctacagattggggctccatcgggctcattctggacagcgagggaatcaccggcacaaattcttattccttcatgaaacatgggagcggatcttttgccatcattgatgacccctacagccccgaacctcggaagggcttccttggggaggtccgctgcccgacggaggaaaccgccatgagagcttccccctcttgtaaaatggcccctaacctgatcgagtatcagcccgaaatggacacagcggagtgcaccacaaatatgattgatcctatggctatctttaaccggggcagcctcccccaggtgagagacggaatgaccttcacgcaatccattgaaaagaataccgttcaggccctgacaaccggcgaggtgaaagcctctatccgcctgattcttgatgactacgatgtcgtgtatcagaacagccagtccgactgcagcgctacatttaagaatctgaccgggtgttactcttgcgatgagggatcccggctctgttaccaagttaaagccgaaggcgagacaatcttccactttatcaacgaagaggagagcattaatgtgatcaacaaggtctcccctggggtgtctgactattgcaccgtgctgcatttcagcagacccgtcatttccatcgaaggaacgtacgattgtggcctctctaagcgcccgatggttattaaaggcacactgatcgcgaccgctcctcacgacgatcggaagcatgaagggggaagctcccttgtggtgaatcccaaaggcgggagcgtcgactttttcggatggctgtctggcctcacctcctggcttgggggacctctgaagacatttctgaccatcctgggcttcctcgccgtgggcctgctcctggttgtgattatcattatcattatcagaacggggatgcagcaggcccttaaaaagaagatcaaatga

SEQ ID NO: 14697 - RNA, 4020 nt, synthetic construct
  misc_feature 1..4020: note = derived and/or modified CDS sequence (opt5) from TOSV(A189)__KP694241.1__GP
  source 1..4020: mol_type = other RNA
atgttcatcgccaagctgctcctgattagctgccttgtgcagcaggcttacctgaaatataccatcatttccgagatcggcaacgggacaagaacgtctagctgttactcctctcggaccagcctcggatccctgcttgaagcctgggataatattacagagtctatcggcctgaccagcgggacatgcaaggtcggatccctcgaaaaccgcgattgtaaaagagacatcatgagcaattatgttgcggaggtgcactctaacctgcatggcctgggggctatgatgcacaattacggagatgacaagcgggtggaagtcctcaacgatgtgattcccgacgagctgaatcctggccgccataactgctccgatcttgacagaaaaccgttttggaccgagttcatcaatgttgcccggcccacaaacaagatggcccctatgagcgtgattccccctcccatcgtcaagcctattccggtggctgaacccaccatcgagaaaacgattccttttgataagctgctctctgaagccgagaaagagctgaatcagaccaagatccgccttgaagctgagagacggtccaacgccgaagaggcggccaaagaacgcgctagaatgcgggagatcgaggacaagctgcgcaaggattgggaactcgagagagaacggaaagacgccgttgctgatgacctggccaaggagattgcgcgcagacgggaaatcgagagaaaagcccacgagctggacaagatgctcaaaaagaaagaacgcgaggatctggtggctcgggaaagagtcagcgaggacatgcgcaatcatgtgcggagacccaacacaaccattgcccctgctcccacaatcattaccacgcttctgatggcctctgccgtgatggctggcccgctcgaaaatcgcgagacaaaccatctgcttaaccggcctgggaatggagcgtataccctgtccgatttcgccgagagcacatgtaccctcgcttacggctccgaatgcaagtcttgggagcaccagctggacgaactgagctttcccttctttcactccaacctcgataagtatagcatgctggaggccgccaccgagacagtccctatccttaataaatcttccgctgtttgtacgatctaccacccccgcattcatagaatggcctgcgggcgggaagcgagcctgatcaagaaaaagtgtggatctaacatgagcgctttcttttacgtgaatctcgccggccagattaccgtggtcaaatgcgacacaaaccacgtgctgtccaatgattgtgggaactgcatctctaagacccttagcggacaaaagatttatacacccgttcaggacatgttctgccagaaaggctggaccgagtccatccctaatacgagatacagcaaggatctgtgttctatcggcctccacacagtgaaagaatgcaagaccgggaccacaaactttgagcgcgtcggattcattgtggttaaaggccggaagatgtatatcgaacagatgaagatgagatcccggcaagagtttagcgaggaccagttcctgtgttacaaatctgaatccagctccgggtctagcgtgaagctgaaaaaggtcaaagtggagtcctgcaagggagtcaccacatctagcgcctccaagtgtagcggcgatgaatatttctgctctcgctacccgtgtgagacggctaatgtggaagcccattgcattctcagacggcactccgctgttatcgaggtgaacgtcaatggggtgtgggttgtgcccagatgtattggatatgaggaagtcctggtgcgccggaccagccttaaagtggaggacacatcttccagagaatgcgacacctgtctgtgggagtgcggcaagaacaaactcatcgttaagacacatggccctaaaattgtctacgccaccgcgtgcagccacgggtcttgtaagagcgtgatgcagaaacccgccacgtttgtgtacctgccttatcccggaaattccgaaatcgtcggcggggatatcggagtgcatatgaccgaggagagctctccgtccaacattcacatggttgctcactgccctgccaaggacagctgtgaagtgtcctcttgcctgttctgtgtccatggccttctcaactaccagtgccacacactgtttagcgctctgctcatctccaccacagtgatgtctattctgacccttctgctcctgctgatgcgcggggccaaggatcttgttaaaagactcttctattggctgatcacgcccctgtgttggctcagcgtgttttgctcctggatgattaagtcttggaaaaagcgggtcggcagcgcgatctcccgcacaaatgacaccatcggatggagagataaccggcgctacggccaagacgtggagagagcccagtatacagggggagctcctggcgccaaatacagcttctatggggttatgattctgggacttctgggcaatgtgcattcttgttccgaaagcgtcctcgctgattctaagatcatgcagtgcaccacctccgggagctctacactgtgtaaggcctccggcacggtgattatgaaactgggacccatcggcagcgagtcctgccttattctcaaggggctgaaagacagcgagaagcaatttatctctatcaaaaccattagctccgaactgacatgccgggagggagaatctttctggaccacactctacacccctgtgtgtctgagctcccgcagatgccaccttatgggcgagtgtgtctctgatcggtgcctgaagtggaagacgaacgaaacaagcgccgagtttaccgggaaagctcacggagaggttatgcatgaaaatcgctgtttcgagcagtccggcgggatcggctacggatgctttaacgtgaatccctcttgtctctatgtgcacagctacctgaagtccgtctataaaaacggcttcaagatttttagatgcgtggcgtggaatcatcggatcagactggaagttaccacacacagccgcaaattcccgatggtgcttatggccatgtctacccagcctacagactgggggtccattggactcatcctggatagcgagggcatcacggggaccaacgcttactctttcatgaagcatggatccggcagctttgccattatcgacgatccctattcccccgaacctcggaaggggttcctgggcgaggtcagatgtccgacagaggaaaccgccattcgcgcttctcccagctgcaaaatggcccctaatctcatcgagtaccagcccgaaatggacacagcggagtgtaccacgaacatgattgaccctatggctatctttaatcggggatccctgccccaagtgagagatggcatgaccttcacacagagcattgaaaagaacaccgttcaggcccttacaaccggggaggtgcgcgcctctatccggctgacactcgacgattatgacgtcgtgtaccaaaattcccaaagcgattgctctgctacctttaaaaacctgacgggatgctacagctgtgacgagggctccagaatgtgctatcaggttaaggccgaaggggagacaatcttccactttgtgaacgaagatgagtctattaatgtcatcaacaaagtgagccctgacgtgtccgattactgtaccgtcctgcacttctctcgccccgttattagcatcgagggacggtatgactgcggcctttccaagagaccgatggtgattaaaggcaccctgatcgcgacagctcctcatgatgaccggaagcacgaagggggaagctctctcgtggtcaatcccaagggcgggaccgtggactttttcggatgggtttccggcctgacgagctggctcgggggacctctgaaaacatttcttaccatcctgggcttcctcgccctgggcctgcttctggtggtcattatcattatcattgcccgcacaggggtgcagcaggctctcaagaaaaagaacaaatga

SEQ ID NO: 14698 - RNA, 4020 nt, synthetic construct
  misc_feature 1..4020: note = derived and/or modified CDS sequence (opt5) from TOSV(AR)__EF656362.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaggcctgggacaatgtcacagagtccattggcctgacctctgggacatgcaaggttggaagcctcgaaaaccgcgattgtagaaaagacatcatgtccaattatgtggcggaggtgcacagcaacctgcatggcctgggggctatgatgcacaattacggagatgacaagcgggtcgaaatcctcaacgatgtgattcccgacgagctgaatcctggccatcacaactgctctgatcttgaccgcaaaccgttctggaccgagtttatcaatgttgccaagccctccagcgaaattgtgcctatgtctgtcattccccctcccgtggttaagctgcaacctccggccgagccctccagcaaaaagcatgtgcctttcgatgtcctcctgtctgaagctgagaaagagcttaaccagacaaagatcagactggaagacgagcggaaatccaatgccgaagagaccgctaaggaacgcgccagaatgaaggagatcgaggatgaactccggcgcgagtgggaactggagagaaaacggaaggacgcgatggccgatgacctggctaaagaaacggcccgcagacgggagattgagcgcaaggctcacgaactcgacagaatgctgaaaaagaaagagcgggaaagccttatcgccaaggagaaggcggatgaagacatgagatcccacgtgcataaacccaacaccacacgcgcccctgctcccaccatcattacaaccctgctcatggcctctgctgccctggccggcccgcttgagaatcgggagacgaaccacctcctcaatagacctgggaacggagcttatacactgagcgattttgcggaatccacctgtacactggcctacggcagcgagtgcaagtcttgggaacatctcctgaacgaggagcttttcccctttttccactccaatctggacaaatatagcatgctcgaagctgccaccgagaccgtgcctatcctgaacaagtctagcgccgtctgtacaatttccccctctacgcacagctccaatgcttgcgggcgcgaagccagcgttatccggaaaaagtgttactctaacatgtccgcgtttttctacattaatcttgctggacagatcaccgtggtgaagtgcgagacaaaccatgtcctgagctctgattgtggcaattgcatctccaaaagcctctccgggcaaaaggtgtatacccccgttcaggacgtgttttgccagaaaggatggacacagtctattcctagcaccagatactccaaggatatctgttctattggcctgcacacggtcaaagaatgcaagatcggcacaaccagcttcgagcgcgtggggtttattgttgtgaagggacggaaaatgtatatcgagcaaatgaagatgagatcccgccaggaatacagcgaggaccagttcctgtgttataaatctgaatccggcagcgggtcttccgtcaagctcaaaaagttcaaggtggagagctgcaaaggagtcaccacatctagcgcctccaagtgtagcggcgatgaatacttttgcaaccggtatccgtgtgagaccgccaatgtggaggctcattgcatcctgagacgccactctgccattgttgaagtgaacgtcaatggggtgtgggttgtgccccggtgtatcggatacgaggaagtccttgtgaaaagaacatccctgaaggtggaggacacgaccggccgggaatgcgatagctgtctctgggagtgcggcaaagacaagctgattgttaaaacacatgggcctaaggtcgtgtacgctaccgcctgctcccacggatcttgtaagagcgtgatgcagaaacccgcgacattcgtctatctgccttaccccggcaactccgagatcgttgggggagacattggcatccacatgaccgaagagtctagcccgtccaatattcatcttgtggcccactgccctgctaaggattcttgtgacgtgagcgattgcctcttttgtgtccatgggctgctgaactatcaatgccacacgctgttctccgccctgcttatcagcaccacagtgatgtctatcctgaccctcctgctgcttctcgttaaaggcgctaaggacctggtgaaaaagctgttttactggctcattacacccctgtgttggctttccgtcttctgctgttgggtggttaagagctggaaacgcagagtgggatctgccatctcccggaccaatgatacgattggctggagagaaaaccgccggcacgcgcaggacatcgagagagcccagtatacagggggagctcctggcgccaagtacagcttttatggggtcatgattctgggactcctgtcttccgctcaaagctgctccgagagcgtgatcgccgattctaaaatcatgcagtgtaccacaagcggctcctctaccctgtgcaaggccagcgggaccgtgattatgcgccttggccccatcggatccgaatcttgcctcattctgaaaggcctgaaggacagcgagaagcagttcatctccattaaaacaatctctagcgaactcacgtgtagagagggggaatccttttggaccacactgtacacccctatctgccttagctctcggcgctgtcatctgatgggagagtgcgtctccgatagatgtctcaagtggaaaacaaaccagaccagcgctgagttcacgggcaaggcgcacggggacgttatgcatgaaaatcggtgctttgagcaatctggaggcattgggtacggctgtttcaacgtgaatccctcctgcctgtatgtgcacagctacctgaaatccgtctatcgcaacggatttaaggtgttcagatgtgttgcctggatccatcggattcgccttgaagtgacaacccactctagaaagttcccgatggtcctcatggctatgagcacccagcctacagattggggctccatcgggctgattctggacagcgagggaatcaccggcacaaattcttactcctttatgaaacacgggagcggatctttcgccatcattgatgacccctatagccccgaacctcggaagggctttctcggggaggtgcgctgcccgacggaggaaaccgccatgagagcttccccctcttgtaaaatggcccctaacctgatcgagtaccagcccgaaatggacacagcggagtgcaccacaaatatgattgatcctatggctatcttcaaccggggcagccttccccaggttagagacggaatgacctttacgcaatccattgaaaagaataccgtgcaggccctgacaaccggcgaggtcaaagcctctatccgcctcacactggatgactatgatgtggtttaccagaacagccagtccgactgcagcgctaccttcaagaatctgacagggtgttactcttgcgatgagggatcccggctttgttatcaagtgaaagccgaaggcgagaccgtctttcatttcattaacgaagaggagagcatcaatgtgatcaacaaggtgtcccctggggtctctgactactgcacggttctgcactttagcagacccgtgatttccatcgaaggaacatatgattgtggcctctctaagcgcccgatggtgattaaaggcaccctgatcgcgaccgctcctcatgacgatcggaagcacgaagggggaagctccctcgtcgtgaatcccaaaggcgggagcgttgacttctttggatgggtgtctggcctgacatcctggcttgggggacctctgaagaccttcctcacgattctgggctttctggccgtcggccttctgctcgtggttatcatcattatcattatcagaacagggatgcagcaggccctgaaaaagaagattaaatga

SEQ ID NO: 14699 - RNA, 4020 nt, synthetic construct
  misc_feature 1..4020: note = derived and/or modified CDS sequence (opt5) from TOSV(EsPhGR40)__FJ153283.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggataatgtcacagagtccattggcctgacctctgggacatgcaaggttggaagcctcgaaaaccgcgattgtggcaaagacatcatgtccaattatgtggcggaggtgcacagcaacctgcatgggctgggagctatgatgcacaattacggcgatgacaagagagtcgaaatcctcaacgatgtgattcccgacgagctgaatcctggccatcacaactgctctgatcttgaccggaaaccgttctggaccgagtttatcaatgttgccaagcccctgtccgaaattgcccctatgagcgtgattccccctcccgtcgtgaagctccagcctccggctgagccctcttccaaaaagcatgttcctttcgatgtgctgcttagcgaagccgagaaagagctgaaccagacaaagatccgcctcgaagacgagagaaaatctaatgctgaagagaccgcccgggaacgcgcgagaatgcgggatatcgaggaggaactgcgcaaggagtgggaactggagagaaagcggaaagacgccatggctgatgacctcgccaaggaaacggctaaacgcagagagattgagcggaaggcccacgaactggaccgcatgcttaaaaagaaagagagagaatccctgatcgcgaaggagaaggaagatgagaacatgcggagcagagtccacaaaccctccaccacacgcgcccctgctcccaccatcattacaaccctcctgatggcctctacggctcttgccgggccgctggagaatcgggaaacaaaccatctcctgaatagacctggaaacggcgcctataccctgagcgactttgctgagtccacatgtaccctcgcgtacgggagcgaatgcaagtcttgggagcatctgcttaacgaggaactgttcccctttttccactccaatctcgataaatatagcatgctggaggccgctaccgaaacagtgcctatccttaacaagtctagcgccgtgtgtacgatttccccctctacccacagctccaatgcctgcggacgcgaggctagcgtcatccggaaaaagtgttactctaacatgtccgccctgttttacattaatctcgcgggccagatcacagttgtgaagtgcgaaaccaaccacgtgctgagctctgactgtgggaattgcatctccaaaagcctgtccggacaaaaggtctatacacccgtgcaggatgttttctgccagaaaggctggaccgagtctattcctagcacgagatactccaaggacatctgttctattggcctccatacagtgaaagagtgcaagatcgggaccaccagctttgaacgcgtcggattcattgtggttaagggccggaaaatgtatatcgagcagatgaagatgagatcccgccaagaatacagcgaggatcagtttctgtgttataaatctgaatccgggagcggatcttccgtgaaacttaaaaagttcaaggtcgagagctgcaaaggcgtgacaacctctagcgcttccaagtgtagcggggacgagtacttctgctctcggtatccgtgtgaaacagccaacgtcgaggcccactgcatcctgagacgccattccgctattgtggaagttaatgtgaacggagtctgggtggttccccggtgtatcggctacgaggaagtgctcgtcaaaagaacgagcctgaaggtggaggataccacagagcgggaatgcgactcctgtctgtgggagtgcggcaaaaataaacttattgtgaagacccacgggcctaaggttgtctacgccacagcttgctctcatggaagctgtaagtccgtgatgcagaaacccaccacgtttgtgtatctcccttaccccggcaactctgaaatcgtcgggggagatattggcatccacatgaccgaggagagctccccgtctaatattcacctggtggcccattgccctgcgcgcgacagctgtgacgtttccgattgcctgttctgtgtgcacgggctcctgaactatcagtgccatacactttttagcgccctgctcatctctaccacagtcatgtccatcctgaccctgcttctcctgctggtgaagggcgctaaagacctcgttaagaaactgttctactggcttattacgcccctgtgttggctcagcgtgttttgctgttgggtcgtgaagtcttggaagagacgggttggatccgccatcagcagaacaaatgataccattggctggcgcgaaaaccggagatatgctcaagacatcgagcgcgcccagtacacagggggagcgcctggcgccaaatattctttctacggggtgatgattctgggactgctttccagcgctcagtcctgcagcgaatctgtcatcgccgatagcaagatcatgcaatgtaccacctccggctctagcacactctgcaaggcttccgggacggtgattatgagactgggccccatcggatctgagagctgcctgattctcaagggcctgaaagactccgaaaagcagtttatctctattaagaccatcagctccgagcttacatgtcgggagggggagagcttctggaccacactgtacacccctatctgcctctcttcccgcagatgtcacctgatgggagaatgcgtgagcgatcggtgtctgaaatggaagacgaacgaaacatctgccgagtttaccggcaaagcccacggggacgtcatgcatgaaaataagtgcttcgagcagtccggaggcattgggtatggctgttttaacgttaatcccagctgcctttacgtgcactcctatctcaaatctgtgtaccgcaacggattcaagatctttagatgtgtcgcttggaatcatcggattcgcctggaggtgaccacacagagcagaaagttcccgatggttctgatggcgatgtccacccaacctacagattggggcagcatcgggctcattctggactctgaaggaatcacgggcaccaactcctatagcttcatgaaacacgggtctggcagctttgccatcattgatgacccctactcccccgagcctcggaagggattccttggggaagtgcgctgcccgacagaggaaaccgctatgagagcctctcccagctgtaaaatggcccctaatctgatcgagtatcagcccgagatggatacagctgaatgcaccacgaacatgattgaccctatggccatctttaatcggggctccctcccccaggtcagagacggaatgaccttcacacagtctattgagaagaacaccgtgcaagcgctgacaaccggcgaagttaaagctagcatccgcctgacacttgatgactacgatgtggtctaccaaaattcccagagcgactgctctgccacctttaagaacctgacggggtgttattcctgcgatgagggaagccggctctgttaccaggtgaaagccgagggcgaaacagttttccattttattaatgaggaagagtccatcaacgtgatcaataaggtctctcctgacgtgagcgattattgcaccgtgctgcacttctccagacccattatctctattgaagggacctacgactgtggactcagcaagcgcccgatggtcatcaaaggcacactgattgctaccgcccctcacgatgaccggaagcatgagggcgggtccagccttgttgtgaaccccaaaggaggctctgtggactttttcgggtggctgtccggactcacgagctggctgggcgggcctctgaagacatttcttaccatcctgggattcctcgcggtcggcctgctcctggtggttatcattatcattatcattagaacaggcatgcaacaggctcttaaaaagaagatcaaatga

SEQ ID NO: 14700 - RNA, 4014 nt, synthetic construct
  misc_feature 1..4014: note = derived and/or modified CDS sequence (opt5) from TOSV(SI-121283)__JF330279.1__GP
  source 1..4014: mol_type = other RNA
atgttcatcgccaagctgctcctgattagctgccttgtgcagcaagcctacctgaaatataccatcatttccgagatcggcaacgggacaagaacgtctttttgttacagctcccggacctctctcggaagcctgcttgaagcctgggacaatattacagagtccatcggcctgacctctgggacatgcaaggtcggaagcctcgaaaaccgcgagtgtaaaagagatatcatgtccaattatgttgcggaagtgcacagcaacctgcatggcctgggggctatgatgcacaattacggagacgataagcggattgaggtgctcaacgacgtcatccccgatgagctgaatcctggccgccataactgctctgaccttgatagaaaaccgttctggaccgaatttattaatgtggccaagcccgccaacgagatggctcctatgtccgttatccctcctcccattgtgaagcctatcccggtcgccgaaagcacaaccaaaaagacgattcccttcgacaaactgctctctgaggctgagaaggaactgaatcagaccaaaatccggcttgagacagaacgcagatccaacgccgaggaagcggccaaggagcgggctcgcatgagagagatcgaagataagctgcggaaagactgggagctcgaacgcgagagaaaggatgccgtggctgaagacctggccaaagagattgcgcggcgcagagagatcgaacggaaggcccacgagctggataaaatgctcaagaaaaaggaaagagaggacctggttgctcgcgaacgggtggacgaggatatgagaaatcatgtccgccggcctaacaccacaattgcccccaccatcattacgacacttctgatgggcagcgctgtgatggccgggcctctcgagaatagagaacccacccatctgcttaaccgcccgggaaacggcgcctatcctctgtctgactttgctgagcccacatgtaccctcgcgtacgggtccgaatgcaagagctgggagcaccagctggatgagctgtccttcccctttttccactctaatctcgacaaatatagcatgctggaagccgctaccgagacaatccccatccttaacaagtccagcgccgtgtgtacgatttctccctccacccacagctctaatgcctgcggacgggaagctagcctgatcaaaaagaaatgtggctccgatatgtctgcctttttctacgtcaacctcgcggggcagattacagttgtgaagtgcgacaccaatcatgtgctgagcaacgattgtggaaattgcatctccaagacacttagcggccagaaaatttacacccctgtccaggacatgttttgccagaagggctggtctgagtccatcccgagcacgagatattctaaagatctgtgttccatcgggctccacacagtgaaggaatgcaaaattggaaccaccaacttcgagcgcgttggctttatcgtggtcaaggggcggaagatgtacattgagcagatgaaaatgagaagccgccaagaattttccgaggaccagttcctgtgttataagtctgaaggaagctccggctctagcgtgaaactgaagaaagttaaggtggagtcctgcaagggggtcacaaccagctctgcttccaaatgtagcggagatgaatacttttgctctcggtatccctgtgagacagccaatgtggaggcccactgcatcctcagacggcattccgctgtcattgaagtgaacgttaatggcgtgtgggtcgtgcctcgctgtatcggctacgaggaagttctggtgagacggacgagccttaaggtcgaggacacctctagcagagaatgcgacacatgtctgtgggagtgcgggaaaaacaagctcattgtgaaaacccacggacccaagatcgtgtatgccacagcttgctcccatggcagctgtaaatctgttatgcagaagcctgccaccttcgtctacctgccctacccggggaactccgagatcgtgggaggcgatattggggtgcacatgacggaagagagctccccttctaatatccatatggtcgcgcactgccccgccaaggacagctgtgaagtgtcctcttgcctgttttgtgttcacggccttctcaattatcagtgccataccctgttcagcgctctgctcatttccacaaccgtgatgtctatcctgacacttctgctcctgctggtcaaaggagccaaggatcttgtgaaacgcctcttttactggctgattacccctctgtgttggctcagcgttttctgcggctggatgatccggtcctggaagaaaagagtggggagcgctatctctcgcacgaacgacacaattggatggagagataactcccggcgcggccaagacatcgagagagcccagtataccgggggagcgcccggcgccaagtacagcttttatggggtcatgattctgggccttctgggaaatgtgcactcttgttccgagagcatcattgctgattctaagatcatgcagtgcacaacctccggcagctccaccctctgtaaagccagcgggacagttatcatgaagctgggacctattggctctgaaagctgcctgatccttaaagggctcaaggactccgagaaacaattcatttctatcaagacgattagctccgaactgacctgccgggagggagaatctttttggacaaccctgtacacacccgtgtgtctcagctcccgcagatgccatctgatgggcgagtgtgtctctgatcggtgccttcgctggaagaccaacgagacgagcgctgagttcacagggaaagcccacggcgaagtgatgcacgaaaatagatgttttgagcagtccggaggcatcgggtatggatgcttcaacgtgaatccgagctgtctgtacgtccattcttacctcaagtccgtttataaaaacggctttaagatcttccggtgcgtggcctggaatcaccgcattagactggaagtgaccacccatagccggaaattccctatggtcctgatggctatgtctacacagcccaccgactgggggtccatcggacttattctcgatagcgagggcatcacagggacgaacgcgtactcctttatgaagcacggcctgggatctttcgccattatcgacgatccctatagccctgagccgagaaagggctttctgggggaagtgcgctgtcccaccgaggaaacagctattcgggcctcccctagctgcaaaatggcccccaatctcatcgagtaccagcctgaaatggacaccgctgagtgtacaaccaacatgatcgaccccatggccattttcaatagaggatctctgcctcaagttcgcgatggcatgacgtttacccagtccatcgagaagaacacagtgcaggcgcttaccacaggggaagtccgggctagcattagactgaccctcgacgattatgacgtggtttaccaaaattctcaattcgattgcagcgccacatttaaaaacctgaccggatgctattcctgtgacgagggctctcgcatgtgctaccaggtgaaggccgaaggcgagacgatcttccattttgtcaatgaggatgaaagcattaacgtgatcaacaaagtttcccccgacgtgtctgattactgtacagtcctgcacttcagccggccggtgatctccattgaggggagatatgactgcggacttagcaagcgccctatggtgatcaaaggcaccctgattgctaccgctccccacgatgaccggaagcatgaagggggatcttccctcgtcgttaatcctaagggcgggacagtggatttcttcggatgggtgagcggcctgacctcctggctcggcgggcccctgaaaacgtttcttacaatcctgggattcctcgcgctgggcctgcttctggtcgtgattatcatcattatcgctagaaccggggttgagcaggccctcaagaaaaagaacaaatga

SEQ ID NO: 14701 - RNA, 4014 nt, synthetic construct
  misc_feature 1..4014: note = derived and/or modified CDS sequence (opt5) from TOSV(SI-121487)__JF330280.1__GP
  source 1..4014: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatattacagagtccatcggcctgacctctgggacatgcaaggtcggaagcctcgaaaaccgcgagtgtaaaagagatatcatgtccaattatgttgcggaagtgcacagcaacctgcatggcctgggggctatgatgcacaattacggagacgataagcggattgaggtgctcaacgacgtcatccccgatgagctgaatcctggccgccataactgctctgaccttgatagaaaaccgttctggaccgaatttattaatgtggccaagcccgccaacgagatggctcctatgtccgttattccccctcccatcgtgaagcctatcccggtcgccgaaagcacaaccaaaaagacgattcccttcgacaaactgctctctgaggctgagaaggaactgaatcaaaccaaaatcatgcttgagacagaacggcgctccaacgccgaggaagcggccaaggagagagctcggatgcgcgagatcgaagataagctgagaaaagactgggagctcgaacgggagcgcaaggatgccgtggctgaagacctggccaaagagattgcgagacggcgcgagatcgaaagaaaggcccacgagctggataaaatgctcaagaaaaaggaacgggaggacctggttgctagagaacgcgtggacgaggatatgcggaatcatgtcagacgccctaacaccacaattgcccccaccatcattacgacacttctgatggctagcgccgtgatggccggccctctcgagaatcgggaaatcaaccatctgcttaactggcccgggaatggagcttataccctgtctgactttgcggagtccacatgtaccctcgcctacggcagcgaatgcaagtcctgggagcaccagctggatgagctgtctttcccgtttttccacagcaacctcgacaaatattccatgctggaagctgccaccgagacaatccctattcttaataagagctctgccgtgtgtacgatctcccccagcacccactctagcaacgcttgcgggagagaagcctccctgattaaaaagaaatgtggatctgatatgagcgcgtttttctacgtcaatctcgctggccagatcacagttgtgaagtgcgacaccaaccatgtgctgtccaatgattgtgggaactgcattagcaagacactttctggacaaaagatctacacccctgtccaggacatgttttgccagaagggctggtccgagagcatcccctctacgcgctattccaaagatctgtgtagcattggcctccacacagtgaaggaatgcaaaatcgggaccaccaatttcgagcgggttggatttattgtggtcaagggcagaaagatgtacatcgagcagatgaaaatgcgctcccggcaagaattttctgaggaccagttcctgtgttataagagcgaagggtcctctggaagctccgtgaaactgaagaaagttaaggtggagagctgcaagggcgtcacaacctcttccgccagcaaatgttctggggatgaatacttttgctccagatatccctgtgagacagccaacgtggaggctcactgcattctccgccggcatagcgccgtcatcgaagtgaatgttaacggagtgtgggtcgtgcctagatgtattggctacgaggaagttctggtgcggcgcacgtctcttaaggtcgaggacaccagctccagagaatgcgacacatgtctgtgggagtgcggcaaaaataagctcatcgtgaaaacccacgggccgaagatcgtgtatgctacagcctgcagccatggatcttgtaaatccgttatgcagaagcccgcgaccttcgtctacctgccttaccccggcaacagcgagattgtcgggggagatatcggcgtgcacatgacggaagagtcctctcctagcaatattcatatggtggcccactgccccgctaaggactcctgtgaagtgtctagctgcctgttttgtgttcacgggcttctcaactatcagtgccataccctgttctccgccctgctcatctctacaaccgtgatgagcattctgacacttctgctcctgctggtcaaaggcgctaaggatcttgtgaaacggctcttttactggctgatcaccccgctgtgttggctctccgttttctgcggatggatgatcagaagctggaagaaacgcgtgggctctgccatttcccggacgaacgacacaatcgggtggagagataatagccgcagaggacaagacattgagcgggcgcagtataccggcggggcccctggagctaagtactctttttatggcgtcatgatcctggggcttctgggcaacgtgcactcctgtagcgagtctattatcgccgattccaagatcatgcagtgcacaaccagcggatccagcaccctctgtaaagctagcggcacagttattatgaagctggggcccatcggaagcgaatcctgcctgattcttaaaggcctcaaggactctgagaaacaattcatcagcattaagacgatctcctctgaactgacctgccgcgagggggaatctttttggacaaccctgtacacacctgtgtgtctctcctctagacggtgccatctgatgggagagtgtgtcagcgatcgctgccttagatggaagaccaatgagacgtccgccgagttcacaggcaaagcccacggggaagtgatgcacgaaaaccggtgttttgagcagagcggcggaatcggctatgggtgcttcaatgtgaacccctcttgtctgtacgtccattcctacctcaagagcgtttataaaaatggatttaagattttccgctgcgtggcttggaaccacagaatccggctggaagtgaccacccattctcgcaaattccctatggtcctgatggcgatgtccacacagcccaccgactggggcagcattgggcttatcctcgattccgagggaattacaggcacgaatgcctactcttttatgaagcacgggagcggctccttcgctatcattgacgatccgtatagccctgagcccagaaagggatttctgggcgaagtgcggtgtcccaccgaggaaacagccatcagagcctctccttcctgcaaaatggctccgaacctgatcgagtaccagcccgaaatggacaccgccgagtgtacaaccaatatgattgaccctatggcgatcttcaaccgcgggagcctcccccaagttcgggatggaatgacgtttacccagtctattgagaagaatacagtgcaggctctgaccacaggcgaagtcagagccagcatccgccttaccctggacgattatgacgtggtttaccagaactcccaattcgattgctctgccacatttaaaaatctcaccgggtgctatagctgtgacgagggatcccggatgtgctaccaggtgaaggctgaaggcgagacgattttccattttgtcaacgaggatgaatctatcaacgtgatcaataaagttagccctgacgtgtccgattactgtacagtcctgcacttcagcagacccgtgatttctatcgagggccgctatgactgcgggctgtccaagcggcctatggtgattaaaagcacccttatcgccaccgcgccccacgatgacagaaagcatgaaggaggctcctctctggtcgttaacccgaaagggggaacagtggatttcttcggctgggtgagcgggctcacctcctggctgggaggccctctcaaaacgtttctgacaattcttggcttcctggctctcgggctgctgcttgtcgtgatcatcattatcattgcccgcaccggagttcagcaggccctgaagaaaaagaataaatga

SEQ ID NO: 14702 - RNA, 4014 nt, synthetic construct
  misc_feature 1..4014: note = derived and/or modified CDS sequence (opt5) from TOSV(SI-21137)__EU003173.1__GP
  source 1..4014: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatattacagagtccatcggcctgacctctgggacatgcaaggtcggaagcctcgaaaaccgcgagtgtaaaagagatatcatgtccaattatgttgcggaagtgcacagcaacctgcatggcctgggggctatgatgcacaattacggagacgataagcggattgaggtgctcaacgacgtcatccccgatgagctgaatcctcgcagacataactgctctgaccttgatcggaaaccgttctggaccgaatttattaatgtggccaagcccgccaacgagatcgctcctatgtccgttattccccctcccatcgtgaagcctattccggtcgccgaaagcacaaccaaaaagacgatccccttcgacaaactgctctctgaggctgagaaggaactgaatcaaaccaaaatccgccttgagacagaaagacggtccaacgccgaggaagcggccaaggagcgcgctagaatgcgggagattgaagataagctgcgcaaagactgggagctcgaaagagagcggaaggatgccgtggctgaagacctggccaaagagatcgcgcgcagacgggagattgaaagaaaggcccacgagctggataaaatgctcaagaaaaaggaacgcgaggacctggttgctcgggaaagagtggacgaggatatgcgcaatcatgtccggagacctaacaccacaatcgcccccaccattatcacgacacttctgatggctagcgccgtgatggccggccctctcgagaatcgcgaaaccaaccatctgcttaaccggcccggcaatggggcttatacactgtctgactttgcggagtccacctgtaccctcgcctacggaagcgaatgcaagtcctgggagcaccagctggatgagctgtctttcccgtttttccacagcaacctcgacaaatattccatgctggaagctgccacagagacgatccctattcttaataagagctctgccgtgtgtaccatctcccccagcacacactctagcaacgcttgcggcagagaagcctccctgattaaaaagaaatgtgggtctaatatgagcgcgtttttctacgtcaacctcgctggacagatcaccgttgtgaagtgcgatacaaatcatgtgctgtccaacgactgtggcaattgcattagcaagaccctttctgggcagaaaatctacacgcctgtccaagatatgttttgccagaagggatggtccgagacaaaccccagcacccgctattctaaagacctgtgttccatcggcctccacaccgtgaaggaatgcaaaattggcacaaccaatttcgagcgggaggggtttatcgttgtgaagggaagaaagatgtacattgaacagatgaaaatgcgcagccggcaagagttctccgaagatcagttcctgtgttataagtctgagggcagctccgggtctagcgtcaaactgaagaaagtgaaggttgaatcctgcaagggagtgacaacgagctctgcctccaaatgtagcggcgacgagtacttttgctctagatatccctgtgagaccgccaacgtcgaagctcactgcatcctccggcgccattccgccgtgattgaggtcaatgtgaacggggtttgggtggtccctagatgtatcggatacgaagaggtgctggttcggagaacaagccttaaggtggaagatacctctagccgcgagtgcgacacatgtctgtgggagtgcggcaaaaataagctcattgtcaaaacccacggcccgaagatcgtgtatgctacggcctgctcccatgggagctgtaaatctgtgatgcagaagcccgcgaccttcgtttacctgccttaccccggaaactccgaaatcgtcggcggggacattggagtgcacatgacagaggaaagctccccttctaacatccatatggtggcccactgccccgctaaggatagctgtgaggtctcctcttgcctgttttgtgtgcacggccttctcaattatcagtgccataccctgttcagcgccctgctcatttccacaaccgttatgtctatcctgacgcttctgctcctgctggtgaaaggggctaaggaccttgtcaaacggctcttttactggctgattacaccgctgtgttggctcagcgtgttctgcggctggatgatcagatcctggaagaaacgcgttggaagcgccatctctagaaccaacgatacaattggctggcgggacaattcccgcagagggcaagatatcgagcgggcgcagtataccggaggcgcccctggggctaagtacagcttttatggagtgatgattctgggccttctggggaacgtccactcttgttccgaaagcatcattgccgactctaagatcatgcagtgcaccacatccggcagctccacgctctgtaaagctagcggaaccgtgatcatgaagctgggccccattgggtctgagagctgcctgatccttaaaggactcaaggattccgaaaaacaattcatttctatcaagacaattagctccgagctgacctgccgcgaaggcgagtctttttggacaaccctgtacacgcctgtttgtctcagctccagacggtgccatctgatgggggagtgtgtgtctgaccgctgccttagatggaagacaaatgaaaccagcgccgagttcaccggaaaagcccacggcgaagtcatgcacgagaaccggtgttttgaacagtccgggggcatcggatatggctgcttcaatgtgaaccccagctgtctgtacgtgcattcttacctcaagtccgtctataaaaatgggtttaagatcttccgctgcgttgcttggaaccaccggattagactggaggtgacaacccatagcagaaaattccctatggtgctgatggcgatgtctacacagcccacggattggggatccatcggccttattctcgacagcgggggaatcaccggcacaaatgcctactcctttatgaagcacgggctgggctctttcgctattatcgatgacccgtatagccctgagccccgcaagggatttctgggcgaagtccggtgtcccaccgaggaaacagccattagagcctcccctagctgcaaaatggctccgaacctcatcgagtaccagcccgaaatggataccgccgagtgtacgaccaatatgatcgaccctatggcgattttcaaccgcgggtctctgccccaagtgcgggacggaatgacatttacccagtccatcgagaagaatacagttcaggctcttaccacaggcgaagtgagagccagcattcgcctgaccctcgatgactatgatgtcgtgtaccagaactctcaattcgactgcagcgccacgtttaaaaacctgacagggtgctattcctgtgatgagggatctcggatgtgctaccaggttaaggctgaaggcgagaccatcttccattttgtgaatgaggacgaaagcattaacgtcatcaataaagtgtcccctgatgtttctgactactgtaccgtgctgcacttcagcagacccgtcatctccattgagggccgctatgattgcgggcttagcaagcggcctatggtgatcaaaggaacactgattgccaccgcgccccacgacgatagaaagcatgaaggcgggtcttccctcgtggtcaacccgaagggaggcacggttgactttttcgggtgggtgagcggactgacatcctggctcggcggccctctgaaaacctttcttacaatcctggggttcctcgctctgggactgcttctggtggtcattatcatcattatcgcccggaccggcgtggagcaggccctcaagaaaaagaataaatga

SEQ ID NO: 14703 - RNA, 4014 nt, synthetic construct
  misc_feature 1..4014: note = derived and/or modified CDS sequence (opt5) from TOSV(SI-31051)__EU003174.1__GP
  source 1..4014: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatattacagagtccatcggcctgacctctgggacatgcaaggtcggaagcctcgaaaaccgcgagtgtaaaagagatatcatgtccaattatgttgcggaagtgcacagcaacctgcatggcctgggggctatgatgcacaattacggagacgataagcggattgaggtgctcaacgacgtcatccccgatgagctgaatcctggccgccataactgctctgaccttgatagaaaaccgttctgtaccgaatttattaatgtggccaagcccgccaacgagatggctcctatgtccgttatccctcctcccattgtgaagcctatcccggtcgccgaacccacaaccaaaaagacgattcctttcgacaaactgctcagcgaggctgagaaggaactgaatcaaaccaaaatccggcttgagacagaacgcagatctaacgccgaggaagcggccaaggagcgggctcgcatgagagagatcgaagataagctgcggaaagactgggagctcgaacgcgagagaaaggatgccgtggctgaagacctggccaaagagattgcgcggcgcagagagatcgaacggaaggcccacgagctggataaaatgctcaagaaaaaggaaagagaggacctggttgctcgcgaacgggtggacgaggatatgagaaatcatgtccgccggcccaacaccacaattgcccctaccatcattacgacacttctgatggcttccgccgtgatggccggccccctcgagaatagagaaaccaaccatctgcttaaccgcccggggaatggagcttatacactgagcgactttgcggagtctacctgcaccctcgcctacggctccgaatgtaagagctgggagcaccagctggatgagctgtccttcccctttttccactctaacctcgacaaatatagcatgctggaagctgccacagagacgatccccatccttaataagtccagcgccgtgtgcaccatttctccttccacacacagctctaacgcttgtgggcgggaagccagcctgatcaaaaagaaatgcggatccgatatgtctgcgtttttctacgtcaatctcgctggccagattaccgttgtgaagtgtgacacaaaccatgtgctgagcaatgattgcgggaactgcatctccaagacccttagcggacagaaaatttacacgcccgtccaagacatgttttgtcagaagggctggtctgagtccatccccagcacaagatattctaaagatctgtgctccatcggcctccacaccgtgaaggaatgtaaaattgggaccacaaatttcgagcgcgttggatttatcgtggtcaagggccggaagatgtacattgagcagatgaaaatgagaagccgccaagagttctccgaggaccagttcctgtgctataagtctgaagggagctccggatctagcgtgaaactgaagaaagttaaggtggagtcctgtaagggcgtcaccacaagctctgcctccaaatgcagcggggatgaatacttttgttctcggtatccttgcgagacggccaacgtggaggctcactgtatcctcagacggcattccgccgtcattgaagtgaatgttaacggagtgtgggtcgtgccgcgctgcatcggctacgaggaagttctggtgagacggaccagccttaaggtcgaggacacatctagcagagaatgtgatacctgcctgtgggagtgcggcaaaaataagctcattgtgaaaacacacgggcccaagatcgtgtatgctaccgcctgttcccatggaagctgcaaatctgttatgcagaagcctgcgacgttcgtctacctgccctaccctggcaactccgagatcgtcgggggagatattggcgtgcacatgaccgaagagagctccccctctaatatccatatggtggcccactgtccggctaaggacagctgcgaagtgtcctcttgtctgttttgcgttcacgggcttctcaactatcagtgtcatacactgttcagcgccctgctcatttccaccacagtgatgtctatcctgacccttctgctcctgctggtcaaaggcgctaaggatcttgtgaaacgcctcttttactggctgattacgcctctgtgctggctcagcgttttctgtggatggatgatccggtcctggaagaaaagagtgggcagcgccatctctcgcacaaacgacaccattgggtggagagataattcccggcgcggacaagacatcgagagagcgcagtatacaggcggggcccccggagctaagtacagcttttatggcgtcatgattctggggcttctgggcaacgtgcactcttgctccgagagcatcattgccgattctaagatcatgcagtgtaccacctccggaagctccacactctgcaaagctagcggcacggttatcatgaagctggggcctattggatctgaaagctgcctgatccttaaaggcctcaaggactccgagaaacaattcatttctatcaagaccattagctccgaactgacatgtcgggagggggaatctttttggaccacactgtacacccccgtgtgcctcagctcccgcagatgtcatctgatgggagagtgcgtctctgatcggtgtcttcgctggaagacgaatgagacaagcgccgagttcaccggcaaagcccacggggaagtgatgcacgaaaacagatgctttgagcagtccggcggaatcggctatgggtgtttcaatgtgaaccctagctgcctgtacgtccattcttacctcaagtccgtttataaaaatggatttaagatcttccggtgtgtggcttggaaccaccgcattagactggaagtgaccacacatagccggaaattccccatggtcctgatggcgatgtctacccagccgacagactggggctccatcgggcttattctcgatagcggaggcatcacggggaccaatgcctactcctttatgaagcacggcctgggatctttcgctattatcgacgatccttatagccccgagcccagaaagggctttctgggggaggtgcgctgccctacagaagagaccgccattcgggcctccccgagctgtaaaatggctcccaacctcatcgaataccagcctgagatggacacagccgaatgcaccacgaatatgatcgaccccatggcgattttcaacagaggatctctgcctcaagttcgcgatggcatgacctttacacagtccatcgagaagaataccgtgcaggctcttacaaccggggaggtccgggccagcattagactgacactcgacgattatgacgtggtttaccagaactctcaattcgattgcagcgccacctttaaaaatctgacgggatgttattcctgcgacgaaggctctcgcatgtgttaccaggtgaaggctgagggcgaaacaatcttccattttgtcaacgaggatgagagcattaacgtgatcaataaagtttcccccgacgtgtctgattactgcaccgtcctgcacttcagccggcctgtgatctccattgaagggagatatgactgtggacttagcaagcgccccatggtgatcaaaggcaccctgattgccacagcgccgcacgatgaccggaagcatgaagggggatcttccctcgtcgttaaccctaagggcgggaccgtggactttttcggatgggtgagcggcctgacgtcctggctcggcgggcccctgaaaacatttcttaccatcctgggattcctcgctctgggcctgcttctggtcgtgattatcatcattatcgccagaacaggggttgaacaggccctcaagaaaaagaataaatga

SEQ ID NO: 14704 - RNA, 4014 nt, synthetic construct
  misc_feature 1..4014: note = derived and/or modified CDS sequence (opt5) from TOSV(SI-39538)__EU003175.1__GP
  source 1..4014: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggataatattacagagtccatcggcctgacctctgggacatgcaaggtcggaagcctcgaaaaccgcgagtgtaaaagagatatcatgtccaattatgttgcggaagtgcacagcaacctgcatggcctgggggctatgatgcacaattacggagacgataagcggattgaggtgctcaacgacgtcatccccgatgagctgaatcctggccgccataactgctctgaccttgatagaaaaccgttctggaccgaatttattaatgtggccaagcccgccaacgagatggctcctatgtccgttattccccctcccatcgtgaagcctatcccggtcgccgaaagcacaaccaaaaagacgattcccttcgacaaactgctctctgaggctgagaaggaactgaatcaaaccaaaatccggcttgagacagaacgcagatccaacgccgaggaagcggccaaggagcgggctcgcatgagagagatcgaagataagctgcggaaagactgggagctcgaacgcgagagaaaggatgccgtggctgaagacctggccaaagagattgcgcggcgcagagagatcgaacggaaggcccacgagctggataaaatgctcaagaaaaaggaaagagaggacctggttgctcgcgaacgggtggacgaggatatgagaaatcatgtccgccggcctaacaccacaattgcccccaccatcattacgacacttctgatggctagcgccgtgatggccggccctctcgagaatagagaaaccaaccatctgcttaaccgccccgggaatggagcttatacactgtctgactttgcggagtccacctgtaccctcgcctacggcagcgaatgcaagtcctgggagcaccagctggatgagctgtctttcccgtttttccacagcaacctcgacaaatattccatgctggaagctgccacagagacgatccctatccttaataagagctctgccgtgtgtaccatttcccccagcacacactctagcaacgcttgcgggcgggaagcctccctgatcaaaaagaaatgtggatctgatatgagcgcgtttttctacgtcaatctcgctggccagattaccgttgtgaagtgcgacacaaaccatgtgctgtccaatgattgtgggaactgcatcagcaagaccctttctggacagaaaatttacacgcctgtccaagacatgttttgccagaagggctggtccgagagcatcccctctacaagatattccaaagatctgtgtagcatcggcctccacaccgtgaaggaatgcaaaattgggaccacaaatttcgagcgcgttggatttatcgtggtcaagggccggaagatgtacattgagcagatgaaaatgagatcccgccaagagttctctgaggaccagttcctgtgttataagagcgaagggtcctctggaagctccgtgaaactgaagaaagttaaggtggagagctgcaagggcgtcaccacatcttccgccagcaaatgttctggggatgaatacttttgctcccggtatccctgtgagacggccaacgtggaggctcactgcatcctcagacggcatagcgccgtcattgaagtgaatgttaacggagtgtgggtcgtgcctcgctgtatcggctacgaggaagttctggtgagacggacctctcttaaggtcgaggacacaagctccagagaatgcgacacctgtctgtgggagtgcggcaaaaataagctcattgtgaaaacacacgggccgaagatcgtgtatgctaccgcctgcagccatggatcttgtaaatccgttatgcagaagcccgcgacgttcgtctacctgccttaccccggcaacagcgagatcgtgggaggagatattggcgtgcacatgaccgaagagtcctctcctagcaatatccatatggtcgcccactgccccgctaaggactcctgtgaagtgtctagctgcctgttttgtgttcacgggcttctcaactatcagtgccatacactgttctccgccctgctcatttctaccacagtgatgagcatcctgacccttctgctcctgctggtcaaaggcgctaaggatcttgtgaaacgcctcttttactggctgattacgccgctgtgttggctctccgttttctgcggatggatgatccggagctggaagaaaagagtgggctctgccatctcccgcacaaacgacaccattgggtggagagataatagccggcgcggacaagacatcgagagagcgcagtatacaggcggggcccctggagctaagtactctttttatggcgtcatgattctggggcttctgggcaacgtgcactcctgtagcgagtctatcattgccgattccaagatcatgcagtgcaccaccagcggatccagcacactctgtaaagctagcggcacggttatcatgaagctggggcccattggaagcgaatcctgcctgatccttaaaggcctcaaggactctgagaaacaattcattagcatcaagaccatttcctctgaactgacatgccgggagggggaatctttttggaccacactgtacacccctgtgtgtctctcctctcgcagatgccatctgatgggagagtgtgtcagcgatcggtgccttcgctggaagacgaatgagacatccgccgagttcaccggcaaagcccacggggaagtgatgcacgaaaacagatgttttgagcagagcggcggaatcggctatgggtgcttcaatgtgaacccctcttgtctgtacgtccattcctacctcaagagcgtttataaaaatggatttaagatcttccggtgcgtggcttggaaccaccgcattagacatgaagtgaccacacactctcggaaattccctatggtcctgatggcgatgtccacccagcccacagactggggcagcatcgggctgattcttgattccggaggcatcacggggaccaatgcctactcttttatgaagcatggcctcgggagcttcgctattatcgacgatccgtattcccctgagcccagaaagggctttctgggggaggtgcgctgtcccacagaagagaccgccattcgggccagcccttcttgcaaaatggctccgaacctgatcgaataccagcccgagatggacacagccgaatgtaccacgaatatgatcgaccctatggcgattttcaacagaggatccctcccccaagttcgcgatggcatgacctttacacagagcatcgagaagaataccgtgcaggctctgacaaccggggaggtccgggcctctattagacttacactggacgattatgacgtggtttaccagaacagccaattcgattgctccgccacctttaaaaatctcacgggatgctattcttgtgacgaaggcagccgcatgtgctaccaggtgaaggctgagggcgaaacaatcttccactttgtcaacgaggatgagtccattaacgtgatcaataaagtttctcctgacgtgagcgattactgtaccgtcctgcacttctcccggcccgtgatcagcattgaagggagatatgactgcggactgtctaagcgccctatggtgatcaaaggcacccttattgccacagcgccccatgatgaccggaagcacgaagggggatccagcctggtcgttaacccgaagggcgggaccgtggactttttcggatgggtgtccggcctcacgtcttggctgggcgggcctctcaaaacatttctgaccatccttggattcctggctctcggcctgctgcttgtcgtgattatcatcattatcgccagaacaggggttgaacaggccctgaagaaaaagaataaatga

SEQ ID NO: 14705 - RNA, 4014 nt, synthetic construct
  misc_feature 1..4014: note = derived and/or modified CDS sequence (opt5) from TOSV(SI-40463)__EU003176.1__GP
  source 1..4014: mol_type = other RNA
atgttcatcgccaagctgctcctgattagctgccttgtgcagcaagcctacctgaaatataccatcatttccgagatcggcaacgggacaagaacgtctttttgttacagctcccggacctctctcggaagcctgcttgaagcctgggataatattacagagtccatcggcctgacctctgggacatgcaaggtcggaagcctcgaaaaccgcgagtgtaaaagagatatcatgtccaattatgttgcggaagtgcacagcaacctgcatggcctgggggctatgatgcacaattacggagacgataagcgggtggaggtcctcaacgacgtgattcccgatgagctgaatcctggccgccataactgctctgaccttgatagaaaaccgttctggaccgaatttatcaatgttgccaagcccgtgaacgagatggcccctatgtccgtcattccccctcccatcgtgaagcctattccggttgctgaaagcacaaccaaaaagacgatccccttcgacaaactgctctctgaggccgagaaggaactgaatcagaccaaaattcggcttgagacagaacgcagatccaacgctgaggaagccgcgaaggagcgggcccgcatgagagagatcgaagataagctgcggaaagactgggagctcgaacgcgagagaaaggatgctgtggccgaagacctggctaaagagatcgcccggcgcagagagattgaacggaaggcgcacgagctggataaaatgctcaagaaaaaggaaagagaggacctggtcgcccgcgaacgggtggacgaggatatgagaaatcatgtgcgccggcctaacaccacaatcgctcccaccattatcacgacacttctgatggccagcgctgtcatggccggccctctcgagaatagagaaaccaaccatctgcttaaccgccccgggaatggagcctatacactgtctgactttgctgagtccacctgtaccctcgcgtacggcagcgaatgcaagtcctgggagcaccagctggatgagctgtctttcccgtttttccacagcaacctcgacaaatattccatgctggaagccgctacagagacgattcctatccttaataagagctctgccgtttgtaccatctcccccagcacacactctagcaacgcctgcgggcgggaagctagcctgattaaaaagaaatgtggatctgatatgagcgcctttttctacgtgaatctcgcgggccagatcaccgtggtcaagtgcgacacaaaccatgtgctgtccaatgattgtgggaactgcattagcaagaccctttctggacagaaaatctacacgcctgttcaagacatgttttgccagaagggctggtccgagagcattccctctacaagatattccaaagatctgtgtagcatcggcctccacaccgtgaaggaatgcaaaatcgggaccacaaatttcgagcgcgtcggatttattgtggttaagggccggaagatgtacatcgagcagatgaaaatgagatcccgccaagagttctctgaggaccagttcctgtgttataagagcgaagggtcctctggaagctccgtgaaactgaagaaagtcaaggtggagagctgcaagggcgtcaccacatcttccgctagcaaatgttctggggatgaatacttttgctcccggtatccctgtgagacggccaacgtggaggcccactgcattctcagacggcatagcgctgttatcgaagtgaatgtcaacggagtgtgggttgtgcctcgctgtattggctacgaggaagtcctggtgagacggacctctcttaaggtggaggacacaagctccagagaatgcgacacctgtctgtgggagtgcggcaaaaataagctcatcgttaaaacacacgggccgaagattgtctatgccaccgcttgcagccatggatcttgtaaatccgtgatgcagaagcccgccacgttcgtgtacctgccttaccccggcaacagcgagatcgtcgggggagatatcggcgtgcacatgaccgaagagtcctctcctagcaatattcatatggttgcgcactgccccgccaaggactcctgtgaagtgtctagctgcctgttttgtgtccacgggcttctcaactatcagtgccatacactgttctccgctctgctcatctctaccacagtgatgagcattctgacccttctgctcctgctggttaaaggcgccaaggatcttgtgaaacgcctcttttactggctgatcacgccgctgtgttggctctccgtcttctgcggatggatgattcggagctggaagaaaagagtgggctctgctatctcccgcacaaacgacaccatcgggtggagagataatagccggcgcggacaagacattgagagagcccagtatacaggcggggcgcctggagccaagtactctttttatggcgttatgatcctggggcttctgggcaacgtgcactcctgtagcgagtctattatcgctgattccaagattatgcagtgcaccaccagcggatccagcacactctgtaaagcctctggcacggtcatcatgaagctggggcccatcggaagcgaatcctgcctgattcttaaaggcctcaaggactctgagaaacaattcatcagcattaagaccatctcctctgaactgacatgccgggagggggaatccttttggaccacactgtacacccctgtgtgtctctcctctcgcagatgccatctgatgggagagtgtgtgagcgatcggtgccttcgctggaagacgaatgagacatccgctgagttcaccggcaaagcccacggggaagtcatgcacgaaaacagatgttttgagcagagcggcggaattggctatgggtgcttcaatgttaacccctcttgtctgtacgtgcattcctacctcaagagcgtgtataaaaatggatttaagatcttccggtgcgtcgcctggaaccaccgcatcagactggaagtgaccacacattctcggaaattccctatggttctgatggctatgtccacccagcccacagactggggcagcattgggcttatcctcgattccggaggcattacggggaccaatgcgtactcttttatgaagcacggcctgggcagcttcgccatcattgacgatccgtattcccctgagcccagaaagggatttctgggggaggtgcgctgtcccacagaagagaccgctatccgggccagcccttcttgcaaaatggccccgaacctcattgaataccagcccgagatggacacagctgaatgtaccacgaatatgatcgaccctatggccatcttcaacagaggatccctgccccaagtccgcgatggcatgacctttacacagagcattgagaagaataccgtgcaggcgcttacaaccggggaggttcgggcttctatcagactgacactcgacgattatgacgtggtctaccagaacagccaattcgattgctccgccacctttaaaaatctgacgggatgctattcttgtgacgaaggcagccgcatgtgctaccaggtgaaggccgagggcgaaacaattttccattttgttaacgaggatgagtccatcaacgtgattaataaagtctctcctgacgtgagcgattactgtaccgtgctgcacttctcccggcccgtcatcagcatcgaagggagatatgactgcggactttctaagcgccctatggttattaaaggcaccctgatcgctacagctccccacgatgaccggaagcatgaagggggatccagcctcgtggtgaacccgaagggcgggaccgtcgactttttcggatgggtgtccggcctgacgtcttggctcggcgggcctctgaaaacatttcttaccattctgggattcctcgcgctgggcctgcttctggttgtgatcattatcatcattgctagaacaggggtcgaacaggccctcaagaaaaagaataaatga

SEQ ID NO: 14706 - RNA, 4020 nt, synthetic construct
  misc_feature 1..4020: note = derived and/or modified CDS sequence (opt5) from TOSV(SI-40614)__EU003177.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatattacagagtccatcggcctgacctctgggacatgcaaggtcggaagcctcgaaaaccgcgattgtaaaagagacatcatgtccaattatgttgcggaggtgcacagcaacctgcatggcctgggggctatgatgcacaattacggagatgacaagcgggtggaagtcctcaacgatgtgattcccgacgagctgaatcctggccgccataactgctctgatcttgacagaaaaccgttctggaccgagtttatcaatgttgccaagcccgccaacaagattgctcctatctccgtgattccccctcccatcgtcaaacctattccgatcgccgaaagcacaatcaagaaaaccattcccttcgataagctgctctctgaggctgaaaaagagctgaatcaaacgaagatccggcttgagaccgaacgcagatccaacgccggcgaggcggcccgggaacgcgctagaatgcgggagattgaagacaagctgcgcaaaaattgggagctcgagagagaacggaaggatgccgtggctgacgatctggccaaagagatcgcgcgcagacgggaaattgagagaaaggcccacgaactggacaaaatgctcaagaaaaaggagcgcgaggaccaggttgctatcgaacgggtgagcgaggatatgagaaaccatgtccgccggcctaatacaaccatcgcccccgctcctacaattatcaccacgctgcttatggcctctgccgtgatggctgggcccctggaaaacagagagacaaaccacctcctgaatcgcccgggaaacggcgcgtataccctttccgactttgccgaaagcacatgtaccctggcttacgggtccgagtgcaagtcttgggagcaccagctcgatgaactgagcttcccctttttccattccaatctggacaaatatagcatgctcgaggccgccaccgaaacaattcctatcctgaacaagtcttccgctgtgtgtacgattagcccttctacccacagctccaatgcctgcggacgggaggcgtctcttatcaaaaagaaatgtggcaacaatatgagcgcctttttctacgtcaacctggctgggcaaatcacagttgtgaagtgcgataccaatcatgtgctctccaacgactgtggaaattgcattagcaagacactgtctggccagaaaatctacacccccgtccaggatatgttttgccagagaggctggacggagtccattcccagcacacgctattctaaggacctttgttccatcgggctgcacaccgtgaaagaatgcaagaccggagccacaaacttcgagcgggttggctttattgtggtcaaaagcagaaagatgtacatcgaacaaatgaagatgcgctcccggcaggagttctctgaagatcagttcctctgttataaaagcgagtcctctagcgggtccagcgtgaagctgaaaaaggttaaagtggagtcttgcaagggagtcaccacatccagcgcttctaagtgttccggcgacgaatacttttgcagcagatatccttgtgagacggccaatgtggaagctcactgcattctgcggcgccattctgccgtcatcgaggtgaacgttaatggggtgtgggtcgtgccgagatgtatcggatacgaagaggttctcgtgcggagaaccagcctgaaaatggaggatacatccagccgcgaatgcgacacctgtctttgggagtgcggcaagaacaaactgattgtcaagacacacggccccaaaatcgtgtatgcgaccgcctgctctcatgggtcctgtaagagcgtgatgcagaaacctgctacgttcgtttacctcccctaccctggaaactccgaaattgtcggcggggacatcggagtgcacatgaccgaggaatctagcccctccaatattcatatggtggcccactgcccggctaaggattcttgtgaggtcagctcctgcctgttttgtgtgcacggcctgcttaactatcaatgccatacactcttctctgccctgctgatcagcaccacagttatgtccatcctcaccctgcttctgctcctggtgaagggggcgaaagacctggtcaagaaactcttttactggcttattacgcctctgtgttggctgagcgtgttctgcggctggatgatcaagtcttggaaaaagcgggttggatccgccattagcagaacaaatgataccatcggctggcgcgacaacagacggtatgggcgcgatgtggagagagctcagtacacaggaggcgtccccggggccatttattctttttacggagtgatgatcctcggcctgcttgggaatgttcactcctgtagcgaatctgtgatcgctgactccaaggtcatgcagtgcaccaccagcggctccagcacactgtgtaaagcctctggaacggtgattatgaagctcggccctatcgggagcgagtcctgcctgattctgaaaggacttaaggataacgaaaaacaattcatctctattaagaccatcagctccgagctcacatgccgggagggcgaatctttttggaccacactgtatacccccgtgtgtctgagctcccgcagatgccatctcatgggggagtgtgtctctgaccggtgcctgaagtggaaaacgaatgaaacaagccctgagttcaccggaaaggcccacggcgaagttatgcacgagaaccgctgttttgagcagtccgggggcatcggatacggctgcttcaatgtgaaccccagctgtctttacgtgcattctattctgaaatccgtctataagaatgggtttaaaatcttcagatgcgtggcttggaaccaccggattcgcctcgaagttaccacacatagcagaaagttcccgatggtgctgatggcgatgtctacccagcctacagattggggatccatcggcctgattcttgacagcgaggggatcacgggaaccaatgcctactcctttatgaagcacggctctgggagcttcgctattatcgatgacccctattcccccgaacctcggaaaggctttctcggagaggtcagatgtccgacagaagagaccgccatccgcgccagcccctcttgcaagatggctcctaacctgattgagtaccagcccgaaatggatacagccgagtgtaccacgaatatgatcgaccctatggcgattttcaaccggggctccctgccccaagtgagagacgggatgacctttacacagagcatcgagaaaaacaccgttcaggctctcacaaccggagaagtgcgcgcctctattcggctgacacttgatgactatgatgtcgtgtaccagaatagccaatccgactgctctgccaccttcaagaacctgacgggctgctatagctgtgatgaagggtccagaatgtgctaccaggttaaagctgagggagagacaatctttcatttcgtgaatgaagacgagtctatcaacgtcattaataaggtgagccctgatgtgtccgactactgtaccgtcctccactttagccgccccgttatctctattgaaggccggtatgattgcggcctgtccaaaagaccgatggtgatcaaggggaccctgattgccacagcgcctcacgacgatcgcaagcatgagggaggcagctcccttgtggtcaaccccaaagggggaaccgtggacttctttggctgggtttctgggctgacgagctggctcggaggccctctgaagacattcctcaccatcctgggctttcttgctctggggctcctgctggtggtcatcattatcattatcgcccggacaggagtggagcaggcccttaaaaagaaaaataagtga

SEQ ID NO: 14707 - RNA, 4014 nt, synthetic construct
  misc_feature 1..4014: note = derived and/or modified CDS sequence (opt5) from TOSV(SI-51903)__EU003178.1__GP
  source 1..4014: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatattacagagtccatcggcctgacctctgggacatgcaaggtcggaagcctcgaaaaccgcgagtgtaaaagagatatcatgtccaattatgttgcggaagtgcacagcaacctgcatggcctgggggctatgatgcacaattacggagacgataagcggattgaggtgctcaacgacgtcatccccgatgagctgaatcctggccgccataactgctctgaccttgatagaaaaccgttctggaccgaatttattaatgtggccaagcccgccaacgagatcgctcctatgtccgttattccccctcccatcgtgaagcctattccggtcgccgaaagcacaaccaaaaagacgatccccttcgacaaactgctctctgaggctgagaaggaactgaatcaaaccaaaatccggcttgagacagaacgcagatccaacgccgaggaagcggccaaggagcgggctcgcatgagagagattgaagataagctgcggaaagactgggagctcgaacgcgagaagaaagatgccgtggctgaagacctggccaaggagatcgcgagacggcgcgagattgaaagaaaagcccacgagctggataagatgctcaaaaagaaggaacgggaggacctggttgctagagaacgcgtggacgaggatatgcggaatcatgtcagacgccctaacgccaccatcgctcccacaattatcaccacgcttctgatggccagcgccgtgatggctggccctctcgagaatcgggaaacaaaccatctgcttaacagacccgggaatggagcgtataccctgtctgactttgccgagtccacatgtaccctcgcttacggcagcgaatgcaaatcctgggagcaccagctggatgagctgtctttcccgtttttccacagcaacctcgacaagtattccatgctggaagccgccaccgagacaatccctattcttaataaaagctctgctgtgtgtacgatctcccccagcacccactctagcaacgcctgcgggcgcgaagcgtccctgattaagaaaaagtgtggatctgatatgagcgctttcttctacgtcaatctcgccggccagatcacagttgtgaagtgcgacaccaaccatgtgctgtccaatgattgtgggaactgcattagcaaaacactttctggacaaaagatctacacccctgtccaggacatgttttgccagaaaggctggtccgagagcatcccctctacgcggtattccaaggatctgtgtagcattggcctccacacagtgaaagaatgcaagatcgggaccaccaatttcgagagagttggatttattgtggtcaagggccgcaaaatgtacatcgagcagatgaagatgcggtccagacaagaattttctgaggacgaatttctgtgttataaaagcgaggggtcctctggaagctccgtgaagctgaaaaaggttaaggtggaaagctgcaaaggcgtcacaacctcttccgccagcaagtgttctggggatgagtacttttgctcccgctatccctgtgagacagctaacgtggaagcccactgcattctccggagacatagcgctgtcatcgaggtgaatgttaacggagtgtgggtcgtgcctcggtgtattggctacgaagaggttctggtgcgcagaacgtctcttaaagtcgaagacaccagctcccgggagtgcgacacatgtctgtgggagtgcggcaagaataaactcatcgtgaagacccacgggccgaaaatcgtgtatgccacagcgtgcagccatggatcttgtaagtccgttatgcagaagcccgccaccttcgtctacctgccttaccccggcaacagcgaaattgtgggaggagatatcggcgtgcacatgacggaggaatcctctcctagcaatattcatatggtcgctcactgccccgccaaagactcctgtgaggtgtctagctgcctgttttgtgttcacgggcttctcaactatcagtgccataccctgttctccgctctgctcatctctacaaccgtgatgagcattctgacacttctgctcctgctggtcaagggcgccaaagatcttgtgaagagactcttttactggctgatcaccccgctgtgttggctctccgttttctgcggatggatgatccgcagctggaaaaagcgggtgggctctgcgatttccagaacgaacgacacaatcgggtggcgcgataatagcagacggggacaggacgtcgagcgcgcccaatataccggcggggctcctggagccaagtactctttttatggcgtgatgattctggggcttctgggcaacgttcactcctgtagcgaatctatcattgctgattccaaaatcatgcagtgcacaaccagcggatccagcaccctctgtaaggcctctggcacagtgatcatgaaactggggcccattggaagcgagtcctgcctgatccttaagggcctcaaagactctgaaaagcagttcattagcatcaagacgatttcctctgagctgacctgcagagaaggggagagcttttggacaaccctgtacacacctgtctgtctctcctctcggcgctgccatctgatgggagagtgtgtgagcgatagatgccttcggtggaaaaccaatgaaacgtccgccgagttcacaggcaaggctcacggggaagtgatgcacgagaaccgctgttttgaacaaagcggcggaatcggctatgggtgcttcaatgtcaacccctcttgtctgtacgttcattcctacctcaaaagcgtgtataagaatggatttaaaatcttcagatgcgtggcgtggaaccaccggattcgcctggaggtcaccacccattctagaaagttccctatggtgctgatggccatgtccacacagcccaccgactggggcagcatcgggcttattctcgattccggaggcatcacagggacgaatgcttactcttttatgaagcacggcctggggagcttcgccattatcgacgatccgtattcccctgagccccggaaaggctttctgggggaagttagatgtcccaccgaggaaacagccattcgcgctagcccttcttgcaagatggccccgaacctcatcgagtaccagcccgaaatggacaccgcggagtgtacaaccaatatgatcgaccctatggctattttcaaccggggatccctgccccaggtgagagatggcatgacgtttacccaaagcatcgagaaaaatacagtccaggcccttaccacaggggaagtgcgcgcctctattcggctgaccctcgacgattatgacgttgtgtaccagaacagccagttcgattgctccgctacatttaagaatctgaccggatgctattcttgtgacgagggccctagaatgtgctaccaagtcaaagccgaaggcgagacgatcttccattttgtgaacgaggatgaaagcattaacgttatcaataaggtgtcccccgacgtctctgattactgtacagtgctgcacttcagccgccctgtgatctccattgaggggcggtatgactgcggacttagcaaaagacccatggtcatcaagggcaccctgattgcgaccgctccgcacgatgaccgcaagcatgaagggggatcttccctcgttgtgaaccctaaaggcgggacagtggatttcttcggatgggtcagcggcctgacctcctggctcggcgggcccctgaagacgtttcttacaatcctgggattcctcgccctgggcctgcttctggtggttattatcatcattatcgcccggaccggggtggagcaggctctcaaaaagaaaaataagtga

SEQ ID NO: 14708 - RNA, 4014 nt, synthetic construct
  misc_feature 1..4014: note = derived and/or modified CDS sequence (opt5) from TOSV(SI-68809)__EU003179.1__GP
  source 1..4014: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatattacagagtccatcggcctgacctctgggacatgcaaggtcggaagcctcgaaaaccgcgagtgtaaaagagatatcatgtccaattatgttgcggaagtgcacagcaacctgcatggcctgggggctatgatgcacaattacggagacgataagcggattgaggtgctcaacgacgtcatccccgatgagctgaatcctggccgccataactgctctgaccttgatagaaaaccgttctggaccgaatttattgacgtggccaagcccgccaatgagatcgctcctatgtccgttattccccctcccatcgtgaagcctattccggtcgccgaaagcacaatcaaaaagaccatccccttcgataaactgctctctgaggctgaggaagaactgaaccaaacgaagattcggcttgaaaccgagcgcagatccaatgccgaagaggcggccaaagagcgggctcgcatgagagaaatcgaggacaagctgcggaaggattgggaactcgagcgcgaaagaaaagacgccgtggctgaggatctggccaaggagattgcgcggcgcagagaaatcgagcggaaagcccacgaactggacaagatgctcaaaaagaaagagagagaagacctggttgctcgcgagcgggtgaacgaggatatgagaaatcatgtccgccggcctaacacaaccattgcccccacaatcatcaccacgcttctgatggctagcgccgtgatggccggccctctcgaaaatagagagacaaaccatctgcttaaccgccccgggaatggagcttataccctgtctgactttgcggaatccacatgtaccctcgcctacggcagcgagtgcaagtcctgggagcaccagctggatgaactgtctttcccgtttttccacagcaacctcgacaagtattccatgctggaggctgccaccgaaacaattcctatccttaataaaagctctgccgtgtgtacgatttcccccagcacccactctagcaacgcttgcgggcgggaggcctccctgatcaagaaaaagtgtggatctaatatgagcgcgtttttctacgtcaacctcgctggccagattacagttgtgaaatgcgataccaatcatgtgctgtccaacgactgtgggaattgcatcagcaagacactttctggacaaaagatctacacccctgtccaggatatgttttgccagaaaggctggtccgaaagcattccctctacgagatattccaaggacctgtgtagcatcggcctccacacagtgaaagagtgcaagaccgggaccacaaacttcgagcgcgttggatttattgtggtcaaaggccggaagatgtacatcgaacagatgaagatgagatcccgccaagagttctctgaagatcagttcctgtgttataaaagcgaggggtcctctggaagctccgtgaagctgaaaaaggttaaagtggaaagctgcaagggcgtcaccacatcttccgccagcaagtgttctggggacgagtacttttgctcccggtatccctgtgagacggccaatgtggaagctcactgcattctcagacggcatagcgccgtcatcgaggtgaacgttaatggagtgtgggtcgtgcctcgctgtattggctacgaagaggttctggtgagacggacctctcttaaagtcgaagatacaagctccagagagtgcgacacctgtctgtgggagtgcggcaagaacaaactcatcgtgaagacacacgggccgaaaatcgtgtatgctaccgcctgcagccatggatcttgtaagtccgttatgcagaaacccgcgacgttcgtctacctgccttaccccggcaatagcgaaattgtgggaggagacatcggcgtgcacatgaccgaggaatcctctcctagcaacattcatatggtcgcccactgccccgctaaggattcctgtgaggtgtctagctgcctgttttgtgttcacgggcttctcaactatcagtgccatacactgttctccgccctgctcatctctaccacagtgatgagcattctgacccttctgctcctgctggtcaagggcgctaaagaccttgtgaagcgcctcttttactggctgatcacgccgctgtgttggctctccgttttctgcggatggatgatccggagctggaaaagacgcgtgggctctgccatttccagaacaaatgataccatcgggtggcgggacaacagccgcagaggacaagatgtcgagcgggcgcagtatacaggcggggcccctggagctaagtactctttttatggcgtgatgattctggggcttctgggcgaagttcactcctgtagcgagtctatcattgccgactccaaaatcatgcagtgcaccaccagcggatccagcacactctgtaaggcttctggcacggtgatcatgaagctggggcccattggaagcgaatcctgcctgatccttaaaggcctcaaggattctgagaaacaattcattagcatcaagaccatttcctctgaactgacatgccgcgagggggagagcttttggaccacactgtacacccctgtctgtctctcctctagacggtgccatctgatgggagaatgtgtgagcgaccgctgccttaaatggaagacgaatgagacatccgccgagttcaccggcaaggcccacggggaggtgatgcacgaaaacagatgttttgagcagagcggcggaatcggctatgggtgcttcaatgtcaacccctcttgtctgtacgttcattcctacctcaaaagcgtgtataagaatggatttaaaatcttccggtgcgtggcttggaaccaccgcattagactggaggtcaccacacattctcggaagttccctatggtgctgatggcgatgtccacccagcccacagattggggcagcatcgggcttattctcgactccggaggcatcacggggaccaatgcctactcttttatgaaacacggcctggggagcttcgctattatcgatgacccgtattcccctgaacccagaaagggctttctgggggaggttcgctgtcccacagaagagaccgccattcgggccagcccttcttgcaagatggctccgaacctcatcgaataccagcccgagatggatacagccgagtgtaccacgaatatgatcgaccctatggcgattttcaacagaggatccctgccccaagtgcgcgacggcatgacctttacacagagcatcgagaaaaataccgtccaggctcttacaaccggggaggtgcgggcctctattagactgacactcgatgactatgatgttgtgtaccagaacagccaattcgactgctccgccacctttaagaatctgacgggatgctattcttgtgatgaaggcagccgcatgtgctaccaggtcaaagctgagggcgagacaatcttccattttgtgaacgaagacgagtccattaacgttatcaataaggtgtctcctgatgtcagcgactactgtaccgtgctgcacttctcccggcccgtgatcagcattgaagggagatatgattgcggactttctaaacgccctatggtcatcaagggcaccctgattgccacagcgccccacgacgatcggaaacatgaagggggatccagcctcgttgtgaacccgaagggcgggaccgtggactttttcggatgggtctccggcctgacgtcttggctcggcgggcctctgaagacatttcttaccatcctgggattcctcgctctgggcctgcttctggtggttattatcatcattatcgccagaacaggggtggaacaggccctcaaaaagaaaaataagtga

SEQ ID NO: 14709 - RNA, 4014 nt, synthetic construct
  misc_feature 1..4014: note = derived and/or modified CDS sequence (opt5) from TOSV(SI-76082)__EU003180.1__GP
  source 1..4014: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggataatattacagagtccatcggcctgacctctgggacatgcaaggtcggaagcctcgaaaaccgcgagtgtaaaagagatatcatgtccaattatgttgcggaagtgcacagcaacctgcatggcctgggggctatgatgcacaattacggagacgataagcggattgaggtgctcaacgacgtcatccccgatgagctgaatcctggccgccataactgctctgaccttgatagaaaaccgttctggaccgaatttattaatgtggccaagcccgccaacgagatggctcctatgtccgttattccccctcccatcgtgaagcctatcccggtcgccgaaagcacaaccaaaaagacgattcccttcgacgagctgctctctgaggctgaaaaagagctgaatcaaaccaagatccggcttgaaacagagcgcagatccaacgccgaagaggcggccaaagagcgggctcgcatgagagaaatcgaggataagctgcggaaggactgggaactcgagcgcgaaagaaaagatgccgtggctgaggacctggccaaggagattgcgcggcgcagagaaatcgagcggaaagcccacgaactggataagatgctcaaaaagaaagagagagaagacctggttgctcgcgagcgggtggacgaggatatgagaaatcatgtccgccggcctaacaccacaattgcccccaccatcattacgacacttctgatggctagcgccgtgatggccggccctctcgaaaatagagagaccaaccatctgcttaaccgccccgggaatggagcttatacactgtctgactttgcggaatccacctgtaccctcgcctacggcagcgagtgcaagtcctgggagcaccagctggatgaactgtctttcccgtttttccacagcaacctcgacaagtattccatgctggaggctgccacagaaacgatccctatccttaataaaagctctgccgtgtgtaccatttcccccagcacacactctagcaacgcttgcgggcgggaggcctccctgatcaagaaaaagtgtggatctgatatgagcgcgtttttctacgtcaatctcgctggccagattaccgttgtgaaatgcgacacaaaccatgtgctgtccaatgattgtgggaactgcatcagcaagaccctttctggacaaaagatttacacgcctgtccaggacatgttttgccagaaaggctggtccgaaagcatcccctctacaagatattccaaggatctgtgtagcatcggcctccacaccgtgaaagagtgcaagattgggaccacaaatttcgagcgcgttggatttatcgtggtcaaaggccggaagatgtacattgaacagatgaagatgagatcccgccaagagttctctgaagaccagttcctgtgttataaaagcgaggggtcctctggaagctccgtgaagctgaaaaaggttaaagtggaaagctgcaagggcgtcaccacatcttccgccagcaagtgttctggggatgagtacttttgctcccggtatccctgtgagacggccaacgtggaagctcactgcatcctcagacggcatagcgccgtcattgaggtgaatgttaacggagtgtgggtcgtgcctcgctgtatcggctacgaagaggttctggtgagacggacctctcttaaagtcgaagacacaagctccagagagtgcgacacctgtctgtgggagtgcggcaagaataaactcattgtgaagacacacgggccgaaaatcgtgtatgctaccgcctgcagccatggatcttgtaagtccgttatgcagaaacccgcgacgttcgtctacctgccttaccccggcaacagcgaaatcgtgggaggagatattggcgtgcacatgaccgaggaatcctctcctagcaatatccatatggtcgcccactgccccgctaaggactcctgtgaggtgtctagctgcctgttttgtgttcacgggcttctcaactatcagtgccatacactgttctccgccctgctcatttctaccacagtgatgagcatcctgacccttctgctcctgctggtcaagggcgctaaagatcttgtgaagcgcctcttttactggctgatgacgccgctgtgttggctctccgttttctgcggatggatgattcggagctggaaaaagagagtgggctctgccatctcccgcacaaacgacaccatcgggtggagagataatagccggcgcggacaagacgtcgagagagcgcagtatacaggcggggcccctggagctaaatactctttttatggcgtgatgattctggggcttctgggcaacgttcactcctgtagcgaatctatcattgccgattccaagatcatgcagtgcaccaccagcggatccagcacactctgtaaggcttctggcacggtgattatgaaactggggcccatcggaagcgagtcctgcctgatccttaagggcctcaaagactctgaaaagcaattcattagcatcaaaaccatttcctctgagctgacatgccgggaaggggagagcttttggaccacactgtacacccctgtctgtctctcctctcgcagatgccatctgatgggagagtgtgtgagcgatcggtgccttcgctggaagacgaatgaaacatccgccgagttcaccggcaaggcccacggggaagtgatgcacgagaacagatgttttgaacagagcggcggaatcggctatgggtgcttcaatgtcaacccctcttgtctgtacgttcattcctacctcaaaagcgtgtataagaatggatttaaaattttccggtgcgtggcttggaaccaccgcatcagactggaggtcaccacacattctcggaagttccctatggtgctgatggcgatgtccacccagcccacagactggggcagcatcgggcttattctcgattccggaggcatcacggggaccaatgcctactcttttatgaaacacggcctggggagcttcgctattatcgacgatccgtattcccctgagcccagaaagggctttctgggggaagttcgctgtcccacagaggaaaccgccattcgggccagcccttcttgcaagatggctccgaacctcatcgagtaccagcccgaaatggacacagccgagtgtaccacgaatatgattgaccctatggcgatcttcaacagaggatccctgccccaagtgcgcgatggcatgacctttacacagagcatcgagaaaaataccgtccaggctcttacaaccggggaagtgcgggcctctattagactgacactcgacgattatgacgttgtgtaccagaacagccaattcgattgctccgccacctttaagaatctgacgggatgctattcttgtgacgagggcagccgcatgtgctaccaggtcaaagctgaaggcgagacaatcttccattttgtgaacgaggatgaatccattaacgttatcaataaggtgtctcctgacgtcagcgattactgtaccgtgctgcacttctcccggcccgtgattagcatcgaggggagatatgactgcggactttctaaacgccctatggtcatcaagggcaccctgattgccacagcgccccacgatgaccggaaacatgaagggggatccagcctcgttgtgaacccgaagggcgggaccgtggactttttcggatgggtctccggcctgacgtcttggctcggcgggcctctgaagacatttcttaccatcctgggattcctcgctctgggcctgcttctggtggttattatcattatcatcgccagaacaggggtggagcaggccctcaaaaagaaaaataagtga

SEQ ID NO: 14710 - RNA, 4020 nt, synthetic construct
  misc_feature 1..4020: note = derived and/or modified CDS sequence (opt5) from TOSV(TOSV/Mantova.ITA/2013)__KM507329.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaggcctgggataatattacagagtccatcggcctgacctctgggacatgcaaggtcggaagcctcgaaaaccgcgattgtaaaagagacatcatgtccaattatgttgcggaggtgcacagcaacctgcatggcctgggggctatgatgcacaattacggagatgacaagcgggtggaagtcctcaacgatgtgattcccgacgagctgaatcctggccgccataactgctctgatcttgacagaaaaccgttctggaccgagtttatcaatgttgccaagcccgccaacaagattgctcctatctccgtgattccccctcccatcgtcaaacctattccgatcgccgaaagcacaatcaaggagaccattcccttcgaaaaactgctctctgaggctgagaaggaactgaatcaaacgaaaatccggcttgagaccgaacgcagatccaacgccgaggaagcggcccgggagcgcgctagagtgcgggagattgaagataagctgcgcaagaattgggagctcgaaagagagcggaaagacgccgttgctgatgacctggccaaggaaatcgcgcgcagacgggagattgagagaaaagcccacgaactggataagatgctcaaaaagaaagagcgcgaagaccaggtggctatcgagcgggtcagcgaagacatgagaaaccatgtgcgccggcctaatacaaccatcgcccccgctcctacaattatcaccacgctgcttatggcctctgccgtgatggctggccccctggagaacagagagacaaaccacctcctgaatcgcccggggaacggagcgtataccctttccgattttgccgaaagcacatgtaccctggcttacggctccgagtgcaagtcttgggaacaccagctcgacgagctgagcttcccctttttccattccaatctggataagtatagcatgctcgaggccgccaccgaaacaattcctatcctgaacaaatcttccgctgtctgtacgattagcccttctacccacagctccaatgcctgcgggcgggaggcgtctcttatcaagaaaaagtgtggaaacaatatgagcgcctttttctacgttaacctggctggccaaatcacagtggtgaaatgcgacaccaatcatgtcctctccaacgattgtgggaattgctttagcaagacactgtctggacagaagatttacacccccgtgcaggacatgttctgccagagaggctggacggaatccatccccagcacacgctattctaaagatctttgttccattggcctgcacaccgttaaggagtgcaaaaccgggacaaccaactttgaacgggtgggattcatcgtcgttaagagcagaaaaatgtacattgagcaaatgaagatgcgctcccggcaggagttctctgaagaccagtttctctgttataagagcgagtcctctagcggctccagcgttaaactgaagaaagtgaaggtcgaatcttgcaaaggggtgacaacgtccagcgcctctaagtgttccggagatgagtacttctgcagcagatatccttgtgaaaccgctaatgtcgaggcccactgcatcctgcggcgccattctgctgtgattgaggttaacgtgaatggcgtctgggtggttccgagatgtatcgggtacgaagaggtgctcgtccggagaacaagcctgaagatggaagacacctccagccgcgagtgcgatacatgtctttgggaatgcggcaaaaacaagctgatcgtgaaaacccacggacccaagattgtgtatgccacggcgtgctctcatggctcctgtaaaagcgttatgcagaagcctgccacctttgtctacctcccctaccctgggaactccgagatcgtgggaggcgacattggggtgcacatgacagaggaatctagcccctccaatatccatatggtcgctcactgcccggccaaagactcttgtgaggtgagctcctgcctgttctgtgttcacggactgcttaactatcaatgccataccctcttttctgctctgctgattagcacaaccgtgatgtccatcctcacgctgcttctgctcctggtcaagggcgccaaggatctggtgaagaaacttttctactggctcatcacacctctgtgttggctgagcgtgttttgcgggtggatgattaaatcttggaagaaacgggtgggctccgcgatcagcagaaccaatgacacaattggatggcgcgataacagacggtatggccgcgacgtcgaaagagcccagtacaccgggggagctcccggcgccaagtattctttctacggggtgatgatcctcggactgcttggcaatgttcactcctgtagcgagtctgtgattgctgattccaaggtcatgcagtgcaccacaagcgggtccagcacgctgtgtaaagcctctggcaccgtgatcatgaagctcggacctatcggcagcgagtcctgcctgattctgaaagggcttaaggacaacgaaaaacaatttatctctattaagacaatcagctccgagctgacctgccgggaaggagagtctttctggacaaccctctatacgcccgtgtgtctgagctcccgcagatgccatctcatgggcgaatgtgtctctgatcggtgcctgaagtggaaaacaaatgagaccagcgccgagtttaccgggaaggctcacggagaagttatgcacgagaaccgctgtttcgaacagtccggcgggattggctacggatgctttaatgtgaaccctagctgtctttacgtgcattcttatctgaaatccgtctacaagaatggcttcaaaatcttcagatgcgtggcgtggaaccaccggatccgcctcgaggttacaacccatagcagaaagtttcccatggtgctgatggccatgtctacacagccgacggactgggggtccattggactgatccttgatagcgaaggcattaccgggacaaatgcttattccttcatgaagcacggatctggcagctttgccatcattgacgatccttactcccccgagccccggaaagggttcctcggcgaggtcagatgtcctaccgaagagacagccatccgcgctagcccgtcttgcaagatggcccccaacctgattgaatatcagcctgagatggacaccgcggaatgtacgaccaatatgatcgatcccatggctatctttaaccggggatccctgcctcaagtgagagacggcatgacattcacccagagcattgagaaaaacacagttcaggccctcaccacaggggaggtgcgcgcctctatccggctgacccttgacgattacgacgtcgtgtatcagaatagccaatccgattgctctgctacgtttaagaacctgacaggatgctacagctgtgacgaaggctccagaatgtgctaccaggttaaagccgagggggaaaccattttccattttgtgaatgaggatgagtctatcaacgtcattaataaggtgagccccgacgtgtccgattattgtaccgtcctccacttcagccgccctgttatctctatcgaaggacggtacgactgcggcctgtccaaaagacccatggtgattaagggcacactgatcgcgaccgctccgcacgatgaccgcaagcatgaagggggaagctcccttgtggtcaaccctaaaggcgggacggtggactttttcggatgggtttctggcctgacaagctggctcgggggacccctgaagacctttctcacaattctgggcttccttgccctgggcctcctgctggtggtcatcattatcatcattgcccggaccggggtgcagcaggctcttaaaaagaaaaataagtga

SEQ ID NO: 14711 - RNA, 4020 nt, synthetic construct
  misc_feature 1..4020: note = derived and/or modified CDS sequence (opt5) from TOSV(TOSV/Phl.233/FR/2009)__HQ184337.1__GP
  source 1..4020: mol_type = other RNA
atgttcatcgccaagctgctcctgattagctgccttgtgcagcaggcttacctgaaatataccatcatttccgagacaggcaacgggacgagaacctctttttgttacagctcccggacatctctcggaagcctgcttgaagcctgggacaatgtcaccgagtccatcggcctgacatctgggacctgcaaggttggaagcctcgaaaaccgcgattgtagaaaagacattatgtccaattatgtggcggaggtgcacagcaacctgcatggcctgggggctatgatgcacaattacggagatgacaagcgggtcgaaatcctcaacgatgtgatccccgacgagctgaatcctggccatcacaactgctctgatcttgaccgcaaaccgttctggacagagtttattaatgttgccaagcccctgtccgaaatcgtgcctatgagcgtcattccccctcccgtggttaagcctcaaccgcccgccgagccttcttccaaaaagcatgtgcccttcgatgtcctcctgagcgaagctgagaaagagcttaaccagaccaagatcagactggaagacgagcggaaatctaatgccgaagagacggctaaggaacgcgccagaatgaaggagattgaggatgaactccggcgcgagtgggaactggagagaaaacggaaggacgcgatggccgatgacctggctaaagaaaccgcccgcagacgggagatcgagcgcaaggctcacgaactcgacaaaatgctgaagaaaaaggagagagaatcccttattgccaaggagaaagcggatgaagacatgcggagccacgtgcataagcctaacacaaccagagcccccgctccgacaatcatcaccacgctgctcatggcctccgctgccctggccggccctcttgagaatcgcgagacaaaccatctgctcaatcggcccgggaacggagcttataccctgtctgattttgcggaaagcacatgtaccctggcctacggctccgagtgcaaaagctgggaacacctcctgaacgaggagcttttcccctttttccactctaatctggacaagtattccatgctcgaagctgccaccgagacagtgcctattctgaacaaaagctctgccgtctgtacgatcagcccctccacccactctagcaatgcttgcgggagagaagcctccgttattcgcaagaagtgttacagcaacatgtctgcgtttttctacatcaatcttgctggacagattacagtgatcaaatgcgagaccaaccatgtgctgtccagcgattgtggcaattgcatctctaagtccctcagcgggcaaaaagtctatacacctgtgcaggacgtgttttgccagaagggatggacccagtccattccgtctacgcggtacagcaaagatatctgttccattggcctgcacacagtgaaggaatgcaagatcggcaccacctctttcgagagagtcgggtttattgtggttaaaggacgcaagatgtatatcgagcaaatgaaaatgcggagcagacaggaatactccgaggaccagttcctgtgttataagagcgaatctggctccgggagctctgtgaaactcaagaagttcaaagtccagtcctgcaagggagtgacaaccagctctgccagcaaatgttccggcgatgagtacttttgcagccgctatccctgtgaaacagccaacgtcgaggctcattgcatcctgcggagacactctgccattgtggaggttaatgtgaacggggtctgggtggttcctcgctgtatcggatacgaagaggtgcttgtcaagcggacgtccctgaaagtggaagacaccacaggcagagagtgcgatagctgtctctgggaatgcggcaagaataaactgattgtgaagacccatgggcccaaggttgtctacgctacagcctgctcccacggatcttgtaaaagcgtgatgcaaaagcctgcgaccttcgtgtatctgccctacccgggcaactccgagatcgtcgggggagacattggcatccacatgacggaggaatctagcccttccaatattcatcttgtggcccactgccccgctcgggactcttgtgatgttagcgactgcctcttttgtgtgcatgggctgctgaactatcagtgccacaccctcttctccgccctgcttatcagcacaaccgtcatgtctatcctgacactcctgctgcttctcgtgaaaggcgctaaggatctggttaaaaagctgtttcactggctcattacccctctgtgttggctttccgtgttctgctgttgggtcgttaagagctggaaacgcagagttggatctgccatctcccggacgaatgacacaattggctggagagagaaccgccggcatgcgcaggatatcgaaagagcccaatacaccgggggagctcccggcgccaagtatagcttttacggggtgatgattctgggactcctgtcttccgctcagagctgctccgagagcgtcatcgccgactctaaaatcatgcagtgtacaaccagcggctcctctaccctgtgcaaggccagcgggacagtgattatgcgccttggccctatcggatccgagtcttgcctcattctgaaaggcctgaaggatagcgaaaagcagttcatctccattaaaacgatctctagcgagctcacctgtagagaaggggagtccttttggacaaccctgtatacacccatctgccttagctctcggcgctgtcacctgatgggagaatgcgtgtccgacagatgtctcaagtggaaaaccaaccaaacgagcgctgagttcacaggcaaggcgcatggggatgtcatgcacgagaatcggtgctttgaacagtctggaggcattgggtacggctgtttcaacgttaatccgtcctgcctgtacgtgcatagctatctgaaatccgtgtaccgcaacggatttaaggtcttcagatgtgtggcctggaatcaccggatccgccttgaggttaccacccactctagaaagttccctatggtgctcatggctatgagcacacagcccaccgactggggctccattgggctgatcctggatagcgaaggaattacaggcacgaactcttattcctttatgaaacatgggagcggatctttcgccatcatcgacgatccctacagccctgagccgcggaagggctttctcggggaagtccgctgccccaccgaggagacagccatgagagcttccccttcttgtaaaatggcccccaatctgattgaatatcagcctgagatggacaccgcggaatgcacaaccaacatgatcgaccccatggctattttcaatcggggcagccttcctcaagtgagagatggaatgacgtttacccagtccatcgagaagaacacagttcaggccctgaccacaggcgaagtgaaagcctctattcgcctcaccctggacgattacgacgtcgtgtatcagaatagccaatccgattgcagcgctacattcaagaacctgaccgggtgttactcttgcgacgagggatcccggctttgttaccaggttaaagccgagggcgaaacgatctttcacttcattaatgaggaagagagcatcaacgtgatcaataaggtctcccccggggtgtctgattattgcacagtgctgcattttagcagaccggtcatttccatcgagggaacctacgactgtggcctctctaagcgccctatggttattaaaggcaccctgatcgcgacagctccccacgatgaccggaagcatgaagggggaagctccctcgtggtgaaccctaaaggcgggagcgtcgatttctttggatggctgtctggccttacctcctggctcgggggacccctgaagacgttcctgacaattctgggctttcttgccgtgggcctgctcctggttgtgatcatcattatcattatcagaaccgggatgcagcaggccctcaaaaagaagattaaatga

SEQ ID NO: 14712 - RNA, 4020 nt, synthetic construct
  misc_feature 1..4020: note = derived and/or modified CDS sequence (opt5) from TOSV(TOSV/Phl.51/FR/2009)__HQ184336.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatgtcacagagtccattggcctgacctctgggacatgcaaggttggaagcctcgaaaaccgcgattgtagaaaagacatcatgtccaattatgtggcggaggtgcacagcaacctgcatggcctgggggctatgatgcacaattacggagatgacaagcgggtcgaaatcctcaacgatgtgattcccgacgagctgaatcctggccatcacaactgctctgatcttgaccgcaaaccgttctggaccgagtttatcaatgttgccaagcccctgtccgaaattgtgcctatgagcgtcattccccctcccgtggttaagctccaacctccggccgagccctcttccaaaaagcatgtgcctttcgatgtcctgcttagcgaagctgagaaagagctgaaccagacaaagatcagactcgaagacgagcggaaatctaatgccgaagagaccgctaaggaacgcgccagaatgaaggagatcgaggatgaactgcggcgcgagtgggaactggagagaaaacggaaggacgcgatggccgatgacctcgctaaagaaacggcccgcagacgggagattgaccgcaaggctcacgagctggatagaatgcttaaaaagaaagaacgggagtccctgatcgccaaggaaaaggcggacgagaacatgagaagccacgtgcatgaacccaataccacacgcgcccctgctcccaccatcattacaaccctcctgatggcctccgctgcccttgccggcccgctggagaaccgggagacgaatcacctcctgaacagacctgggaacggagcttatacactgtctgattttgcggaaagcacctgtacactcgcctacggctccgagtgcaaaagctgggaacatctgcttaatgaggagctgttcccctttttccactctaacctcgacaagtattccatgctggaagctgccaccgagaccgtgcctatccttaataaaagctctgccgtctgtacaattagcccctccacgcactctagcaacgcttgcgggcgcgaagcctccgttatccggaagaaatgttacagcaatatgtctgcgtttttctacattaacctggctggacagatcaccgtggtgaagtgcgagacaaatcatgtcctctccagcgattgtggcaactgcatctctaagtccctgagcgggcaaaaagtgtatacccccgttcaggacgtgttttgccagaagggatggacacagtccattccttctaccagatacagcaaagatatctgttccattggcctgcacacggtcaaggaatgcaaaatcggcacaacctctttcgagcgcgtggggtttattgttgtgaagggacggaagatgtatatcgagcaaatgaaaatgagaagccgccaggaatactccgaggaccagttcctctgttataagagcgaatctggctccgggagctctgtcaaactgaagaaattcaaggtggagtcctgcaagggagtcaccacaagctctgccagcaaatgttccggcgatgaatacttttgcagccggttcccgtgtgagaccgccaatgtggaggctcattgcatccttagacgccactctgccattgttgaagtgaacgtcaatggggtgtgggttgtgccccggtgtatcggatatgaggaagtcctggtgaagagaacatccctcaaagtggaggacacgaccgaacgggagtgcgatagctgtctgtgggagtgcggcaagaacaaactgattgttaagacacatggccctaaagtcgtgtacgctaccgcctgctcccacgggtcttgtaagagcgtgatgcagaagcccgcgacatttgtctaccttccttatcccggaaattccgaaatcgtgggcggggacattggaatccacatgaccgaggaatctagcccgtccaacattcatctcgttgcccactgccctgctcgcgactcttgtgatgtgagcgactgcctgttctgtgtccatggcctgctcaattaccaatgccacacgctgttttccgcccttctgatcagcaccacagtgatgtctatcctcaccctgctgcttctcctggttaaaggggctaaggatctggtgaaaaagctgttccactggctcattacacccctttgttggctgtccgtcttttgctgttgggtggttaaaagctggaagagacgggtgggctctgccatctccagaaccaacgacacgattggatggcgcgagaaccggagacatgcgcaggatatcgagcgcgcccagtatacaggcggggctcctggagccaagtacagcttctttggcgtcatgattctcgggctgctgtcttccgctcaaagctgctccgaaagcgtgatcgccgactctaaaatcatgcagtgtaccacaagcggatcctctaccctttgcaaggccagcggcaccgtgattatgagactcgggcccatcggctccgagtcttgcctgattctgaaaggactcaaggatagcgaaaaacagttcatctccattaagacaatctctagcgagctgacgtgtcgggaaggcgagtccttttggaccacactttatacccctatctgcctgagctctcgcagatgtcacctcatgggggagtgcgtctccgaccggtgtctgaagtggaaaacaaatcagaccagcgctgagttcacgggaaaggcgcatggcgatgttatgcacgaaaaccgctgctttgaacaatctgggggaattggctacgggtgtttcaatgtgaacccctcctgcctgtatgtgcatagctaccttaaatccgtctacagaaatggcttcaaggtgtttcggtgtgttgcctggaaccaccgcatcagactcgaggtgacaacccactctcggaaattcccgatggtcctgatggctatgagcacccagcctacagactggggatccattggcctgatcctcgatagcgaagggattaccggaacaaattcttattcctttatgaagcatggcagcgggtctttcgccatcatcgacgatccctacagccccgagcctcgcaagggatttctgggcgaggtgagatgcccgacggaagagaccgccatgcgggcttccccctcttgtaaaatggcccctaaccttgttgaatatcagcccgagatggacacagcggaatgcaccacaaatatgattgaccctatggctatcttcaacagagggagcctgccccaggtgcgcgatggcatgacctttacgcaatccattgagaagaataccgtccaggccctcacaaccggagaggtgaaagcctctatccggctgacactggacgattacgacgttgtgtatcagaacagccagtccgattgcagcgctaccttcaagaatcttacaggctgttactcttgcgacgaagggtccagactgtgttatcaagtcaaagccgagggagaaaccatttttcacttcatcaacgaggaggaaagcattaatgtgatcaacaaggtgtcccctcgcgtctctgattactgcacggttctccattttagccggcccgtgatctccattgagggcacatacgactgtgggctgtctaaaagaccgatggtgatcaagggaaccctcattgcgaccgctcctcacgatgaccgcaagcatgaaggcggcagctccctggtcgtgaaccccaaagggggaagcgttgatttctttggctggctttctgggctgacatcctggctcggaggccctctgaagaccttcctgacgatccttgggttcctggccgtgggactcctgctcgtcgtgattatcatcattatcattcggacaggcatgcagcaggccctgaaaaagaaaatcaagtga

SEQ ID NO: 14713 - RNA, 4020 nt, synthetic construct
  misc_feature 1..4020: note = derived and/or modified CDS sequence (opt5) from TOSV(11368)__KU925897.1__GP
  source 1..4020: mol_type = other RNA
atgttcatcgccaagctgctcctgattagctgccttgtgcagcaggcttacctgaaatataccatcatttccgagacaggcaacgggacgagaacctctttttgttacagctcccggacatctctcggaagcctgcttgaagcctgggacaatgtcaccgagtccatcggcctgacatctgggacctgcaaggttggaagcctcgaaaaccgcgattgtagaaaagacattatgtccaattatgtggcggaggtgcacagcaacctgcatggcctgggggctatgatgcacaattacggagatgacaagcgggtcgaaatcctcaacgatgtgatccccgacgagctgaatcctggccatcacaactgctctgatcttgaccgcaaaccgttctggacagagtttattaatgttgccaagcccctgtccgaaatggtgcctatgagcgtcatccctcctcccgtggttaagctccaacctccggccgagccctcttccaaaaagcatgtgcctttcgatgtcctgcttagcgaagctgagaaagagctgaaccagaccaagattagactcgaagacgagcggaaatctaatacggaagagaccgccaaggaacgcgctagaatgaaggagatcgaggatgaactgcggcgcgagtgggaactggagagaaaacggaaggacgccatggcggatgacctcgccaaagaaacagctcgcagacgggagattgagcgcaaggcccacgaactggacaaaatgcttaagaaaaaggagagagaatccctgatcgctaaggagaaagccgatgaagacatgcggagccacgtgcataagcccaacaccacaagagcgctcgcccctaccattatcacgacactgcttatggcttccgccgctctggccggccccctcgagaatcgcgagaccaaccatctgctgaatcggccggggaacggagcctatacactctctgattttgctgaaagcacctgtaccctggcgtacggctccgagtgcaaaagctgggaacaccttctgaacgaggaactcttcccctttttccactctaatctggacaagtattccatgcttgaagccgctacagagacggtgcccatcctgaacaaaagctctgccgtctgtaccattagcccttccacacactctagcaatgcctgcgggagagaggcttccgttatccgcaagaagtgttacagcaacatgtctgcctttttctacattaatctcgcgggacagatcaccgtgattaaatgcgagacaaaccatgtgctgtccagcgattgtggcaattgcatctctaagtccctgagcgggcaaaaagtctatacccccgtgcaggacgtgttttgccagaagggatggacgcagtccatcccctctacacggtacagcaaagatatttgttccatcggcctccacaccgtgaaggaatgcaagattggcaccacatctttcgagagagtcgggtttatcgtggttaaaggacgcaagatgtatattgagcaaatgaaaatgcggagcagacaggaatactccgaggaccagttcctgtgttataagagcgaatctggctccgggagctctgtgaaacttaagaagttcaaagtccagtcctgcaagggagtgaccacaagctctgctagcaaatgttccggcgatgagtacttttgcagccgctatccttgtgaaacggccaacgtcgaggcccattgcatcctgcggagacactctgctatcgtggaggttaatgtgaacggggtctgggtggttccgcgctgtattggatacgaagaggtgctcgtcaagcggacctccctgaaagtggaagacacaaccggcagagagtgcgatagctgtctgtgggaatgcggcaagaataaacttatcgtgaagacacatgggcccaaggttgtctacgccaccgcttgctcccacggatcttgtaaaagcgtgatgcaaaagcctgccacgttcgtgtatctcccctaccctggcaactccgagattgtcgggggagacatcggcattcacatgaccgaggaatctagcccctccaatatccatctggtggcgcactgcccggcccgggactcttgtgatgttagcgactgcctgttttgtgtgcatgggctcctgaactatcagtgccacacacttttctccgctctgctcattagcaccacagtcatgtctatcctgaccctgcttctcctgctggtgaaaggcgccaaggatctcgttaaaaagctgtttcactggcttatcacgcctctgtgttggctctccgtgttctgctgttgggtcgttaagagctggaaacgcagagttggatctgctatttcccggacaaatgacaccatcggctggagagagaaccgccggcatgcccaggatattgaaagagcgcaatacacagggggagcccccggcgctaagtatagcttttacggggtgatgatcctgggactgctttcttccgcccagagctgctccgagagcgtcattgctgactctaaaatcatgcagtgtaccaccagcggctcctctacactctgcaaggccagcgggacggtgatcatgcgcctgggccctattggatccgagtcttgcctgatcctcaaaggcctgaaggatagcgaaaagcagttcatttccatcaaaaccatttctagcgagcttacatgtagagaaggggagtccttttggaccacactgtatacccccatctgcctcagctctcggcgctgtcacctgatgggagaatgcgtgtccgacagatgtctgaagtggaaaacgaaccaaacaagcgccgagttcaccggcaaggctcatggggatgtcatgcacgagaatcggtgctttgaacagtctggaggcatcgggtacggctgtttcaacgttaatccttcctgcctttacgtgcatagctatctcaaatccgtgtaccgcaacggatttaaggtcttcagatgtgtggcgtggaatcaccggattcgcctggaggttaccacacactctagaaagttccccatggtgctgatggccatgagcacccagccgacagactggggctccatcgggctcattctggatagcgaaggaatcacgggcaccaactcttattcctttatgaaacatgggagcggatctttcgctattatcgacgatccttacagccccgagccccggaagggctttcttggggaagtccgctgccctacagaggagaccgccatgagagcctccccgtcttgtaaaatggctcccaatctgatcgaatatcagcctgagatggacacagccgaatgcaccacgaacatgattgaccccatggcgatcttcaatcggggcagcctccctcaagtgagagatggaatgacctttacacagtccattgagaagaacaccgttcaggctctgacaaccggcgaagtgaaagcctctatccgcctgattcttgacgattacgacgtcgtgtatcagaatagccaatccgattgcagcgccacattcaagaacctgaccgggtgttactcttgcgacgagggatcccggctctgttaccaggttaaagctgagggcgaaacgatctttcacttcattaatgaggaagagagcatcaacgtgatcaataaggtctcccccggggtgtctgattattgcacagtgctgcattttagcagacctgtcatttccatcgagggaacctacgactgtggcctctctaagcgccccatggttattaaaggcaccctgatcgccacagcgccgcacgatgaccggaagcatgaagggggaagctcccttgtggtgaaccctaaaggcgggagcgtcgatttctttggatggctgtctggcctcacctcctggcttgggggacccctgaagacgttcctgacaattctgggctttctcgctgtgggcctgctcctggttgtgatcatcattatcattatcagaaccgggatgcagcaggcccttaaaaagaagattaaatga

SEQ ID NO: 14714 - RNA, 4020 nt, synthetic construct
  misc_feature 1..4020: note = derived and/or modified CDS sequence (opt5) from TOSV(5904242804)__KU935737.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatattacagagtccatcggcctgacctctgggacatgcaaggtcggaagcctcgaaaaccgcgattgtaaaagagacatcatgtccaattatgttgcggaggtgcacagcaacctgcatggcctgggggctatgatgcacaattacggagatgacaagcgggtggaagtcctcaacgatgtgattcccgacgagctgaatcctggccgccataactgctctgatcttgacagaaaaccgttctggaccgagtttatcgatgttgccaagcccacaaataagattgcccctatgtccgtgatccctcctcccattgtcaaacctatcccggtggctgaaagcaccattaagaaatctatccccttcgacaagctgctctccgaggccgaaaaagagctgaaccagacgaagatccggcttgagaccgaacgcagaagcaatgctgaggaagccgcgaaggagcgggcccgcatgagagaaattgaggataaactgcggaaggactgggagctcgaacgcgagagaaaagatgctgttgccgacgacctggctaaggaaatcgcccggcgcagagagattgaacggaaagcgcacgagctggataagatgctcaaaaagaaggagagagaagacctggtggcccgcgagcgggtctctgaagatatgagaaaccatgtgcgcaaacctaatacaaccatcgctcccgcccctacaattatcaccacgcttctgatggcttccgccgtgatggccggccccctcgagaaccgggaaacaaatcatctgcttaacagaccggggaacggagcttataccctgagcgactttgcggagtccacatgtaccctcgcctacggctctgagtgcaagagctgggaacaccagctggatgagctgtccttcccctttttccacagcaatctcgacaaatattctatgctggaagctgccaccgagacaatccccattcttaacaagtccagcgccgtctgtacgatctctcctagcacccactcctctaatgcttgcgggcgcgaggccagcctgattaaaaagaagtgtggatccaacatgagcgcgtttttctacgttaatctcgctggccagatcacagtggtgaaatgcgataccaaccatgtcctgtctaatgactgtgggaactgcatttccaagacacttagcggacagaaaatctacacccccgtgcaagatatgttttgccagaagggctggacggaatctatccccaatacacggtattccaaagacctgtgtagcattggcctccacaccgttaaggagtgcaagaccgggacaaccaacttcgaaagagtgggatttatcgtcgtggagggccgcaaaatgtacattgaacagatgaagatgcggtccagacaagagttctctgaggatcagttcctgtgttataaaagcgaatcctctagcgggtccagcgttaagctgaaaaaggtgaaggtcgagtcttgcaaaggagtgacaacgtccagcgcctctaagtgttccggcgacgaatacttttgcagccgctatccttgtgagaccgccaatgtcgaagctcactgcatcctccggagacattctgccgtgattgaggttaacgtgaatggggtctggatcgtgccgcggtgtattggatacgaggaagttctggtgcgcagaacaagccttaaagtcgaggacacctccagccgggaatgcgatacatgtctgtgggagtgcggcaagaacaaactcatcgtgaagacccacggccccaaaatcgtgtatgctacggcctgctctcatgggtcctgtaagagcgttatgcagaagcctgcgaccttcgtctacctgccctaccctggaaattccgaaattgtgggcggggacatcggagtgcacatgacagaggagtctagcccctccaacattcatatggtcgcccactgcccggctaaagattcttgtgaagtgagctcctgcctgttttgtgttcacggccttctcaactatcagtgccataccctgttctctgccctgctcatcagcacaaccgtgatgtccattctgacgcttctgctcctgctggtcaagggggctaaagaccttgtgaagagactcttttactggctgatcacacctctgtgttggctcagcgttttctgcggctgggtgatcaaatcttggaagaagcgcgtcggatccgccattagccggaccaatgatacaatcggctggagagacaaccgcagatatcggcaagatgtggagcgcgcgcagtacaccgggggagcccccggcgctaaatattctttttacggggttatggtgctgggacttctgggcaatgtccactcctgtagcgaatctattatcgccgactccaagattatgcagtgcaccacaagcgggtccagcacgctctgtaaggcttctggcaccgtgatcatgaaactgggacctatcggcagcgagtcctgcctgattcttaaagggctcaaggattctgagaagcaattcatcagcattaaaacaatctcctctgaactgacctgcagagagggagagagcttttggacaaccctgtatacgcccgtgtgtctctcctctcggcgctgccatctgatgggcgaatgtgtcagcgacagatgccttaagtggaaaacaaacgaaacctccgccgagttcaccgggaaggcccacggagaggttgtgcacgaaaatcggtgttttgagcagagcggcgggattggctacggatgcttcaacgtgaatccttcttgtctgtacgtccattcctatctcaaaagcgtgtacaagaacggctttaagatcttccgctgcgttgcttggaatcacagaatccggctggaagtgacaacccattctcgcaaattccccatggtcctgatggcgatgtccacacagccgacggattgggggagcattggacttatcctcgactccgagggcattaccgggacaaacgcctattcttttatgaagcacggaagcggctccttcgctatcattgatgacccttacagccccgaacccagaaaagggtttctgggcgaggtgcggtgtcctaccgaggaaacagccatcagagcctctccgtcctgcaagatggctcccaatctgattgagtatcagcctgaaatggacaccgccgagtgtacgaccaacatgatcgatcccatggcgatcttcaatcgcggaagcctccctcaagttcgggacggcatgacatttacccagtctattgagaaaaacacagtgcaggctctgaccacaggggaagtcagagccagcatccgccttaccctggatgactacgatgtggtttatcaaaattcccaatctgactgcagcgccacgttcaagaacctcacaggatgctactcctgtgatgagggctctcggatgtgctaccaggtgaaagctgaaggggagaccatttttcatttcatcaacgaagacgagagcattaatgtcatcaacaaggtgaatcccgatgtgtccgactattgtaccgtcctgcactttagcagacctgttatctctattgagggacgctacgattgcggcctgtccaagcggcccatggtgatcaaaggcacacttattgccaccgcgccgcacgacgatagaaagcatgaagggggaagctccctgatcgtgaaccctaaaggcgggacggtcgacttctttggatgggtgtctggcctcacaagctggctcgggggacccctgaagaccttcctgacaattcttggctttctggctctcggcctgctgcttgttgtgatcatcattatcattgcccgcaccggggtccagcaggccctgaaaaagaagaataaatga

SEQ ID NO: 14715 - RNA, 4020 nt, synthetic construct
  misc_feature 1..4020: note = derived and/or modified CDS sequence (opt5) from TOSV(5963930705)__KU935734.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatgtcacagagtccattggcctgacctctgggacatgcaaggttggaagcctcgaaaaccgcgattgtagaaaagacatcatgtccaattatgtggcggaggtgcacagcaacctgcatggcctgggggctatgatgcacaattacggagatgacaagcgggtcgaaatcctcaacgatgtgattcccgacgagctgaatcctggccatcacaactgctctgatcttgaccgcaaaccgttctggaccgagtttatcaatgttgccaagcccctgggcgaaattgtgcctatgtccgtcattccccctcccgtggttaagctccagcctccggccgagcccagctctaaaaagcatgtgcctttcgatgtcctgctttccgaagctgagaaagagctgaaccagacaaagatcagactcgaagacgagcggaaaagcaatgccgaagagaccgctaaggaacgcgccagaatgaaggagatcgaggaggagctgcggcgcgaatgggagctggaaagaaaacggaaggatgcgatggccgacgatctcgctaaagagacggcccgcagacgggagattgaacgcaaggctcacgagctggacagaatgcttaaaaagaaagaacgggagtctctgatcgccaaggaaaaggcggacgaggatatgagatcccacgtgcataaacccaacaccacacgcgcccctgctcccaccatcattacaaccctcctgatggccagcgctgcccttgccgggccgctggagaatcgggaaacgaaccacctcctgaatagacctggaaacggcgcttatacactgtccgactttgcggagtctacctgtacactcgcctacgggagcgaatgcaagtcctgggagcatctgcttaacgaggaactgttcccctttttccacagcaatctcgataaatattctatgctggaggctgccaccgaaaccgtgcctatccttaacaagtccagcgccgtctgtacaatttctcccagcacgcactcctctaatgcttgcggacgcgaggccagcgttatccggaaaaagtgttactccaacatgagcgcgtttttctacattaatctggctggccagatcaccgtggtgaagtgcgaaacaaaccatgtcctctcttccgactgtgggaattgcatcagcaaatctctgtccggacaaaaggtgtatacccccgttcaggatgtgttttgccagaaaggctggacacagagcattccttccaccagatactctaaggacatctgtagcattggcctgcacacggtcaaagagtgcaagatcgggacaacctccttcgagcgcgtgggatttattgttgtgaagggccggaaaatgtatatcgaacaaatgaagatgagatctcgccaggagtacagcgaagatcagttcctctgttataaatccgagagcgggtctggatccagcgtcaagctgaaaaagttcaaggtggaatcttgcaaaggcgtcaccacatccagcgcctctaagtgtagcggggacgagtacttttgctcccggtatccgtgtgaggccgctaacgtggaagcccattgcatccttagacgccacagcgctattgttgaggtgaatgtcaacggagtgtgggttgtgccccggtgtatcggctacgaagaggtcctggtgaaaagaacctctctcaaggtggaagatacaacggagcgggagtgcgactcctgtctgtgggaatgcggcaaaaataagctgattgttaaaacccatgggcctaaggtcgtgtacgccacagcgtgcagccacggatcctgtaagtctgtgatgcagaaacccgccaccttcgtctatcttccttaccccggcaacagcgagatcgtgggaggagatattggcatccacatgacagaagagtcctctccgagcaatattcatctcgttgctcactgccctgcccgcgactcctgtgacgtgtctgattgcctgttttgtgtccatgggctgctcaactatcaatgccacaccctgttcagcgcccttctgatctccacgaccgtgatgagcatcctcacactgctgcttctcctggttaagggcgctaaagacctggtgaagaaactctttcactggctgattacgcccctttgttggctgtctgtcttctgctgttggatggtgaagtcctggaagagacgggttggaagcgcgatctctagaacaaatgataccattggctggcgcgagaaccggagacatgcccaggacatcgaacgcgctcagcacaccgggggagcccctggcgctaaatactccttttatggggtgatgattctcggactgctgagctctgcccaatcctgcagcgagtccgtcatcgccgatagcaagatcatgcagtgtacaacctctggcagctccacactttgcaaggcttctgggaccgtgattatgagactcggccccatcggaagcgaatcctgcctgattctgaaaggcctcaaagactctgagaagcagttcatcagcattaagaccatctcctctgaactgacatgtcgggagggggagagcttttggacgaccctttacacacctatctgcctgtccagccgcagatgtcatctcatgggagaatgcgtgtctgatcggtgtctgaaatggaagaccaaccagacatccgcggagttcaccggcaaagcccacggggacgtcatgcatgaaaatcgctgctttgagcaaagcggaggcattgggtatggctgtttcaacgttaatccctcttgcctgtacgtgcactcctaccttaagagcgtgtatagaaacggatttaaagtcttccggtgtgtggcttggaatcaccgcatcagactcgaagttacgacacattcccggaagttcccgatggtgctgatggccatgtctacccagcctaccgattggggcagcattgggctgatcctcgactccgagggaattacaggcaccaacagctactcttttatgaagcacgggtccgggagcttcgccatcatcgatgacccctattctcccgagcctcgcaaaggctttctgggggaagtcagatgcccgacagaggaaacggctatgcgggccagcccctcctgtaagatggcgcctaatcttattgagtaccagcccgaaatggataccgctgagtgcacaaccaacatgatcgaccctatggccattttcaatagaggctctctgccccaggtgcgcgacggaatgacatttacccaaagcatcgagaaaaacacggttcaggccctcaccacaggcgaagtgaaggcttccattcggctgaccctggatgactatgatgtcgtgtaccaaaattctcagagcgactgctccgccacattcaaaaaccttaccgggtgttatagctgcgatgagggatctagactgtgttaccaagttaaggcggaaggcgagacaatctttcatttcattaatgaggaagagtccatcaacgtgatcaataaagtcagccctggggtgtccgactactgcaccgtgctccacttttctagccccgtcatttccatcgaaggaacgtatgattgtggcctgtctaagcgcccgatggttattaagggcacactcatcgctaccgcccctcatgacgatcggaaacacgaagggggaagctccctggtggtgaaccccaagggcgggagcgtcgacttctttggatggctttctggcctgacctcctggctcgggggacctctgaaaacattcctgaccattcttggctttctggccgtgggcctcctgctcgttgtgatcatcattatcattatcagaacggggatgcagcaggctctgaagaaaaagattaagtga

SEQ ID NO: 14716 - RNA, 4020 nt, synthetic construct
  misc_feature 1..4020: note = derived and/or modified CDS sequence (opt5) from TOSV(H4906)__KU922125.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggataatgtcacagagtccattggcctgacctctgggacatgcaaggttggaagcctcgaaaaccgcgattgtagaaaagacatcatgtccaattatgtggcggaggtgcacagcaacctgcatggcctgggggctatgatgcacaattacggagatgacaagcgggtcgaaatcctcaacgatgtgattcccgacgagctgaatcctggccatcacaactgctctgatcttgaccgcaaaccgttctggaccgagtttatcaatgttgccaagcccctgtccgaaattgtgcctatgagcgtcatccctcctcccgtggttaagcctcaaccgcccgccgagccttcttccaaaaagcatgtgcccttcgatgtcctcctgagcgaagctgagaaagagcttaaccagacaaagattagactggaagacgagcggaaatctaatgccgaagagaccgctaaggaacgcgccagaatgaaggagatcgaggatgaactccggcgcgagtgggaactggagagaaaacggaaggacgcgatggccgatgacctggctaaagaaacggcccgcagacgggagattgagcgcaaggctcacgaactcgacagaatgctgaaaaagaaagagcgggaatcccttatcgccaaggagaaggcggatgaagacatgagaagccacgtgcataaacctaacaccacacgcgcccccgctccgaccatcattacaaccctgctcatggcctccgctgccctggccggccctcttgagaatcgggagacgaaccatctgctcaatagacccgggaacggagcttatacactgtctgattttgcggaaagcacctgtacactggcctacggctccgagtgcaagagctgggaacacctcctgaacgaggagcttttcccctttttccactctaatctggacaaatattccatgctcgaagctgccaccgagaccgtgcccatcctgaacaagagctctgccgtctgtacaattagcccctccacgcactctagcaatgcttgcgggcgcgaagcctccgttatccggaaaaagtgttacagcaacatgtctgcgtttttctacattaatcttgctggacagatcaccgtggtgaagtgcgagacaaaccatgtcctgtccagcgattgtggcaattgcatctctaaatccctcagcgggcaaaaggtgtatacccctgttcaggacgtgttttgccagaaaggatggacacagtccattccgtctaccagatacagcaaggatatctgttccattggcctgcacacggtcaaagaatgcaagatcggcacaacctctttcgagcgcgtggggtttattgttgtgaagggacggaaaatgtatatcgagcaaatgaagatgagaagccgccaggaatactccgaggaccagttcctgtgttataaaagcgaatctggctccgggagctctgtcaagctcaaaaagttcaaggtggagtcctgcaaaggagtcaccacaagctctgccagcaagtgttccggcgatgaatacttttgcagccggttcccctgtgagaccgccaacgtggaggctcattgcatcctgagacgccactctgccattgttgaagtgaatgtcaacggggtgtgggttgtgcctcggtgtatcggatatgaggaagtccttgtgaaaagaacatccctgaaggtggaggacacgaccgaacgggagtgcgatagctgtctctgggagtgcggcaaaaataagctgattgttaaaacacatggccccaaggtcgtgtacgctaccgcctgctcccacgggtcttgtaagagcgtgatgcagaaacctgcgacatttgtctacctgccctatccgggaaactccgaaatcgtgggcggggacattggaatccacatgaccgaggaatctagcccttccaatattcatcttgttgcccactgccccgctcgcgactcttgtgatgtgagcgactgcctcttctgtgtccatggcctgctgaactaccaatgccacacgctcttttccgccctgcttatcagcaccacagtgatgtctatcctgaccctcctgctgcttctcgttaagggggctaaagatctggtgaagaaactgttccactggctcattacacctctgtgttggctttccgtcttttgctgttgggtggttaagagctggaagagacgggtgggctctgccatctccagaaccaatgacacgattggatggcgcgagaaccggagacatgcgcaggatatcgagcgcgcccagtatacaggcggggctcccggagccaaatacagcttctatggcgtcatgattctggggctcctgtcttccgctcaaagctgctccgaaagcgtgatcgccgactctaagatcatgcagtgtaccacaagcggatcctctaccctgtgcaaagccagcggcaccgtgattatgagacttgggcctatcggctccgagtcttgcctcattctgaagggactgaaagatagcgaaaagcagtttatctccattaagacaatctctagcgagctcacgtgtcgggaaggcgagtccttctggaccacactgtacacccccatctgccttagctctcgcagatgtcacctgatgggggagtgcgtctccgaccggtgtctcaaatggaagacaaaccagaccagcgctgaatttacgggaaaagcgcatggcgatgttatgcacgagaatcgctgcttcgaacaatctgggggaattggctatgggtgttttaacgtgaatccgtcctgcctgtacgtgcatagctacctgaagtccgtctatagaaacggcttcaaagtgttccggtgtgttgcctggaatcaccgcatcagacttgagatgacaacccactctcggaagtttcctatggtgctcatggctatgagcacccagcccacagactggggatccattggcctgatcctggatagcgaagggattaccggaacaaactcttactccttcatgaagcatggcagcgggtcttttgccatcatcgacgatccctatagccctgagccgcgcaaaggattcctcggcgaggtcagatgccccacggaagagaccgccatgcgggcttccccttcttgtaagatggcccccaatctgattgaataccagcctgagatggacacagcggaatgcaccacaaacatgatcgaccccatggctatttttaatagagggagccttcctcaggtgcgcgatggcatgaccttcacgcaatccatcgagaaaaacaccgttcaggccctgacaaccggagaggtgaaggcctctattcggctcacactggacgattatgacgtcgtgtaccagaatagccagtccgattgcagcgctacctttaaaaacctgacaggctgttattcttgcgacgaagggtccagactttgttaccaagttaaggccgagggagaaaccatcttccactttattaatgaggaggaaagcatcaacgtgatcaataaagtcaaccccggcgtgtccgattactgcacggtgctgcatttctctcgcccggtcattagcatcgaggggacatatgactgtggactctccaagcggcctatggttattaagggcaccctgatcgcgaccgctccccacgatgacagaaaacatgaaggcgggtctagcctcgtggtgaaccctaagggaggctccgtcgactttttcgggtggctgagcggacttacatcttggctgggcgggcccctcaaaacctttctgacgattctgggattccttgccgtgggcctgctcctggttgtgatcatcattatcattatccgcacaggcatgcagcaggccctcaagaaaaagattaagtga

SEQ ID NO: 14717 - RNA, 4020 nt, synthetic construct
  misc_feature 1..4020: note = derived and/or modified CDS sequence (opt5) from TOSV(MRS2010-4319501)__KC776215.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatgtcacagagtccattggcctgatctctgggacctgcaaggttggaagcctcgaaaaccgcgattgtagaaaagacatcatgtccaattatgtggcggaggtgcacagcaacctgcatggcctgggggctatgatgcacaattacgccgatgacaagcgggtcgaaattctcaacgatgtgatccccgacgagctgaatcctggacatcacaactgctctgatcttgaccgcaaaccgttctggacagagtttattaatgttgccaagcccctgtccgaaatcgtgcctatgagcgtcattccccctcccgtggttaagctccagcctccggctgagccctcttccaaaaagcatgtgcctttcgatgtcctgcttagcgaagccgagaaagagctgaaccagaccaagatcagactcgaagacgagcggaaatctaatgctgaagagacagccaaggaacgcgcgagaatgaaggagattgaggatgaactgcggcgcgagtgggaactggagagaaaacggaaggacgccatggctgatgacctcgccaaagaaaccgctcgcagacgggagatcgagcgcaaggcccacgaactggacagaatgcttaaaaagaaagagcgggaatccctgatcgcgaaggagaaggccgatgaagacatgagaagccacgtgtataaacccaacacgacccgcgctcctgcccccacaattatcaccacactcctgatggcttccgccgcccttgctggcccgctggagaatcgggagaccaaccatctcctgaatagacctggcaacggggcgtacacgctgtctgattttgccgaaagcacatgtaccctcgcttatggatccgagtgcaagagctgggaacaccttcttaacgaggagctgttcccctttttccattctaatctcgacaaatactccatgctggaagccgccacagagaccgtgcctattcttaacaagagctctgctgtctgtaccatcagcccctccacacactctagcaatgcctgcggccgcgaagcgtccgttattcggaaaaagtgttacagcaacatgtctgcctttttctatatcaatctggctgggcagatcacggtggtgaagtgcgagaccaaccacgtcctctccagcgattgtggaaattgcatttctaaatccctgagcggccaaaaggtgtacacacccgttcaggacgtgttttgccagaaagggtggacccagtccatcccttctacaaagtatagcaaagatatttgttccatcggactgcataccgtcaaggaatgcaagattggcatcacgtctttcgagagagtgggctttatcgttgtgaaagggcgcaagatgtacattgagcaaatgaaaatgcggagcagacaggaatattccgaggaccagttcctctgttacaagagcgaatcttccagcggatcttccgtcaaactgaagaagttcaaagtggagagctgcaagggcgtcacaacctctagcgcctccaaatgtagcggggatgaatatttttgctctcgctacccgtgtgagaccgctaacgtggaggcccactgcatccttcggagacattccgctattgttgaagtgaatgtcaacggagtgtgggttgtgccccgctgtatcggctacgaggaagtcctggtgaagcggacaagcctcaaagtggaggacaccacagggagagaatgcgattcctgtctgtgggagtgcggaaagaataaactgattgttaagacgcacggccctaaggtcgtgtatgccaccgcgtgctctcatggcagctgtaaatccgtgatgcagaagcccgccacattcgtctaccttccttatcccgggaactctgagatcgtgggaggcgacattgggatccacatgaccgaagagagctccccgtctaatatccacctcgttgctcattgccctgcccgggacagctgtgatgtgtccgactgcctgttttgtgtccacggactgctcaactaccaatgccatacactgttcagcgctctgctgatttctaccacggtgatgtccatcctcaccctgctgcttctcctggttaaaggcgccaaggatctggtgaaaaagctctttcactggctgattacacccctttgttggctgagcgtcttctgctgttgggtggttaagtcttggaaacgcagagtggggtccgcgatcagccggaccaatgacacaattggctggagagaaaaccgccggcacgcccaggatatcgagagagctcagtataccggaggcgcccctggggctaagtactctttttatggagtcatgatcctcggcctgctgtccagcgcccaatcctgcagcgagtctgtgattgccgacagcaaaatcatgcagtgtacgacatccgggtctagcaccctttgcaaggcttccggaacagtgattatgcgcgtcggccccatcgggtctgaaagctgcctcattctgaaaggcctgaaggattccgagaagcagttcatctctatcaaaaccattagctccgaactcacctgtagagagggagagagcttttggacaacgctgtacacccctatctgcctttcttcccggcgctgtcatctgatgggcgaatgcgttagcgacagatgtctcaagtggaaaacaaaccagacctctgcggagttcacagggaaggcccacggagatgtgatgcatgaaaatcggtgctttgagcaatccggcgggattggatacggctgtttcaacgtgaatcccagctgcctgtatgtccactcctacctgaaatctgtgtatcgcaacgggtttaaggttttcagatgtgtggcttggaatcatcggatccgccttgaagtcaccacgcacagcagaaagttcccgatggtgctcatggccatgtccacacagcctaccgactggggcagcattggactgatcctggattctgagggcgttaccgggacaaactcctacagctttatgaaacacggatctggcagcttcgccatcattgacgatccctattcccccgaacctcggaaggggtttctcggagaggtgcgctgcccgaccgaggaaacagctatgagagcctctcccagctgtaaaatggcgcctaatctgatcgagtaccagcccgaaatggacacggctgagtgcaccacaaacatgattgaccctatggccatcttcaatcggggctcccttccccaggtcagagatgggatgacctttacacaatctattgaaaagaacaccgtgcaggccctgacgaccggcgaggttaaagctagcatccgcctcacactggacgattatgacgtggtctaccaaaattcccagagcgattgctctgccaccttcaagaacctgacaggatgttactcctgcgacgagggcagccggctttgttatcaagtgaaagcggaaggggagaccatttttcatttcatcaatgaagaggagtccatcaacgtgattaataaggtctctcctggagttagcgattactgcacagtgctgcacttttccagacccgtgatctctattgaaggcacctatgactgtgggctcagcaagcgcccgatggtcatcaaaggaacgctgattgctacagcccctcatgatgaccggaagcacgagggcggctccagcctcgtggttaaccccaaagggggatctgtggatttctttggctggctgtccgggcttaccagctggctgggaggccctctcaagaccttcctgacaatcctggggtttcttgccgtcggactgctcctggtggttatcattatcattatcattagaaccggcatgcagcaggctctcaaaaagaagatcaaatga

SEQ ID NO: 14718 - RNA, 4020 nt, synthetic construct
  misc_feature 1..4020: note = derived and/or modified CDS sequence (opt5) from TOSV(Nice/113)__KU204982.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatgtcacagagtccattggcctgacctctgggacatgcaaggttggaagcctcgaaaaccgcgattgtggcaaagacatcatgtccaattatgtggcggaggtgcacagcaacctgcatgggctgggagctatgatgcacaattacggcgatgacaagagagtcgaaatcctcaacgatgtgattcccgacgagctgaatcctggccatcacaactgctctgatcttgaccggaaaccgttctggaccgagtttatcaatgttgcccgccccctgtccgaaattgcccctatgagcgtgattccccctcccgtcgtgaagctccaacctccggctgagccctcttccaagaaacatgttcctttcgatgtgctgcttagcgaagccgagaaggagctgaaccagacaaaaatcagactcgaagacgagcggaagtctaatgctgaagagaccgccaaagaacgcgcgagaatgaaggagatcgaggatgaactgcggcgcgagtgggaactggagagaaagcggaaagacgccatggctgatgacctcgccaaggaaacggctcgcagacgggagattgagcgcaaagcccacgaactggacagaatgcttaagaaaaaggagcgggaatccctgatcgcgaaagagaaggccgatgaagacatgagaagccacgtccataagcccaacaccacacgcgctcctgcccccaccatcattacaaccctcctgatggcttccgccgcccttgctgggccgctggagaatcgggagacgaaccacctcctgaatagacctggaaacggcgcgtatacactgtctgattttgccgaaagcacctgtacactcgcttacgggtccgagtgcaaaagctgggaacatctgcttaacgaggagctgttcccctttttccactctaatctcgacaagtattccatgctggaagccgccaccgagaccgtgcctatccttaacaaaagctctgctgtgtgtacaattagcccctccacgcactctagcaatgcctgcggacgcgaagcgtccgtcatccggaagaaatgttacagcaacatgtctgcctttttctacattaatctggctggccagatcaccgttgtgaagtgcgagacaaaccatgtgctctccagcgattgtgggaattgcatctctaagtccctgagcggacaaaaagtctatacccccgtgcaggacgtgttttgccagaagggctggacacagtccattccttctaccagatacagcaaagatatctgttccattggcctgcacacggttaaggaatgcaaaatcgggacaacctctttcgagcgcgtcggatttattgtggttggcgggcggaagatgtatatcgagcaaatgaagatgagaagccgccaggaatactccgaggaccagttcctctgttataaaagcgaatctggatccggcagctctgtgaagctgaaaaagttcaaagtcgagtcctgcaagggggtgaccacaagctctgccagcaagtgttccggagatgaatacttttgcagccggtatccgtgtgagaccgctaacgtcgaggcccattgcatccttagacgccactctgctattgtggaagttaatgtgaacggcgtctgggtggttccccggtgtatcggctacgaggaagtgctggtcaaaagaacatccctcaaggtggaggacacgaccgaacgggagtgcgatagctgtctgtgggagtgcgggaaaaataagctgattgtgaaaacacatggacctaaggttgtctacgccaccgcgtgctcccacggctcttgtaaaagcgtgatgcagaagcccgccacattcgtgtatcttccttaccccgggaactccgaaatcgtcggaggcgacattgggatccacatgaccgaggaatctagcccgtccaatattcatctcgtggctcactgccctgcccgcgactcttgtgatgttagcgactgcctgttttgtgtgcatggcctgctcaactatcaatgccacacgctgttctccgcccttctgatcagcaccacagtcatgtctatcctcaccctgctgcttctcctggtgaagggagctaaagatctggttaagaaactcttttactggctgattacacccctttgttggctgtccgtgttctgctgttgggtcatcaagagctggaaaagacgggtgggctctgcgatttccagaaccaatgacacgatcgggtggcgcgagaaccggagacacgcccaggatattgagcgcgctcagtatacaggaggcgcccctggggctaagtacagcttttatggagttatgatcctcggcctgctgtcttccgcccaaagctgctccgaaagcgtgatcgccgactctaagattatgcagtgtaccacaagcgggtcctctaccctttgcaaagctagcggcaccgtcatcatgagactcggacccattggctccgagtcttgcctgatcctgaaggggctcaaagatagcgaaaagcagttcatttccatcaaaacaatctctagcgagctgacgtgtcgggaaggagagtccttttggaccacactttacacccctatttgcctgagctctcgcagatgtcatctcatgggcgagtgcgtgtccgaccggtgtctgaagtggaagacaaaccagaccagcgcggagttcacggggaaagcccacggagatgtgatgcatgagaatcgctgctttgaacaatctggcgggatcggctacggatgtttcaacgtcaatccctcctgcctgtatgttcacagctaccttaagtccgtgtatagaaacggctttaaagtgttccggtgtgtcgcttggaatcatcgcattagactcgaggtgacaacccactctcggaagttcccgatggttctgatggccatgagcacccagcctacagactgggggtccatcggactgattctcgatagcgaaggcatcaccgggacaaactcttactcctttatgaaacacggaagcggctctttcgccatcattgacgatccctatagccccgagcctcgcaaggggtttctgggcgaggtgagatgcccgacggaagagaccgctatgcgggcctccccctcttgtaagatggcgcctaatcttatcgaataccagcccgagatggacacagctgaatgcaccacaaacatgattgaccctatggccatcttcaatagaggaagcctgccccaggtccgcgatggcatgacctttacgcaatccattgagaaaaacaccgtgcaggccctcacaaccggggaggttaaggcttctatccggctgacactggacgattatgacgtggtctaccagaatagccagtccgattgcagcgccaccttcaaaaaccttacaggatgttactcttgcgacgaaggctccagactgtgttatcaagtgaaggcggagggggaaaccatttttcatttcatcaatgaggaggaaagcatcaacgttattaataaagtgtcccctgaggtctctaactactgcacggtgctccactttagccgccccgtgatctccattgaaggaacatatgattgtggcctgtctaagcggccgatggtcatcaaaggcaccctcattgctaccgcccctcatgacgatagaaagcacgaagggggaagctccctggttgtgaaccccaagggcgggagcgtggacttctttggatggctttctggcctgacatcctggctcgggggacctctgaaaaccttcctgacgatccttggctttctggccgtcggcctcctgctcgtggttatcattatcattatcattcgcacagggatgcagcaggctctgaagaaaaagatcaaatga

SEQ ID NO: 14719 - RNA, 4020 nt, synthetic construct
  misc_feature 1..4020: note = derived and/or modified CDS sequence (opt5) from TOSV(P233)__KU204976.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatgtcacagagtccattggcctgacctctgggacatgcaaggttggaagcctcgaaaaccgcgattgtagaaaagacatcatgtccaattatgtggcggaggtgcacagcaacctgcatggcctgggggctatgatgcacaattacggagatgacaagcgggtcgaaatcctcaacgatgtgattcccgacgagctgaatcctggccatcacaactgctctgatcttgaccgcaaaccgttctggaccgagtttatcaatgttgccaagcccctgtccgaaattgtgcctatgagcgtcatccctcctcccgtggttaagcctcaaccgcccgccgagccttcttccaaaaagcatgtgcccttcgatgtcctcctgagcgaagctgagaaagagcttaaccagacaaagattagactggaagacgagcggaaatctaatgccgaagagaccgctaaggaacgcgccagaatgaaggagatcgaggatgaactccggcgcgagtgggaactggagagaaaacggaaggacgcgatggccgatgacctggctaaagaaacggcccgcagacgggagattgagcgcaaggctcacgaactcgacaaaatgctgaagaaaaaggagagagaatcccttatcgccaaggagaaagcggatgaagacatgcggagccacgtgcataagcctaacaccacaagagcccccgctccgaccatcattacaaccctgctcatggcctccgctgccctggccggccctcttgagaatcgcgagacgaaccatctgctcaatcggcccgggaacggagcttatacactgtctgattttgcggaaagcacctgtacactggcctacggctccgagtgcaaaagctgggaacacctcctgaacgaggagcttttcccctttttccactctaatctggacaagtattccatgctcgaagctgccaccgagaccgtgcccatcctgaacaaaagctctgccgtctgtacaattagcccctccacgcactctagcaatgcttgcgggagagaagcctccgttatccgcaagaagtgttacagcaacatgtctgcgtttttctacattaatcttgctggacagatcaccgtgatcaaatgcgagacaaaccatgtgctgtccagcgattgtggcaattgcatttctaagtccctcagcgggcaaaaagtctatacccctgtgcaggacgtgttttgccagaagggatggacacagtccatcccgtctacccggtacagcaaagatatttgttccatcggcctgcacacggttaaggaatgcaagattggcacaacctctttcgagagagtcgggtttatcgtggttaaaggacgcaagatgtatatcgagcaaatgaaaatgcggagcagacaggaatactccgaggaccagttcctgtgttataagagcgaatctggctccgggagctctgtgaaactcaagaagttcaaagtcaagtcctgcaaaggagtgaccacaagctctgccagcaagtgttccggcgatgagtacttttgcagccgctatccctgtgaaaccgccaacgtcgaggctcattgcattctgcggagacactctgccatcgtggaggttaatgtgaacggggtctgggtggttcctcgctgtattggatacgaagaggtgcttgtcaaacggacatccctgaaggtggaagacacgaccggcagagagtgcgatagctgtctctgggaatgcggcaaaaataagctgatcgtgaagacacatgggcccaaagttgtctacgctaccgcctgctcccacggatcttgtaagagcgtgatgcagaaacctgcgacattcgtgtatctgccctacccgggcaactccgagattgtcgggggagacatcggcattcacatgaccgaggaatctagcccttccaatatccatcttgtggcccactgccccgctcgggactcttgtgatgttagcgactgcctcttttgtgtgcatgggctgctgaactatcaatgccacacgctgttctccgccctgcttatcagcaccacagtcatgtctattctgaccctcctgctgcttctcgtgaagggcgctaaagatctggttaagaagctgtttcactggctcatcacacctctgtgttggctttccgtgttctgctgttgggtcgtgaaaagctggaagcgcagagttggatctgccatttcccggaccaatgacacgatcggctggagagagaaccgccggcatgcgcaggatattgaaagagcccagtacacagggggagctcccggcgccaaatatagcttttacggggtgatgatcctgggactcctgtcttccgctcaaagctgctccgagagcgtcatcgccgactctaagattatgcagtgtaccacaagcggctcctctaccctgtgcaaagccagcgggaccgtgatcatgcgccttggccctattggatccgagtcttgcctcatcctgaagggcctgaaggatagcgaaaaacagttcatttccatcaagacaatctctagcgagctcacgtgtagagaaggggagtccttttggaccacactgtatacccccatttgccttagctctcggcgctgtcacctgatgggagaatgcgtgtccgacagatgtctcaaatggaagacaaaccagaccagcgctgagttcacgggcaaagcgcatggggatgtcatgcacgagaatcggtgctttgaacaatctggaggcatcgggtacggctgtttcaacgttaatccgtcctgcctgtacgtgcatagctatctgaagtccgtgtaccgcaacggatttaaggtcttcagatgtgtggcctggaatcaccggattcgccttgaggttacaacccactctagaaaattccctatggtgctcatggctatgagcacccagcccacagactggggctccatcgggctgattctggatagcgaaggaatcaccggcacaaactcttattcctttatgaagcatgggagcggatctttcgccatcattgacgatccctacagccctgagccgcggaaaggctttctcggggaagtccgctgccccacggaggagaccgccatgagagcttccccttcttgtaagatggcccccaatctgatcgaatatcagcctgagatggacacagcggaatgcaccacaaacatgattgaccccatggctatcttcaatcggggcagccttcctcaggtgagagatggaatgacctttacgcaatccattgagaaaaacaccgttcaggccctgacaaccggcgaagtgaaggcctctatccgcctcacactggacgattacgacgtcgtgtatcagaatagccagtccgattgcagcgctaccttcaaaaacctgacagggtgttactcttgcgacgagggatcccggctttgttaccaagttaaggccgagggcgaaaccatttttcacttcatcaatgaggaagagagcatcaacgtgattaataaggtctcccccggggtgtctgattattgcacggtgctgcattttagcagaccggtcatctccattgagggaacatacgactgtggcctctctaaacgccctatggttatcaagggcaccctgattgcgaccgctccccacgatgaccggaaacatgaagggggaagctccctcgtggtgaaccctaagggcgggagcgtcgatttctttggatggctgtctggccttacatcctggctcgggggacccctcaaaaccttcctgacgatcctgggctttcttgccgtgggcctgctcctggttgtgatcattatcattatcattagaacagggatgcagcaggccctcaagaagaaaatcaagtga

SEQ ID NO: 14720 - RNA, 4020 nt, synthetic construct
  misc_feature 1..4020: note = derived and/or modified CDS sequence (opt5) from TOSV(T152)__JX867535.1__GP
  source 1..4020: mol_type = other RNA
atgttcatcgccaagctgctcctgattagctgccttgtgcagcaggcttacctgaaatataccatcatttccgagatcggcaacgggacaagaacgtctagctgttactcctctcggaccagcctcggatccctgcttgaagcctgggacaatattacagagtctatcggcctgaccagcgggacatgcaaggtcggatccctcgaaaaccgcgattgtaaaagagacatcatgagcaattatgttgcggaggtgcactctaacctgcatggcctgggggctatgatgcacaattacggagatgacaagcgggtggaagtcctcaacgatgtgattcccgacgagctgaatcctggccgccataactgctccgatcttgacagaaaaccgttttggaccgagttcatcaatgttgccaagcccacaaacaagattgcccctatcagcgtgattccccctcccatcgtcaaacctattccgatcgctgaacccaccacgaagaaaaatatcccttttgataagctgctctctgaggccgaaaaagagctgaaccaaaccaagattcggcttgagacagaacgcagatccaatgctgaggaagccgcgaaggagcgggcccgcatgagagaaatcgaggacaaactgcggaaggattgggagctcgaacgcgagagaaaagacgctgtggccgatgacctggctaaggaaattgcccggcgcagagagatcgaacggaaagcgcacgagctggacaagatgctcaaaaagaaggagagagaagatctggttgccattgagaaagtgagcgaagacatgcgcaaccatgtccggagacccaataccacaatcgctcctgcccccaccatcattacgacacttctgctcgcttctgccgtgatggccggcccgctggagaaccgcgaaaccaaccaccttctgaatcggcctgggaacggagcttatacactctccgatttcgcggagagcacctgtaccctggcctacggctccgagtgcaagtcttgggaacaccagctggacgagctcagctttcccttctttcattccaatctggataaatatagcatgcttgaagctgccacagagacgatccctattctgaacaagtcttccgccgtgtgtaccatcagcccctctacacacagctccaatgcttgcgggagagaggcctctctcattaaaaagaagtgtggaagcaacatgtccgcgttcttttacgtcaatctggctggccagatcaccgttgtgaaatgcgacacaaaccatgtgcttagcaatgattgtgggaactgcatctctaagaccctgtccggacagaaaatttacacgcccgtccaagacatgttctgccagaagggctggacagaaagcatcccttctacccgctattccaaagatctctgtagcattggcctgcacaccgtgaaggagtgcaagacagggaccacaaattttgaacgggttggattcatcgtggtcgagtccagaaaaatgtacattgaacagatgaagatgcgctctcggcaagagtttagcgaggaccagttcctgtgttataaatccgaatctagctccggcagctctgtgaagctcaaaaaggttaaggtggagtcctgcaaaggggtcacgaccagctctgcctccaagtgtagcggagatgaatacttctgctctagatatccgtgtgagacagccaacgtggaagctcactgcatcctgcgccggcatagcgccgtcattgaggtgaatgttaacggcgtgtgggtcgtgcccagatgtatcgggtacgaggaagttcttgtgcggcgcacctccctgaaagtcgaggacacaagctctagagaatgcgacacctgtctctgggagtgcggaaagaataaactgatcgtgaagacgcacggccctaaaattgtgtatgctaccgcctgctcccatggcagctgtaagtccgttatgcagaagcccgcgacatttgtcttcctgccttaccccgggaactctgaaatcgtgggaggcgatattggggtgcacatgaccgaggagagctccccgtctaacatccatatggtcgcccactgccctgctaaagacagctgtgaagtgtcctcttgcctcttttgtgttcacggacttctgaattaccagtgccatacactgttcagcgccctcctgatttccaccacggtgatgagcatccttacactgctcctgctgcttgtcaagggcgctaaagatctcgtgaagcggctgttttattggctgatcacacccctctgttggctgtctgttttctgctcctggatgattaaaagctggagaaagcgcgtggggtctgccatctcccggaccaacgacaccattggctggagagataatcgcagatacggacaagacgtcgagcgggcgcagtataccggcggggcccctggaacaaagtacagcttttatggcgtgatgatccttgggctgctcggaaacgttcactcttgttccgaaagcgtgattgctgattccaaagtcatgcagtgcacgaccagcggctctagcacactgtgtaaggcctccgggaccgtgatcatgaaactgggccccatcggatctgagagctgccttattctcaagggcctgaaagactccgagaagcaattcatctctattaagacaatcagctccgaactgacctgccgcgagggggaatctttttggacgacactctacacccctgtgtgtctgagctccagacggtgccatcttatgggagagtgtgtcagcgatcgctgcctgaaatggaagaccaatgaaacatctgctgagttcaccggcaaagcccacggggaggttatgcacgaaaacaagtgttttgagcagtccggaggcattgggtatggctgcttcaatgtgaaccccagctgtctctacgtgcattcttacctgaaatccgtctataagaatggatttaagatcttcagatgcgtggcctggaaccaccggatccgcctggaagttacaacgcatagcagaaaattcccgatggtgcttatggctatgtccacccagcctacagactggggctctattgggctcatcctggatagcgagggaattaccggcacaaatgcgtactcctttatgaagcacgggagcggatctttcgccatcattgacgatccctattcccccgaacctcggaaaggctttctgggggaggtccgctgtccgaccgaggaaacggctatcagagccagcccctcttgcaagatggcccctaacctcattgagtaccagcccgaaatggacaccgctgagtgtacaaccaatatgatcgaccctatggccatcttcaaccggggcagcctgccccaagtgagagatggaatgacatttacccagtccattgagaaaaatacagttcaggcgcttaccacgggcgaagtgcgcgcttctatccggctgacactcgacgattatgacgtcgtgtaccagaacagccaatccgattgctctgccaccttcaagaacctgaccgggtgctatagctgtgacgagggatccagaatgtgctaccaggttaaagccgaaggcgagacaatttttcatttcgtgaatgaagatgagagcatcaacgtcattaataaggtgtctcctgacgtgtccgattactgtaccgtcctgcactttagccgccccgttatctccatcgaggggcggtatgactgcggactttctaagagaccgatggtgattaaaggcacgctgatcgctacagcccctcacgatgaccgcaagcatgaaggcgggagctccctcgtggtcaaccccaaaggaggcaccgtggatttctttgggtgggtttctggactgacaagctggctcggcgggcctctgaagaccttccttacaattctgggatttctcgcgctgggcctgcttctggtggtcgtgatcattatcatcgctcggaccggcgttcagcaggccctcaaaaagaagaataaatga

SEQ ID NO: 14721 - RNA, 4020 nt, synthetic construct
  misc_feature 1..4020: note = derived and/or modified CDS sequence (opt5) from TOSV(TOSV/P51)__KU204979.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatgtcacagagtccattggcctgacctctgggacatgcaaggttggaagcctcgaaaaccgcgattgtagaaaagacatcatgtccaattatgtggcggaggtgcacagcaacctgcatggcctgggggctatgatgcacaattacggagatgacaagcgggtcgaaatcctcaacgatgtgattcccgacgagctgaatcctggccatcacaactgctctgatcttgaccgcaaaccgttctggaccgagtttatcaatgttgccaagcccctgtccgaaattgtgcctatgagcgtcattccccctcccgtggttaagctccaacctccggccgagccctcttccaaaaagcatgtgcctttcgatgtcctgcttagcgaagctgagaaagagctgaaccagacaaagatcagactcgaagacgagcggaaatctaatgccgaagagaccgctaaggaacgcgccagaatgaaggagatcgaggatgaactgcggcgcgagtgggaactggagagaaaacggaaggacgcgatggccgatgacctcgctaaagaaacggcccgcagacgggagattgaccgcaaggctcacgagctggatagaatgcttaaaaagaaagaacgggagtccctgatcgccaaggaaaaggcggacgagaacatgagaagccacgtgcatgaacccaataccacacgcgcccctgctcccaccatcattacaaccctcctgatggcctccgctgcccttgccggcccgctggagaaccgggagacgaatcacctcctgaacagacctgggaacggagcttatacactgtctgattttgcggaaagcacctgtacactcgcctacggctccgagtgcaaaagctgggaacatctgcttaatgaggagctgttcccctttttccactctaacctcgacaagtattccatgctggaagctgccaccgagaccgtgcctatccttaataaaagctctgccgtctgtacaattagcccctccacgcactctagcaacgcttgcgggcgcgaagcctccgttatccggaagaaatgttacagcaatatgtctgcgtttttctacattaacctggctggacagatcaccgtggtgaagtgcgagacaaatcatgtcctctccagcgattgtggcaactgcatctctaagtccctgagcgggcaaaaagtgtatacccccgttcaggacgtgttttgccagaagggatggacacagtccattccttctaccagatacagcaaagatatctgttccattggcctgcacacggtcaaggaatgcaaaatcggcacaacctctttcgagcgcgtggggtttattgttgtgaagggacggaagatgtatatcgagcaaatgaaaatgagaagccgccaggaatactccgaggaccagttcctctgttataagagcgaatctggctccgggagctctgtcaaactgaagaaattcaaggtggagtcctgcaagggagtcaccacaagctctgccagcaaatgttccggcgatgaatacttttgcagccggtatccgtgtgagaccgccaatgtggaggctcattgcatccttagacgccactctgccattgttgaagtgaacgtcaatggggtgtgggttgtgccccggtgtatcggatacgaggaagtcctggtgaagagaacatccctcaaagtggaggacacgaccggccgggaatgcgatagctgtctgtgggagtgcggcaagaacaaactgattgttaagacacatgggcctaaagtcgtgtacgctaccgcctgctcccacggatcttgtaagagcgtgatgcagaagcccgcgacattcgtctatcttccttaccccggcaattccgagatcgttgggggagacattggcatccacatgaccgaagagtctagcccgtccaacattcatctcgtggcccactgccctgctcgcgactcttgtgatgtgagcgactgcctgttttgtgtccatgggctgctcaattatcaatgccacacgctgttctccgcccttctgatcagcaccacagtgatgtctatcctcaccctgctgcttctcctggttaaaggcgctaaggatctggtgaaaaagctcttttactggctgattacacccctttgttggctgtccgtcttctgctgttgggtggttaaaagctggaagagacgggtgggatctgccatctccagaaccaacgacacgattggctggcgcgaaaaccggagacacgcgcaggatatcgagcgcgcccagtatacagggggagctcctggcgccaagtacagcttttatggggtcatgattctcggactgctgtcttccgctcaaagctgctccgagagcgtgatcgccgactctaaaatcatgcagtgtaccacaagcggctcctctaccctttgcaaggccagcgggaccgtgattatgagactcggccccatcggatccgaatcttgcctgattctgaaaggcctcaaggatagcgagaaacagttcatctccattaagacaatctctagcgaactgacgtgtcgggagggggaatccttttggaccacactttacacccctatctgcctgagctctcgcagatgtcatctcatgggagagtgcgtctccgaccggtgtctgaagtggaaaacaaatcagaccagcgctgagttcacgggcaaggcgcacggggatgttatgcatgaaaaccgctgctttgagcaatctggaggcattgggtacggctgtttcaatgtgaacccctcctgcctgtatgtgcacagctaccttaaatccgtctatagaaatggatttaaggtgttccggtgtgttgcctggaaccatcgcatcagactcgaagtgacaacccactctcggaaattcccgatggtcctgatggctatgagcacccagcctacagactggggctccattgggctgatcctcgatagcgagggaattaccggcacaaattcttactcctttatgaagcacgggagcggatctttcgccatcatcgacgatccctatagccccgaacctcgcaagggctttctgggggaggtgagatgcccgacggaggaaaccgccatgcgggcttccccctcttgtaaaatggcccctaaccttgttgagtaccagcccgaaatggacacagcggagtgcaccacaaatatgattgaccctatggctatcttcaacagaggcagcctgccccaggtgcgcgatggaatgacctttacgcaatccattgaaaagaataccgtccaggccctcacaaccggcgaggtgaaagcctctatccggctgacactggacgattatgacgttgtgtaccagaacagccagtccgattgcagcgctaccttcaagaatcttacagggtgttactcttgcgacgagggatccagactgtgttatcaagtcaaagccgaaggcgagaccatttttcatttcatcaacgaagaggagagcattaatgtgatcaacaaggtgtcccctcgcgtctctgattactgcacggttctccactttagccggcccgtgatctccattgaagggacatatgactgtggactgtctaaaagaccgatggtgatcaagggcaccctcattgcgaccgctcctcatgatgaccgcaagcacgagggcgggagctccctggtcgtgaaccccaaaggaggcagcgttgatttctttgggtggctttctggactgacatcctggctcggcgggcctctgaagaccttcctgacgatccttggatttctggccgtgggcctcctgctcgtcgtgattatcatcattatcattcggacaggcatgcagcaggccctgaaaaagaaaatcaagtga

SEQ ID NO: 14722 - RNA, 4020 nt, synthetic construct
  misc_feature 1..4020: note = derived and/or modified CDS sequence (opt5) from TOSV(TOSV_Italy/BB8/2014/human)__KY626661.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatattacagagtccatcggcctgacctctgggacatgcaaggtcggaagcctcgaaaaccgcgattgtaaaagagacatcatgtccaattatgttgcggaggtgcacagcaacctgcatggcctgggggctatgatgcacaattacggagatgacaagcgggtggaagtcctcaacgatgtgattcccgacgagctgaatcctggccgccataactgctctgatcttgacagaaaaccgttctggaccgagtttatcgatgttgccaagcccacaaataagattgcccctatgtccgtgatccctcctcccattgtcaaacctatcccggtggctgaaagcaccattaagaaatctatccccttcgacaagctgctctccgaggccgaaaaagagctgaaccaaacgaagatccggcttgagaccgaacgcagaagcaatgctgaggaagccgcgaaggagcgggcccgcatgagagaaattgaggataaactgcggaaggactgggagctcgaacgcgagagaaaagatgctgttgccgacgacctggctaaggaaatcgcccggcgcagagagattgaacggaaagcgcacgagctggataagatgctcaaaaagaaggagagagaagacctggtggcccgcgagcgggtctctgaagatatgagaaaccatgtgtgtaaacctaatacaaccatcgctcccgcccctacaattatcaccacgcttctgatggcttccgccgtgatggccggccccctcgagaaccgcgaaacaaatcatctgcttaaccggccggggaacggagcttataccctgagcgactttgcggagtccacatgcaccctcgcctacggctctgagtgtaagagctgggaacaccagctggatgagctgtccttcccctttttccacagcaatctcgacaaatattctatgctggaagctgccaccgagacaatccccattcttaacaagtccagcgccgtctgcacgatctctcctagcacccactcctctaatgcttgtgggagagaggccagcctgattaaaaagaagtgcggatccaacatgagcgcgtttttctacgttaatctcgctggccagatcacagtggtgaaatgtgataccaaccatgtcctgtctaatgactgcgggaactgcatttccaagacacttagcggacagaaaatctacacccccgtgcaagatatgttttgtcagaagggctggacggaatctatccccaatacacgctattccaaagacctgtgcagcattggcctccactccgttaaggagtgtaagaccgggaccacaaacttcgaacgggtgggatttatcgtcgtgaaaggcagaaagatgtacattgagcagatgaaaatgcgctctcggcaagagttcagcgaggatcagttcctgtgctataagtccgagtctagctccgggagctctgttaaactgaagaaggtgaaagtcgaatcctgtaagggagtgaccacaagctctgcctccaaatgcagcggcgacgagtacttttgttctagatatccttgcgaaacggccaatgtcgaggctcactgtatcctccgccggcatagcgccgtgattgaagttaacgtgaatggggtctggatcgtgccgagatgcattggatacgaggaggttctggtgcggcgcacctcccttaaggtcgaagacacaagctctagagagtgtgatacctgcctgtgggaatgcggcaaagacaagctcatcgtgaaaacacacggccccaagatcgtgtatgctaccgcctgttcccatgggagctgcaagtccgttatgcagaaacctgcgacgttcgtctacctgccctaccctggaaactctgagattgtgggcggggatatcggagtgcacatgaccgaagagagctccccctctaatattcatatggtcgcccactgtccggctaaggacagctgcgaggtgtcctcttgtctgttttgcgttcacggccttctcaactatcagtgtcatacactgttcagcgccctgctcatctccaccacagtgatgagcattctgacccttctgctcctgctgatgaaaggggctaaggatcttgtcaaacggctcttttactggctgatcacgcctctgtgctggctctctgtgttctgtggctgggttatcaagtcctggaagaaaagagtgggaagcgccatttctcgcacaaacgacaccatcggctggcgggataatagacgctatagacaagacgtcgaacgggcgcagtacacagggggagcccccggcgctaagtattccttttacggggtgatggttctgggacttctgggcaacgtgcacagctgctctgagtccgtcattgccgatagcaaaatcatgcagtgtaccacctccgggagctctacactctgcaaggctagcggcacggtgattatgaaactgggacctatcggctccgaatcttgcctgatccttaaggggctcaaggacagcgagaaacaattcatttccatcaagaccatttctagcgagctgacatgtcgcgaaggagagtccttttggaccacactgtatacccccgtgtgcctctctagcagacggtgtcatctgatgggcgaatgcgtctccgatcgctgtcttaaatggaagacgaatgagacaagcgccgagttcaccgggaaagcccacggagaagttatgcacgagaacagatgctttgaacagtctggcgggatcggctacggatgtttcaatgtgaacccttcctgcctgtacgtgcatagctatctcaagtctgtctacaagaatggctttaaaaccttccggtgtgtggcttggaaccaccgcattagactggaggttacaacccattcccggaagttccccatggtgctgatggcgatgagcacacagccgacggactgggggtccatcggacttatcctcgattctgaaggcattaccgggacaaatgcctatagctttatgcgccacggatccggcagcttcgctatcattgacgacccttactctcccgagcccagaaaagggtttctgggcgaagtccggtgccctaccgaggagacagccatcagagcctccccgagctgtaagatggctcccaacctgattgaatatcagcctgagatggataccgccgaatgcacgaccaatatgatcgaccccatggcgattttcaaccgcggatctctccctcaagtgcgggatggcatgacatttacccagagcatcgagaaaaatacagttcaggctctgaccacaggggaagtgagagcctccatccgccttaccctggacgattacgacgtcgtgtatcagaactctcaaagcgattgctccgccacgttcaagaatctcacaggatgttactcttgcgacgagggcagccggatgtgttaccaggttaaagctgagggggaaaccatttttcatttcatcaacgaggatgaatccattaacgtgatcagcaaggtcaatcccgacgtgtctgattattgcaccgtgctgcacttttccagacctgtcattagcatcgagggacgctacgactgtggcctgtccaagcggcccatggttatcaaaggcacacttattgccaccgcgccgcacgatgacagaaagcatgaagggggatctagcctgatcgtgaaccctaaaggcgggacggtggacttctttggatgggtctccggcctcacatcttggctcgggggacccctgaagaccttcctgacaattcttggctttctggctctcggcctgctgcttgtggttatcattatcatcattgcccgcaccggggtgcagcaggccctgaaaaagaagaataaatga

SEQ ID NO: 14723 - RNA, 4020 nt, synthetic construct
  misc_feature 1..4020: note = derived and/or modified CDS sequence (opt5) from TOSV(TOSV-54441132704)__KX010933.1__GP
  source 1..4020: mol_type = other RNA
atgttcatcgccaagctgctcctgattagctgccttgtgcagcaggcttacctgaaatataccatcatttccgagatcggcaacgggacaagaacgtctttttgttacagctcccggacctctctcggaagcctgcttgaagcctgggacaatgtcacagagtccattggcctgacctctgggacatgcaaggttggaagcctcgaaaaccgcgattgtagaaaagacatcatgtccaattatgtggcggaggtgcacagcaacctgcatggcctgggggctatgatgcacaattacggagatgacaagcgggtcgaaatcctcaacgatgtgattcccgacgagctgaatcctggccatcacaactgctctgatcttgaccgcaaaccgttctggaccgagtttatcaatgttgccaagcccctgtccgaaattgtgcctatgagcgtcattccccctcccgtggttaagctccaacctccggccgagccctcttccaaaaagcatgtgcctttcgatgtcctgcttagcgaagctgagaaagagctgaaccagacaaagatcagactcgaagacgagcggaaatctaatgccgaagagaccgctaaggaacgcgccagaatgaaggagatcgaggatgaactgcggcgcgagtgggaactggagagaaaacggaaggacgcgatggccgatgacctcgctaaagaaacggcccgcagacgggagattgagcgcaaggctcacgaactggacaaaatgcttaagaaaaaggagagaaagtccctgatcgccaaagaaaaggcggatgtggacatgcggagccacgtgcataaacccaacaccacaagagcccctgctcccaccatcattacaaccctcctgatggcctccgctgcccttgccggcccgctggagaatcgcgaaacgaaccacctcctgaatcggcctgggaacggagcttatacactgtctgattttgcggagagcacctgtacactcgcctacggctccgagtgcaagagctgggaacatctgcttaacgaggaactgttcccctttttccactctaatctcgacaaatattccatgctggaggctgccaccgagaccgtccctatccttaacaagagctctgccgtttgtacaattagcccctccacgcactctagcaatgcttgcgggagagaagcctccgtgatccgcaagaaatgttacagcaacatgtctgcgtttttctacattaatctggctggacagatcaccgtgatcaagtgcgagacaaaccatgtcctctccagcgattgtggcaattgcatttctaaatccctgagcgggcaaaaggtgtatacccccgttcaggacgtgttttgccagaaaggatggacacagtccatcccttctacccggtacagcaaggatatttgttccatcggcctgcacacggtcaaggaatgcaaaattggcacaacctctttcgagagagtggggtttatcgttgtgaagggacgcaaaatgtatatcgaacaaatgaagatgcggagcagacaggagtactccgaggaccagttcctctgttataaaagcgaatctggctccgggagctctgtcaagctgaagaaattcaaggtggagtcctgcaaaggagtcaccacaagctctgccagcaagtgttccggcgatgaatacttttgcagccgctatccgtgtgagaccgccaacgtggaagctcattgcattcttcggagacactctgccatcgttgaggtgaatgtcaacggggtgtgggttgtgccccgctgtattggatacgaggaagtcctggtgaaacggacatccctcaaggtggaggacacgaccggcagagaatgcgatagctgtctgtgggagtgcggcaaaaataagctgatcgttaagacacatgggcctaaagtcgtgtacgctaccgcctgctcccacggatcttgtaagagcgtgatgcagaaacccgcgacattcgtctatcttccttaccccggcaactccgaaattgttgggggagacatcggcattcacatgaccgaggagtctagcccgtccaatatccatctcgtggcccactgccctgctcgggactcttgtgatgtgagcgactgcctgttttgtgtccatgggctgctcaactatcaatgccacacgctgttctccgcccttctgatcagcaccacagtgatgtctattctcaccctgctgcttctcctggttaagggcgctaaagatctggtgaagaagctcttttactggctgatcacacccctttgttggctgtccgtcttctgctgttgggtggttaaaagctggaagcgcagagtgggatctgccatttcccggaccaatgacacgatcggctggagagaaaaccgccggcacgcgcaggatattgagagagcccagtatacagggggagctcctggcgccaaatacagcttttatggggtcatgatcctcggactgctgtcttccgctcaaagctgctccgaaagcgtgatcgccgactctaagattatgcagtgtaccacaagcggctcctctaccctttgcaaagccagcgggaccgtgatcatgcgcctcggccccattggatccgagtcttgcctgatcctgaagggcctcaaggatagcgagaaacagttcatttccatcaagacaatctctagcgaactgacgtgtagagagggggaatccttttggaccacactttacacccctatttgcctgagctctcggcgctgtcatctcatgggagagtgcgtctccgacagatgtctgaaatggaagacaaaccagaccagcgctgagttcacgggcaaagcgcacggggatgttatgcatgagaatcggtgctttgagcaatctggaggcatcgggtacggctgtttcaacgtgaatccctcctgcctgtatgtgcacagctaccttaagtccgtctatcgcaacggatttaaggtgttcagatgtgttgcctggaatcatcggattcgcctcgaagtgacaacccactctagaaaattcccgatggtcctgatggctatgagcacccagcctacagactggggctccatcgggctgattctcgatagcgagggaatcaccggcacaaactcttactcctttatgaagcacgggagcggatctttcgccatcattgacgatccctatagccccgaacctcggaaaggctttctgggggaggtgcgctgcccgacggaagagaccgccatgagagcttccccctcttgtaagatggcccctaatcttatcgagtaccagcccgaaatggacacagcggagtgcaccacaaacatgattgaccctatggctatcttcaatcggggcagcctgccccaggttagagatggaatgacctttacgcaatccattgagaaaaacaccgtgcaggccctcacaaccggcgaagtcaaggcctctatccgcctgattctggacgattatgacgtggtttaccagaatagccagtccgattgcagcgctacattcaaaaaccttaccgggtgttactcttgcgacgaaggatcccggctgtgttatcaagtgaaggccgagggcgagacaatctttcatttcatcaatgaagaggaaagcattaacgtcatcaataaggtgtcccctggggtgtctgattactgcaccgtcctccactttagcagacccgttatttccatcgagggaacgtatgactgtggcctgtctaaacgcccgatggtgattaagggcacactcatcgcgaccgctcctcatgatgaccggaaacacgaagggggaagctccctggtggtcaaccccaagggcgggagcgtggatttctttggatggctttctggcctgacctcctggctcgggggacctctgaaaacattcctgaccatccttggctttctggccgttggcctcctgctcgtggtcattatcattatcattatcagaacggggatgcagcaggccctgaagaagaaaatcaagtga

SEQ ID NO: 14724 - RNA, 3222 nt, synthetic construct
  misc_feature 1..3222: note = derived and/or modified CDS sequence (opt5) from SFTSV(HB29)__NC_018138.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatgtcgcctggatggacgtggggcactcccataagatcattatgcgcgagcacaaaaccaagtgggtgcaggaatctagctccaaggatttcgtctgctataaagagggaacaggcccgtgtagcgaatctgaggaaaaggcttgcaaaacctccgggagctgcagaggagacatgcagttttgtaaggttgccggctgcgagcacggcgaggaggcttctgaagccaaatgtcggtgctccctggtgcataagcctggggaagtggtcgtgagctacggaggcacacgcgttagacccaaatgttacgggttctcccggatgatggcgacccttgaggtgaaccctcccgaacagcgcatcggacaatgcacgggctgtcacctggagtgcattaatgggggcgtcagactcatcaccctgacatctgagctgcggagcgccaccgtgtgtgcttcccatttttgctctagcgcctccagcggaaagaagtctacagaaattcacttccactccggcagcctcgttgggaaaaccgctatccatgtgaagggagccctggtcgacggcacggagttcacatttgaagggtcttgtatgttccccgatggatgcgacgcggtggattgcaccttttgtcgcgagttccttaaaaaccctcagtgctatccggccaagaaatggctgtttatcattatcgtcattctcctgggctacgctgggcttatgctgctcacaaatgtgctgaaggccatcggcgtttggggatcctgggtgattgctcccgtcaagctgatgttcgccatcatcaaaaagctcatgagaaccgtgagctgtctggttggcaaacttatggaccgggggagacaggtgattcacgaagagatcggagagaacggcgaagggaatcaagatgacgtccgcattgagatggcccggcctagacgcgtgcggcattggatgtattctcccgtgatcctgaccattctcgctatcggactggcggaaggctgcgatgagatggttcacgccgacagcaagctggtctcctgtagacaggggagcggcaacatgaaagagtgcattacaacgggacgcgctctgctccctgccgtgaatcccggccaggaagcctgtctgcattttaccgctccggggtctcctgattccaagtgcctgaagatcaaagtgaagcggatcaacctcaaatgtaagaaaagctcctcttacttcgtccccgacgccagaagccgctgcacatccgtgcggagatgtcgctgggcgggagattgccagtctggctgccctccccactttaccagcaattccttctctgacgactgggctgggaagatggatcgggccggactgggctttagcgggtgttccgacggctgcggaggcgccgcttgtgggtgcttcaacgccgctcctagctgtatcttttggagaaagtgggttgagaatccccacggaattatttggaaagtgtctccgtgcgccgcgtgggtcccttccgccgtgatcgaacttacaatgcccagcggcgaggttcggaccttccatcccatgtctgggattcctacgcaagtgttcaagggagtctccgtgacatatctgggcagcgatatggaagtttctggcctcaccgacctgtgtgagatcgaggaactgaaatccaagaaacttgctctcgccccgtgcaaccaggctgggatgggagtggtcggcaaggtgggggagatccagtgtagctccgaagagagcgcccgcaccattaaaaaggatggatgcatctggaacgcggacctggtgggcattgaactgagagtcgatgacgccgtttgttactctaagatcacaagcgtggaggctgtggccaattattccgctattcccaccacaatcgggggactccggtttgagagatctcacgatagccagggcaaaatctccggctctcctctggacattacggccatccgcgggagcttctccgtcaactaccggggacttagactgtctctcagcgaaattaccgccacatgcaccggcgaggtgacaaatgtttccgggtgctacagctgtatgaccggagctaaggtgtctatcaaactgcattccagcaagaactctacggcgcacgtccgctgcaaaggcgatgaaaccgccttttccgtgctggagggggttcacagctatattgtgagactttccttcgaccatgctgtcgtggatgaacaatgtcagctcaattgcggaggccacgagtctcaggttacactgaagggcaacctgatctttctcgacgtgcccaagttcgtcgacgggagctacatgcagacctatcattccacagtgcctaccggagccaatatccccagccctacggattggctgaacgccctttttggcaatgggctgtctcggtggattctcggagtgatcggcgtcctgcttgggggacttgctctcttctttctgattatgttcctgctcaaactgggcacaaagcaagtttttcgctccagaaccaaacttgcctga

SEQ ID NO: 14725 - RNA, 3222 nt, synthetic construct
  misc_feature 1..3222: note = derived and/or modified CDS sequence (opt5) from SFTSV(Jilin)__KT890281.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctaatatcccgcatctgcttgggtactccgagaagatctgtcaaattgatagactgatccacgtttctagctggctccggaaccattcccagtttcagggatatgtgggccagcgcgggggaagatctcaagtgagctactatcccgccgaaaattcctacagccggtggtctggcctgctttccccttgcgacgcggattggctgggcatgctcgtcgtgaaaaaggctaaagggagcgacatgattgttcccggaccttcttataagggcaaggtgttctttgagcgccccacattcgatgggtacgtcggatggggctgtgggtccggaaaaagcagaacggaatctggcgagctgtgctccagcgactccggcacctctagcgggctgctcccttccgatcgggtgctgtggatcggagacgttgcctgtcagccgatgacacccattcctgaagagacctttcttgagctcaagagcttctctcagtccgaatttcccgatatctgcaaaattgacggcatcgtgttcaaccagtgtgagggggaaagcctgcctcaaccctttgatgtcgcctggatggacgtgggacactctcataagatcattatgcgcgagcacaaaacaaagtgggtgcaggagagctcctctaaggatttcgtctgctataaagaaggcaccgggccgtgtagcgagtccgaagagaagacatgcaaaaccagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggcccctcttgaagtgaatcctcccgagcagcgcatcggccaatgcacggggtgtcacctggaatgcattaacggcggagtcagactcatcaccctgacaagcgagctgaagtccgcgaccgtgtgtgcctatcatttttgctcttgtgctacaagcggcaagaaatccaccgagattcagttccactctgggagcctcgttggaaagacggccatccacgtgaaaggcgctctggtcgacgggacagagttcacctttgaaggacggtgcatgttccccgatggctgcgacgccgtggattgtacattttgccgcgagttccttaagaatccgcagtgttaccccgcgcaaaaatggctgtttatcattatcgtcattctcctggggtatgccggccttatgctgctcaccaacgtgctgaaggctatgggagtttggggctcctgggtgatcgcccctgtcaagctggtgttcgctattatcaaaaagctcatgagagccgttagctgcctgatggggaaacttatggaccggggaagacaggtgatccatgaagaaattggcgagaatcgcgaggggaaccaggatgacgtccggatcgaaatggccagaccccgccgggtgagacactggatgtactctcctgtgattcagaccatcgttgctattggactggcggagggctgtgatgaaatggtccatgccgactccaagctcgtgagctgccgccaagggtctggcaatatgaaagagtgtgtgacaacgggacgggctctgcttcccgccgtcaacccgggccaggaggcctgcctgcactttaccgctcctgggtcccccgatagcaagtgtctcaagatcagagtgaaacgcattaatctgaagtgcaaaaagtctagctcctatttcgttcctgacgcccggagcagatgtacatctgtgcgccggtgcagatgggcgggagattgccagtccggctgtccccctcattttaccagcaactccttctctgacgactgggctgggaaaatggatcgggccggactgggctttagcgggtgctccgacggctgtggaggcgccgcttgcgggtgtttcaatgccgctccctcttgcatcttttggcgcaagtgggtcgaaaacccgcacggaatcatttggaaggtgagcccttgtgccgcgtgggttccctccgccgtgatcgagctcacaatgccctctggcgaagtcagaaccttccaccctatgagcgggattccgacacaggtgttcaaaggagtttccgtgacgtacctgggcagcgatatggaggtctctggccttaccgacctgtgcgaaatcgaggagctcaagtccaaaaagctggctctggccccctgtaaccaagctgggatgggagtggtgggcaaagtcggggaaattcagtgcagctctgaggaatccgcccggaccatcaagaaagatggatgtatctggaatgcggaccttgttggcattgagctcagagtggatgacgccgtgtgctatagcaagatcacatctgtcgaagctgtggccaactactccgctattcctaccacaatcgggggactgcgctttgagcggagccatgattcccagggcaagattagcggctctcccctggacatcacggccatcagagggagcttctccgttaattaccgcggactcagactgtctcttagcgagattaccgccacatgcaccggcgaagtgacaaacgtctccgggtgttattcttgcatgaccggagctaaagtgagcatcaagctgcactcctctaaaaatagcacggcgcatgttcggtgtaagggcgatgagaccgccttttccgtgctcgaaggggtccacagctactctgtgtccctgagcttcgaccacgctgttgtggatgagcagtgccaactgaactgtggaggccatgaatctcaggtcacacttcgcggcaatctcatttttctggacgtgcctaaattcgtggacgggtcctatatgcagacctaccacagcacagtccccaccggagccaacatcccttcccccacggattggctgaatgccctctttggcaacgggctgtctagatggattcttggagttatcggcgtgctgctcgggggactggctctgttctttcttatcatgagcctcttcaagctgggcacaaagcagatttttcggtcccgcaccaaactggcctga

SEQ ID NO: 14726 - RNA, 3222 nt, synthetic construct
  misc_feature 1..3222: note = derived and/or modified CDS sequence (opt5) from SFTSV(05-Lu'an(CHN)-2015)__KX302597.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgagggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctggggctaaatgtcggtgctccctcgtgcataagcctggagaagtggtcgtgagctacggcgggatgcgcgttagacccaaatgttacggattttcccggatgatggccaccctggaggtgaaccagcctgaacaacgcatcggccagtgcacggggtgtcaccttgagtgcattaatggcggagtcagactgatcaccctcacatctgaacttaagagcgcgaccgtgtgtgcctcccatttctgctctagcgctacatccggcaagaaaagcaccgagattcagttccactctgggtccctggttggaaagacggccatccacgtgaaaggcgctctcgtcgatgggacagagtttaccttcgaaggaagctgtatgtttcccgacggctgcgatgccgtggactgcacattctgtcgggagtttctgaagaacccccaatgctatcctgcgaaaaagtggcttttcatcattatcgtcattctgctcgggtacgccggcctgatgcttctgaccaatgtgctcaaggctatcggaatttggggctcttgggttatcgccccggtgaaactgatgtttgctatcattaagaaactgatgcgcaccgtctcctatctcatggggaagctgatggatagaggaagacaggtgatccatgaagagattggcgaaaaccgggaggggaatcaggacgatgttcgcatcgagatggcccggcccagacgcgtgcggcactggatgtacagccctgtcattcttacaatcctggccattggactcgctgaatcttgtgacgagatggtgcatgcggatagcaaactggtgtcctgcagacagggcagcgggaacatgaaggaatgtgttacgaccggccgcgcccttctgcccgctgtcaatcctggacaagaggcctgcctccacttcacagcccccggctctccggactccaagtgtctgaaaatcaaggtgaaacggatcaacctgaagtgcaaaaagagctcctcttattttgtgcctgatgctagaagccgctgtacctccgtccggagatgccgctgggccggggactgtcagtctggatgtccccctcatttcacaagcaattccttttctgacgattgggcgggcaagatggaccgggctgggctcggattcagcggctgctccgatgggtgcggcggagccgcctgcggctgttttaacgctgcccccagctgcattttctggagaaaatgggtggagaatcctcacgggatcatttggaaggtttctccctgtgctgcctgggtgccgtccgcggtcatcgaactgaccatgcctagcggagaggtgcggacgttccaccccatgtctggcattcccacacaggtttttaaaggggtgtccgtcacctaccttggaagcgacatggaagtgtctggcctgaccgatctctgcgagatcgaagaactgaagtccaaaaagctggcccttgctccttgtaaccaggccggcatgggggttgtgggaaaagtcggcgagatccaatgcagctccgaagagagcgctcgcacaattaagaaggacgggtgtatctggaacgccgatctcgtgggaattgaactgagagtggacgatgcggtctgctattctaaaatcaccagcgttgaggccgtggctaattactccgccattccgacaacgatcggcgggctgcggttcgaaagatctcatgacagccagggaaagatctccggctctcccctcgatattaccgctatccgcggcagcttttccgtgaactaccgggggctgagactttctctgagcgagattacagccacctgtacaggagaggtcaccaatgtgtccggctgctatagctgcatgacgggggccaaagtttctatcaagctccactccagcaaaaactctaccgctcatgtgcgctgtaagggagacgaaacagcgttctccgtcctggagggcgtgcacagctacaccgtttccctgtcttttgatcacgccgtggtcgacgaacagtgccagcttaattgtgggggacatgagagccaagtgacactcaagggcaacctgattttcctggacgttcctaaatttgtggatggctcctatatgcagacctaccacagcacggtccccacaggggctaatatcccttctcccaccgactggctcaacgccctgttcggaaatggcctttccagatggatcctgggggtgattggagtgctcctgggcgggctggccctgtttttcatgatcatgagcctctttaagctgggaacaaaacaggtcttccggtctcgcaccaagctggcttga

SEQ ID NO: 14727 - RNA, 3222 nt, synthetic construct
  misc_feature 1..3222: note = derived and/or modified CDS sequence (opt5) from SFTSV(07-Lu'an(CHN)-2015)__KX302598.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatgtcgcctggatggacgtggggcactcccataagatcattatgcgcgagcacaaaaccaagtgggtgcaggaatctagctccaaggatttcgtctgctataaagagggaacaggcccgtgtagcgaatctgaggaaaaggcttgcaaaacctccgggagctgcagaggagacatgcagttttgtaaggttgccggctgcgagcacggcgaggaagctagcgaggccaaatgtcggtgctccctggtgcataagcctggggaagtggtcgtgagctacggaggcatgcgcgttagacccaaatgttacgggttctcccggatgatggcgacacttgaggtgaaccctcccgaacagcgcatcggacaatgcaccggctgtcacctggagtgcattaatgggggcgtcagactcatcacgctgacctctgagctgcggagcgccacagtgtgtgcttcccatttttgctctagcgccacctccggaaagaagtctacagaaattcacttccactctggctccctcgttgggaaaaccgctatccatgtgaagggagccctggtcgacggcacggagttcacatttgaagggagctgtatgttccccgatggatgcgacgcggtggattgcaccttttgtcgcgagttccttaaaaaccctcagtgctatccggccaagaaatggctgtttatcattatcgtcattctcctgggctacgctgggcttatgctgctcacaaatgtgctgaaggccatcggcgtttggggatcttgggtgattgctcccgtcaagctgatgttcgccatcatcaaaaagctcatgagaaccgtgtcctgtctggttggcaaacttatggaccgggggagacaggtgattcacgaagagatcggagagaacggcgaagggaatcaagatgacgtccgcattgagatggcccggcctagacgcgtgcggcattggatgtatagccccgtgatcctgaccattctcgctatcggactggcggaaggctgcgatgagatggttcacgccgactctaagctggtcagctgtagacaggggtccggcaacatgaaagagtgcattacaacgggacgcgctctgctccctgccgtgaatcccggccaggaagcctgtctgcattttaccgctccggggagccctgattctaagtgcctgaagatcaaagtgaagcggatcaacctcaaatgtaagaaatccagctcctacttcgtccccgacgccagatctcgctgcacaagcgtgcggagatgtcgctgggcgggagattgccagtccggctgccctccccactttacctctaatagcttctccgacgactgggctgggaagatggatcgggccggactgggcttttctgggtgtagcgacggctgcggaggcgccgcttgtgggtgcttcaacgccgctccttcctgtatcttttggagaaagtgggttgagaatccccacggaattatttggaaagtgagcccgtgcgccgcgtgggtcccttctgccgtgatcgaacttacaatgccctccggcgaggttcggaccttccatcccatgagcgggattcctacgcaagtgttcaagggagtctctgtgacatatctgggctccgatatggaagttagcggcctcaccgacctgtgtgagatcgaggaactgaaatctaagaaacttgctctcgccccgtgcaaccaggctgggatgggagtggtcggcaaggtgggggagatccagtgttccagcgaagagtccgcccgcaccattaaaaaggatggatgcatctggaacgcggacctggtgggcattgaactgagagtcgatgacgccgtttgttacagcaagatcacatctgtggaggctgtggccaattatagcgctattcccaccacaatcgggggactccggtttgagagatcccacgattctcagggcaaaatcagcggctcccctctggacattacggccatccgcgggtctttcagcgtcaactaccggggacttagactgtccctctctgaaattaccgccacatgcaccggcgaggtgacaaatgttagcgggtgctactcctgtatgaccggagctaaggtgagcatcaaactgcattcttccaagaacagcacggcgcacgtccgctgcaaaggcgatgaaaccgccttttctgtgctggagggggttcactcctatattgtgagcctttccttcgaccatgctgtcgtggatgaacaatgtcagctcaattgcggaggccacgagtctcaggttacactgaagggcaacctgatctttctcgacgtgcccaagttcgtcgacgggagctacatgcagacctatcattccacagtgcctaccggagccaatatccccagccctacggattggctgaacgccctttttggcaatgggctgtctagatggattctcggagtgatcggcgtcctgcttgggggacttgctctcttctttctgattatgttcctgctcaaactgggcacaaagcaagtttttcggtcccgcaccaaacttgcctga

SEQ ID NO: 14728 - RNA, 3222 nt, synthetic construct
  misc_feature 1..3222: note = derived and/or modified CDS sequence (opt5) from SFTSV(12-Lu'an(CHN)-2014)__KX302595.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaagtggacggaattgtcttcaaccagtgtgattctgagagcctccctcaacccatcgacgtggcctggatggatgtgggccactcccataagatcattatgcgcgaacacaaaacaaagtgggtccaggagtctagctccaaggactttgtttgctataaagaggggaccggaccgtgtagcgaatctgaggaaaagacatgcaaaacctccggcagctgcagaggggacatgcagttctgtaaggtggctggatgcgagcacggcgaagaggcctctgaggctaaatgtcggtgctccctggtgcataagcctggcgaagtcgtggttagctacgggggaatgcgcgtgagacccaaatgttacggcttttcccggatgatggccacgcttgaggtcaatcctcccgaacagcgcatcgggcaatgcaccggatgtcacctggagtgcattaacggcggggtgagactcatcacactgacctctgaacttaagagcgcgacagtttgtgcctcccatttctgctctagcgctacctccggcaagaaaagcacggagattcagtttcactctggatccctcgtgggcaaggccgctatccacgtcaaaggggccctggtggatggaacagagttcaccttcgaaggcagctgtatgtttcccgacgggtgcgatgcggtcgactgcacattctgtcgggagtttcttaagaatcctcagtgctatccggccaaaaagtggctgttcatcattatcgtgattctcctgggatacgctggccttatgctgctcaccaacgttctgaaggccatcggggtgtggggctcttgggtcatggctcccgtgaaactgatgtttgccattatgaagaaactcatgcgctccgttagctgtctgatgggaaagctgatggatagaggccggcaagtgatccatgaagagatcggggaaaatagagagggaaaccaggacgatgtccgcattgagatggcccggcctagacgcgtgcggcactggatgtattctcccgtgatcctgaccattctcgctatcggcctggcggaagggtgcgacgagatggttcatgccgatagcaaacttgtctcctgtagacagggaagcggcaatatgaaggaatgcgtgacaacggggcgcgctctgctccctgccgtgaaccccggccaggaggcctgtctgcacttcaccgctccgggatctcctgactccaagtgcctgaaaattaaggtcaaacggatcaatctcaagtgtaaaaagagctcctcttactttgtgcccgatgccagaagccgctgcacatccgttcggagatgtcgctgggcgggcgactgccaatctgggtgccctagctatttcacctccaactcttttagcgacgattgggctggaaagatggaccgggccggcctggggttctccggatgtagcgatggctgcgggggcgccgcttgtggatgctttaatgccgctccctcttgtattttctggagaaaatgggtggagaaccctcatggcatcatctggaaggtctccccctgcgccgcgtgggtgccgagcgccgttattgaacttacaatgccttctggggaggtgcggacctttcaccccatgtccggaatccccacgcaggtcttcaaaggcgtgagcgttacatacctggggtctgacatggaagtgtccggactcaccgatctgtgtgagattgaggaacttaagagcaaaaagctggctctcgccccttgcaaccaggctggcatgggcgtcgtggggaaagtgggagagatccagtgttccagcgaagagtctgcccgcaccattaagaaggacggctgcatctggaatgcggatctggtcgggatcgaactgagagttgacgatgccgtgtgttatagcaaaattacatccgtggaggctgtcgccaactactctgctatcccgaccacaattggaggcctccggttcgaaagaagccacgactcccaagggaagatctctggaagccccctggatattacggccatccgcggctccttttctgtgaattaccggggccttagactgagcctctccgagatcaccgccacatgcaccggggaggttacaaacgtgagcggatgctattcttgtatgaccggcgctaaagtctccattaagctgcatagctctaaaaattccacggcgcacgtgcgctgcagaggggacgaaaccgccttcagcgttctggagggagtgcattcctacacagtctctcttagctttgatcacgctgtggttgacgaacagtgtcagctcaactgcggcgggcacgagtcccaggtgaccctgaagggaaatctgatcttcctcgacgtccctaagtttgtggatggcagctatatgcaaacataccattcttccgtgcccaccggcgccaacattcctagccccacggactggctgaatgcccttttcgggaacggactgtctcggtggatcctcggcgtcattggggttctgctgggagtgcttgctctctttttcctgatcatgagcctgtttaaactcggcacaaaacaggtgatccgctccagaaccaagctggcctga

SEQ ID NO: 14729 - RNA, 3222 nt, synthetic construct
  misc_feature 1..3222: note = derived and/or modified CDS sequence (opt5) from SFTSV(14-Lu'an(CHN)-2014)__KX302596.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaagtggacggaattgtcttcaaccagtgtgattctgagagcctccctcaacccatcgacgtggcctggatggatgtgggccactcccataagatcattatgcgcgaacacaaaacaaagtgggtccaggagtctagctccaaggactttgtttgctataaagaggggaccggaccgtgtagcgaatctgaggaaaagacatgcaaaacctccggcagctgcagaggggacatgcagttctgtaaggtggctggatgcgagcacggcgaagaggcctctgaggctaaatgtcggtgctccctggtgcataagcctggcgaagtcgtggttagctacgggggaatgcgcgtgagacccaaatgttacggcttttcccggatgatggccacgcttgaggtcaatcctcccgaacagcgcatcgggcaatgcaccggatgtcacctggagtgcattaacggcggggtgagactcatcacactgacctctgaacttaagagcgcgacagtttgtgcctcccatttctgctctagcgctacctccggcaagaaaagcacggagattcagtttcactctggatccctcgtgggcaaggccgctatccacgtcaaaggggccctggtggatggaacagagttcaccttcgaaggcagctgtatgtttcccgacgggtgcgatgcggtcgactgcacattctgtcgggagtttcttaagaatcctcagtgctatccggccaaaaagtggctgttcatcattatcgtgattctcctgggatacgctggccttatgctgctcaccaacgttctgaaggccatcggggtgtggggctcttgggtcatggctcccgtgaaactgatgtttgccattatgaagaaactcatgcgctccgttagctgtctgatgggaaagctgatggatagaggccggcaagtgatccatgaagagatcggggaaaatagagagggaaaccaggacgatgtccgcattgagatggcccggcctagacgcgtgcggcactggatgtattctcccgtgatcctgaccattctcgctatcggcctggcggaagggtgcgacgagatggttcatgccgatagcaaacttgtctcctgtagacagggaagcggcaatatgaaggaatgcgtgacaacggggcgcgctctgctccctgccgtgaaccccggccaggaggcctgtctgcacttcaccgctccgggatctcctgactccaagtgcctgaaaattaaggtcaaacggatcaatctcaagtgtaaaaagagctcctcttactttgtgcccgatgccagaagccgctgcacatccgttcggagatgtcgctgggcgggcgactgccaatctgggtgccctagccatttcacctccaactcttttagcgacgattgggctggaaagatggaccgggccggcctggggttctccggatgtagcgatggctgcgggggcgccgcttgtggatgctttaatgccgctccctcttgtattttctggagaaaatgggtggagaaccctcacggcatcatctggaaggtctccccctgcgccgcgtgggtgccgagcgccgttattgaacttacaatgccttctggggaggtgcggacctttcaccccatgtccggaatccccacgcaggtcttcaaaggcgtgagcgttacatatctggggtctgacatggaagtgtccggactcaccgatctgtgtgagattgaggaacttaagagcaaaaagctggctctcgccccttgcaaccaggctggcatgggcgtcgtggggaaagtgggagagatccagtgttccagcgaagagtctgcccgcaccattaagaaggacggctgcatctggaatgcggatctggtcgggatcgaactgagagttgacgatgccgtgtgttacagcaaaattacatccgtggaggctgtcgccaactattctgctatcccgaccacaattggaggcctccggttcgaaagaagccatgactcccaagggaagatctctggaagccccctggatattacggccatccgcggctccttttctgtgaattaccggggccttagactgagcctctccgagatcaccgccacatgcaccggggaggttacaaacgtgagcggatgctactcttgtatgaccggcgctaaagtctccattaagctgcacagctctaaaaattccacggcgcatgtgcgctgcagaggggacgaaaccgccttcagcgttctggagggagtgcactcctatacagtctctcttagctttgatcacgctgtggttgacgaacagtgtcagctcaactgcggcgggcatgagtcccaggtgaccctgaagggaaatctgatcttcctcgacgtccctaagtttgtggatggcagctacatgcaaacatatcactcttccgtgcccaccggcgccaacattcctagccccacggactggctgaatgcccttttcgggaacggactgtctcggtggatcctcggcgtcattggggttctgctgggagtgcttgctctctttttcctgatcatgagcctgtttaaactcggcacaaaacaggtgttccgctccagaaccaagctggcctga

SEQ ID NO: 14730 - RNA, 3222 nt, synthetic construct
  misc_feature 1..3222: note = derived and/or modified CDS sequence (opt5) from SFTSV(18-Lu'an(CHN)-2015)__KX302599.1__GP
  source 1..3222: mol_type = other RNA
atgatgaaggtgatctggttctttagcctgatttgcttcgtcatccagtgttccggcgactctgggcccattatctgcgccggacctattcacagcaacaaatccgctgatatcccgcatctcctgggctactctgagaagatctgtcaaattgacagacttatccacgttagctcctggctgcggaatcattctcagtttcaggggtatgtgggacagcgcggcgggagaagccaagtgtcctactatcccgccgaaaacagctactctcggtggtccggactcctgagcccttgcgatgcggactggcttggcatgctggtcgtgaaaaaggctaaaggctctgatatgattgttcccgggccttcctataagggaaaggtgttctttgagcgccccaccttcgacggctacgtcgggtggggatgtggcagcgggaaatctagaacagaatccggagagctctgcagctccgattctggcacgagctccggcctgctgcctagcgaccgggtgctctggatcggggatgttgcctgtcagccgatgacccccattcctgaagagacatttctggagcttaagtctttctcccagagcgaatttcccgacatctgcaaaattgatggaatcgtgttcaatcagtgtgagggcgaatctctgcctcaaccctttgacgtcgcctggatggatgtggggcacagccataagatcattatgcgcgagcacaaaaccaagtgggtgcaggagtcctctagcaaggacttcgtctgctataaagaaggaacaggcccgtgttccgagagcgaagagaagacctgcaaaacatctgggtcctgcagaggagacatgcagttttgtaaggttgctggctgcgaacacggcgaggaggccagcgaagctaaatgtcggtgctctctcgtgcataagcctggggaggtggtcgtgtcctaccgcggaatgagaatccggcccaaatgttacggcttcagccgcatgatggccaccctggaagttaaccagcctgagcaaagaattgggcagtgcacgggatgtcaccttgaatgcatcaatggcggggtgcggctgattaccctcacatccgagctgaagtctgcgaccgtctgtgccagccatttctgctcctctgctacaagcggcaagaaatccaccgagatccagtttcacagcggatctctggtgggcaagacggccatccacgttaaaggggctctcgtggatggaacagagttcacctttgaaggctcctgtatgttccccgacgggtgcgatgccgtcgactgcacattttgtcgcgagttcctgaagaacccccaatgctatcctgcgaaaaagtggctttttattatcattgtgatcctgctcggatacgccggcctgatgcttctgaccaatgtcctcaaggctattgggatctggggcagctgggtgatcgccccggttaaactgattttcgctatcattaagaaactgatgagaaccgtgtcttgtctcatgggaaagctgatggatcggggcagacaggtcatccatgaagaaattggggagaaccgcgagggaaatcaggacgatgtgcggatcgaaatggccagaccccgccgggttagacactggatgtattcccctgtgattcttacaatcctggccatcggcctcgctgaggggtgcgacgaaatggtccatgcggatagcaaactggtgtcttgtcgccagggaagcggcaacgtgaaggagtgcgttacgaccgggcgggcccttctgcccgctgtcaatcctggccaagaggcctgtctccactttacagcccccggatccccggacagcaagtgcctgaaaattagagtgaagcgcatcaacctgaaatgtaagaaatcttccagctacttcgtgcctgatgctcggtccagatgcacctctgtccgccggtgtagatgggccggcgactgccagagcgggtgtccccctcattttacatccaattctttcagcgacgattgggcgggaaagatggaccgggctggcctcgggttttccggatgctctgatggctgcgggggcgccgcctgtggatgcttcaacgctgcccccagctgtattttctggcgcaagtgggtggaaaatcctcacggcatcatttggaaagtttccccctgcgctgcctgggtgccgagcgcggtcatcgagctgaccatgccttctggggaagtgagaacgtttcaccccatgtccggaatccccacacaggttttcaagggcgtgagcattacctatcttgggtctgacatggaggtctccggactgaccgatctctgtgaaatcgaggagctgaaaagcaagaaactggcccttgctccttgcaaccaggccggcatgggcgtggttgggaaggtgggagaaattcaatgttcttccgaggaaagcgctcggacaatcaaaaaggacggctgcatttggaacgccgatctcgtcgggatcgagctgagagtggacgatgcggtgtgttactccaagatcaccagcgtcgaagccgttgctaattattctgccattccgacaacgatcggaggcctgcgctttgagcggagccatgactcccaggggaaaatttctggaagccccctcgatatcaccgctattagaggctccttctctgtgaactaccgcggcctgagacttagcctgtccgagatcacagctacctgcacaggggaagtgaccaatgtctctggatgctacagctgtatgacgggcgccaaggtgtccatcaaactccacagcaacaaaaattctaccgcccatgttcggtgcaagggggacgagacagcgttttccgtgctggaaggagtccacagctataccgtgtctctgtccttcgatcacgccgttgtggacgagcagtgtcagcttaactgcggcgggcatgaaagccaagtcacactcaagggaaatctgatttttctggacgtgcctaagttcgttgatggctcctacatgcagacctatcactctacggtgcccacaggcgctaacatccctagccccaccgactggctcaatgccctgtttgggaacggactttcccgctggattctgggcgtcatcggggtgctcctgggaggcctggcccttttctttatgattatgagcctcttcaaactggggacaaaacaggtgtttagatctcggaccaagctggcttga

SEQ ID NO: 14731 - RNA, 3222 nt, synthetic construct
  misc_feature 1..3222: note = derived and/or modified CDS sequence (opt5) from SFTSV(27-Lu'an(CHN)-2015)__KX302600.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcatcagacccaaatgttacgggttttcccggatgatggccaccctggaagttaaccagcctgagcaacgcattggacagtgcacgggctgtcaccttgaatgcatcaatgggggcgtgagactgattaccctcacatctgagcttaagagcgcgaccgtctgtgcctcccatttctgctctagcgctacatccggaaagaaaagcaccgagatccagttccactctggctccctggtggggaagacggccatccacgttaaaggagctctcgtggatggcacagaatttaccttcgaggggagctgtatgtttcccgacggatgcgatgccgtcgactgcacattctgtcgggaatttctgaagaacccccaatgctatcctgcgaaaaagtggcttttcattatcattgtgatcctgctcggctacgccgggctgatgcttctgaccaatgtcctcaaggctattggcatctggggatcttgggtgatcgccccggttaaactgatttttgctatcattaagaaactgatgcgcaccgtgtcctgtctcatgggcaagctgatggatagagggcggcaggtcatccatgaggaaattggagagaacagagagggcaatcaggacgatgtgcgcatcgaaatggcccggcccagacgcgttcggcactggatgtatagccctgtgattcttacaatcctggccatcgggctcgctgagtcttgcgacgaaatggtccatgcggatagcaaactggtgtcctgtagacagggaagcggcaacatgaaggagtgcgtgacgaccgggcgcgcccttctgcccgctgttaatcctggccaagaggcctgtctccacttcacagcccccggatctccggactccaagtgcctgaaaattaaggtcaaacggatcaacctgaagtgtaaaaagagctcctcttactttgtgcctgatgctagaagccgctgcacctccgtgcggagatgtcgctgggccggcgactgccagtctgggtgtccccctcatttcacaagcaattccttttctgacgattgggcgggaaagatggaccgggctggcctcgggttcagcggatgctccgatggctgcgggggcgccgcctgtggatgctttaacgctgcccccagctgtattttctggagaaaatgggtcgaaaatcctcacggcatcatttggaaggtgtctccctgcgctgcctgggttccgtccgcggtgatcgagctgaccatgcctagcggggaagtccggacgttccaccccatgtctggaatccccacacaggtgtttaaaggcgtttccgtgacctatcttgggagcgacatggaggtctctggactgaccgatctctgtgaaattgaggagctgaagtccaaaaagctggcccttgctccttgcaaccaggccggcatgggcgtggttgggaaagtgggagaaatccaatgtagctccgaggaaagcgctcgcacaattaagaaggacggctgcatctggaacgccgatctcgtcgggattgagctgagagtggacgatgcggtgtgttactctaaaatcaccagcgtcgaagccgttgctaattattccgccatcccgacaacgattggaggcctgcggttcgagagatctcatgacagccaggggaagatctccggatctcccctcgatattaccgctatccgcggcagcttttccgtgaactaccggggcctgagactttctctgagcgagattacagctacctgcacaggggaagtgaccaatgtctccggatgctacagctgtatgacgggcgccaaagtgtctatcaagctccactccagcaaaaactctaccgcccatgttcgctgcaagggggacgagacagcgttctccgtgctggaaggagtccacagctataccgtgtccctgtcttttgatcacgccgttgtggacgagcagtgtcagcttaattgcggcgggcatgaaagccaagtcacactcaagggaaacctgatcttcctggacgtgcctaaatttgttgatggctcctacatgcagacctatcacagcacggtgcccacaggcgctaatattccttctcccaccgactggctcaacgccctgttcgggaatggactttccagatggatcctgggcgtcattggggtgctcctgggaggcctggccctgtttttcatgatcatgagcctctttaagctggggacaaaacaggtgttccggtctcgcaccaagctggcttga

SEQ ID NO: 14732 - RNA, 3222 nt, synthetic construct
  misc_feature 1..3222: note = derived and/or modified CDS sequence (opt5) from SFTSV(36-Lu'an(CHN)-2015)__KX302601.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatgtttgctatcattaagaaactgatgcgcaccgtctcctgtctcatgggcaagctgatggatagagggagacaggtgatccatgaggaaattggagagaaccgggagggcaatcaggacgatgttcgcatcgaaatggcccggcccagacgcgtgcggcactggatgtatagccctgtcgtgcttacaattctggccatcgggctcgctgagtcttgcgacgaaatggtgcatgcggatagcaaactggtttcctgtagacagggaagcggcaacatgaaggagtgcgtcacgaccgggcgcgcccttctgcccgctgtgaatcctggccaagaggcctgtctccacttcacagcccccggatctccggactccaagtgcctgaaaattaaggtgaaacggatcaacctgaagtgtaaaaagagctcctcttactttgtccctgatgctagaagccgctgcacctccgtgcggagatgtcgctgggccggcgactgccagtctgggtgtccccctcatttcacaagcaattccttttctgacgattgggcgggaaagatggaccgggctggcctcgggttcagcggatgctccgatggctgcgggggcgccgcctgtggatgctttaacgctgcccccagctgtatcttctggagaaaatgggttgaaaatcctcacggcattatctggaaggtgtctccctgcgctgcctgggtcccgtccgcggtgattgagctgaccatgcctagcggggaagttcggacgttccaccccatgtctggaatccccacacaggtgtttaaaggcgtctccgtgacctatcttgggagcgacatggaggtttctggactgaccgatctctgtgaaattgaggagctgaagtccaaaaagctggcccttgctccttgcaaccaggccggcatgggcgtggtcgggaaagtgggagaaatccaatgtagctccgaggaaagcgctcgcacaatcaagaaggacggctgcatttggaacgccgatctcgtggggatcgagctgagagtcgacgatgcggtttgttactctaaaattaccagcgtggaagccgtggctaattattccgccatcccgacaacgattggaggcctgcggttcgagagatctcatgacagccaggggaagatctccggatctcccctcgatatcaccgctattcgcggcagcttttccgtcaactaccggggcctgagactttctctgagcgagatcacagctacctgcacaggggaagtgaccaatgtttccggatgctacagctgtatgacgggcgccaaagtgtctattaagctccactccagcaaaaactctaccgcccatgtccgctgcaagggggacgagacagcgttctccgtgctggaaggagttcacagctataccgtgtccctgtcttttgatcacgccgtcgtggacgagcagtgtcagcttaattgcggcgggcatgaaagccaagttacactcaagggaaacctgatcttcctggacgtgcctaaatttgtcgatggctcctacatgcagacctatcacagcacggtgcccacaggcgctaatattccttctcccaccgactggctcaacgccctgttcgggaatggactttccagatggatcctgggcgtgatcggggtcctcctgggaggcctggccctgtttttcatgattatgagcctctttaagctggggacaaaacaggttttccggtctcgcaccaagctggcttga

SEQ ID NO: 14733 - RNA, 3222 nt, synthetic construct
  misc_feature 1..3222: note = derived and/or modified CDS sequence (opt5) from SFTSV(42-Lu'an(CHN)-2015)__KX302602.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggcttcagcgagaagatctgtcaaattgacagacttatccacgtttcctcttggctgcggaatcatagccagtttcaggggtacgtgggacagcgcggcgggagatcccaagtgagctattaccccgccgaaaactcttattcccggtggagcggactcctgtctccttgcgatgcggactggcttggcatgctggtcgtgaaaaaggctaaaggctccgatatgattgttcccgggcctagctacaagggaaaggtgttctttgagcgccccaccttcgacggctatgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacatttctggagcttaagtccttcagccagtctgaatttcccgacatctgcaaaattgatggaatcgtgttcaatcagtgtgagggcgaaagcctgcctcaaccctttgacgtcgcctggatggatgtggggcactcccataagatcattatgcgcgagcacaaaaccaagtgggtgcaggagtctagctccaaggacttcgtctgctacaaagaaggaacaggcccgtgtagcgagtctgaagagaagacctgcaaaacatccgggagctgcagaggagacatgcagttttgtaaggttgctggctgcgaacacggcgaggaggcctctgaagctaaatgtcggtgctccctcgtgcataagcctggggaggtggtcgtgagctatggacgcatgagagttcggcccaaatgttacggcttctcccgcatgatggccaccctggaagtgaaccagcctgagcaaagaatcgggcagtgcacgggatgtcaccttgaatgcattaatggcggggtccggctgatcaccctcacatctgagctcaagagcgcgaccgtgtgtgcctcccatttctgctctagcgctacatccggcaagaaaagcaccgagattcagtttcactctggatccctggttggcaagacggccatccacgtgaaaggggctctggtcgatggaacagagttcacctttgaaggcagctgtatgttccccgacgggtgcgatgccgtggactgcacattttgtcgcgagttcctgaagaacccccaatgctaccctgcgaaaaagtggctttttatcattatcgtcattctgctcggatatgccggcctgatgcttctgaccaatgtgctcaaggctatcgggatttggggctcttgggttatcgccccggtgaaactgatcttcgctattatcaagaaactgatgagaaccgtctcctgtctcatgggaaagctgatggatcggggcagacaggtgattcatgaagaaatcggggagaaccgcgagggaaatcaggacgatgttcggattgaaatggccagaccccgccgggtgagacactggatgtacagccctgtcatccttacaattctggccatcggcctcgctgagtcttgcgacgaaatggtgcatgcggatagcaaactggtgtcctgtcgccaggggagcggaaacatgaaggagtgcgttacgaccggccgggcccttctgcccgctgtcaatcctgggcaagaggcctgtctccactttacagcccccggctctccggactccaagtgcctgaaaatcaaggtgaaaagaattaacctgaagtgtaaaaagagctcctcttatttcgtgcctgatgctcgcagccggtgcacctccgtcagacgctgtcggtgggccggagactgccagtctggctgtccccctcattttacaagcaattccttctctgacgattgggcggggaagatggacagagctggactcggctttagcgggtgctccgatggatgcggcggggccgcctgtggctgcttcaacgctgcccccagctgtatcttctggcggaaatgggtggaaaatcctcacggaattatctggaaggtttctccctgcgctgcctgggtgccgtccgcggtcattgagctgaccatgcctagcggcgaagtgcgcacgtttcaccccatgtctgggatccccacacaggttttcaaaggagtgtccgtcacctaccttggcagcgacatggaggtgtctgggctgaccgatctctgtgaaatcgaggagctgaagtccaaaaagctggcccttgctccttgcaaccaggccggaatgggcgttgtgggcaaagtcggggaaattcaatgtagctccgaggaaagcgctagaacaatcaagaaggacggatgcatttggaacgccgatctcgtgggcatcgagctgcgggtggacgatgcggtctgttattctaaaattaccagcgttgaagccgtgtccaattactctgctatcccgacaacgatcgggggactgagatttgagcgcagccatgactcccagggcaagatttctgggagccccctcgatatcaccgccattcggggatccttctctgtgaactatagaggcctgcgccttagcctgtccgagatcacagctacctgcacaggcgaagtcaccaatgtgagcgggtgctactcttgtatgacgggagccaaagtttccattaagctccacagctctaaaaactccaccgcccatgtgagatgcaagggcgacgagacagcttttagcgtcctggaaggggtgcactcctacaccgtttctctgagcttcgatcacgcggtggtcgacgagcagtgtcagcttaattgcggaggccatgaatcccaagtgacactcaaggggaacctgatctttctggacgttcctaaattcgtggatggaagctatatgcagacctaccactctacggtccccacaggcgccaatatcccttcccccaccgactggctcaacgctctgtttggcaatgggcttagccggtggattctgggagtgatcggcgtgctccttgggggactggccctgttctttatgattatgtctctcttcaagctgggcacaaaacaggtctttcgcagcagaaccaagctggcctga

SEQ ID NO: 14734 - RNA, 3222 nt, synthetic construct
  misc_feature 1..3222: note = derived and/or modified CDS sequence (opt5) from SFTSV(44-Lu'an(CHN)-2015)__KX302603.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggcttcagcgagaagatctgtcaaattgacagacttatccacgtttcctcttggctgcggaatcatagccagtttcaggggtacgtgggacagcgcggcgggagatcccaagtgagctattaccccgccgaaaactcttattcccggtggagcggactcctgtctccttgcgatgcggactggcttggcatgctggtcgtgaaaaaggctaaaggctccgatatgattgttcccgggcctagctacaagggaaaggtgttctttgagcgccccaccttcgacggctatgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacatttctggagcttaagtccttcagccagtctgaatttcccgacatctgcaaaattgatggaatcgtgttcaatcagtgtgagggcgaaagcctgcctcaaccctttgacgtcgcctggatggatgtggggcactcccataagatcattatgcgcgagcacaaaaccaagtgggtgcaggagtctagctccaaggacttcgtctgctacaaagaaggaacaggcccgtgtagcgagtctgaagagaagacctgcaaaacatccgggagctgcagaggagacatgcagttttgtaaggttgctggctgcgaacacggcgaggaggcctctgaagctaaatgtcggtgctccctcgtgcataagcctggggaggtggtcgtgagctatggaggcatgcgcgttagacccaaatgttacgggttctcccggatgatggccaccctggaagtgaaccagcctgagcaacgcatcggacagtgcacgggctgtcaccttgaatgcattaatgggggcgtcagactgatcaccctcacatctgagctcaagagcgcgaccgtgtgtgcctcccatttctgctctagcgctacatccggaaagaaaagcaccgagattcagtttcactctggctccctggttgggaagacggccatccacgtgaaaggagctctggtcgatggcacagagttcacctttgaagggagctgtatgttccccgacggatgcgatgccgtggactgcacattttgtcgggagttcctgaagaacccccaatgctaccctgcgaaaaagtggctttttatcattatcgtcattctgctcggctatgccgggctgatgcttctgaccaatgtgctcaaggctatcggcatttggggatcttgggttatcgccccggtgaaactgatcttcgctattatcaagaaactgatgcgcaccgtctcctgtctcatgggcaagctgatggatagagggagacaggtgattcatgaagaaatcggagagaaccgggagggcaatcaggacgatgttcgcattgaaatggcccggcccagacgcgtgcggcactggatgtacagccctgtcatccttacaattctggccatcgggctcgctgagtcttgcgacgaaatggtgcatgcggatagcaaactggtgtcctgtagacagggaagcggcaacatgaaggagtgcgttacgaccgggcgcgcccttctgcccgctgtcaatcctggccaagaggcctgtctccactttacagcccccggatctccggactccaagtgcctgaaaatcaaggtgaaacggattaacctgaagtgtaaaaagagctcctcttatttcgtgcctgatgctagaagccgctgcacctccgtccggagatgtcgctgggccggcgactgccagtctgggtgtccccctcattttacaagcaattccttctctgacgattgggcgggaaagatggaccgggctggcctcgggtttagcggatgctccgatggctgcgggggcgccgcctgtggatgcttcaacgctgcccccagctgtatcttctggagaaaatgggtggaaaatcctcacggcattatctggaaggtttctccctgcgctgcctgggtgccgtccgcggtcattgagctgaccatgcctagcggggaagtgcggacgtttcaccccatgtctggaatccccacacaggttttcaaaggcgtgtccgtcacctaccttgggagcgacatggaggtgtctggactgaccgatctctgtgaaatcgaggagctgaagtccaaaaagctggcccttgctccttgcaaccaggccggcatgggcgttgtggggaaagtcggagaaattcaatgtagctccgaggaaagcgctcgcacaatcaagaaggacggctgcatttggaacgccgatctcgtggggatcgagctgagagtggacgatgcggtctgttattctaaaattaccagcgttgaagccgtgtccaattactctgctatcccgacaacgatcggaggcctgcggtttgagagaagccatgactcccaggggaagatttctggaagccccctcgatatcaccgccattcgcggctccttctctgtgaactatcggggcctgagacttagcctgtccgagatcacagctacctgcacaggggaagtcaccaatgtgagcggatgctactcttgtatgacgggcgccaaagtttccattaagctccacagctctaaaaactccaccgcccatgtgcgctgcaagggggacgagacagcttttagcgtcctggaaggagtgcactcctacaccgtttctctgagcttcgatcacgcggtggtcgacgagcagtgtcagcttaattgcggcgggcatgaatcccaagtgacactcaagggaaacctgatctttctggacgttcctaaattcgtggatggcagctatatgcagacctaccactctacggtccccacaggcgccaatatcccttcccccaccgactggctcaacgctctgtttgggaatggacttagcagatggattctgggcgtgatcggggtgctcctgggaggcctggcccttttctttatgattatgtctctcttcaagctggggacaaaacaggtctttcggagccgcaccaagctggcctga

SEQ ID NO: 14735 - RNA, 3222 nt, synthetic construct
  misc_feature 1..3222: note = derived and/or modified CDS sequence (opt5) from SFTSV(52-Lu'an(CHN)-2015)__KX302604.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgcgcaccgtctcctgtctcatgggcaagctgatggatagagggagacaggtgattcatgaggaaatcggagagaaccgggagggcaatcaggacgatgttcgcattgaaatggcccggcccagacgcgtgcggcactggatgtatagccctgtcatccttacaattctggccatcgggctcgctgagtcttgcgacgaaatggtgcatgcggatagcaaactggtgtcctgtagacagggaagcggcaacatgaaggagtgcgttacgaccgggcgcgcccttctgcccgctgtcaatcctggccaagaggcctgtctccacttcacagcccccggatctccggactccaagtgcctgaaaatcaaggtgaaacggattaacctgaagtgtaaaagaagctcctcttactttgtgcctgatgctcgcagccggtgcacctccgtcagacgctgtcggtgggccggcgactgccagtctgggtgtccccctcatttcacaagcaattccttttctgacgattgggcgggaaagatggacagagctggcctcgggttcagcggatgctccgatggctgcgggggcgccgcctgtggatgctttaacgctgcccccagctgtatcttctggcggaagtgggtggaaaatcctcacggcattatctggaaagtttctccctgcgctgcctgggtgccgtccgcggtcattgagctgaccatgcctagcggggaagtgcgcacgttccaccccatgtctggaatccccacacaggtttttaagggcgtgtccgtcacctatcttgggagcgacatggaggtgtctggactgaccgatctctgtgaaatcgaggagctgaaatccaagaaactggcccttgctccttgcaaccaggccggcatgggcgttgtggggaaggtcggagaaattcaatgtagctccgaggaaagcgctagaacaatcaaaaaggacggctgcatttggaacgccgatctcgtggggatcgagctgcgggtggacgatgcggtctgttactctaagattaccagcgttgaagccgtggctaattattccgccatcccgacaacgatcggaggcctgagattcgagcgctctcatgacagccaggggaaaatttccggatctcccctcgatatcaccgctattcggggcagcttttccgtgaactacagaggcctgcgcctttctctgagcgagatcacagctacctgcacaggggaagtcaccaatgtgtccggatgctacagctgtatgacgggcgccaaggtttctattaaactccactccagcaagaactctaccgcccatgtgagatgcaaaggggacgagacagcgttctccgtcctggaaggagtgcacagctataccgtttccctgtcttttgatcacgccgtggtcgacgagcagtgtcagcttaattgcggcgggcatgaaagccaagtgacactcaagggaaacctgatcttcctggacgttcctaagtttgtggatggctcctacatgcagacctatcacagcacggtccccacaggcgctaatatcccttctcccaccgactggctcaacgccctgttcgggaatggactttcccggtggattctgggcgtgatcggggtgctcctgggaggcctggccctgtttttcatgattatgagcctctttaaactggggacaaagcaggtcttccgctctagaaccaaactggcttga

SEQ ID NO: 14736 - RNA, 3222 nt, synthetic construct
  misc_feature 1..3222: note = derived and/or modified CDS sequence (opt5) from SFTSV(HL/Injected)__KF791953.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagcttaagagcttctctcagtccgaatttcccgacatctgcaaaattgatggcatcgtgttcaatcagtgtgagggggaaagcctccctcaaccctttgacgtcgcctggatggatgtgggacactctcataagatcattatgcgcgagcacaaaacaaagtgggtgcaggagagctcctctaaggacttcgtctgctataaagaaggcaccgggccgtgtagcgagtccgaagagaagacatgcaaaaccagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacgcttgaagtgagccagcctgagcaacgcatcggccagtgcaccgggtgtcacctggaatgcattaacggcggagtcagactcatcacactgacctccgagctgaagtctgcgacagtgtgtgccagccatttttgctcctctgctaccagcggcaagaaatccacggagattcagttccacagcgggtctctcgttggaaagacagccatccacgtgaaaggcgctctggtcgatgggaccgagttcacatttgaaggatcctgtatgttccccgacggctgcgatgccgtggactgcaccttttgtcgggagttccttaagaatccccaatgctatcctgcgaaaaagtggctgtttatcattatcgtcattctcctggggtacgccggccttatgctgctcaccaacgtgctgaaggctatcggagtttggggcagctgggtgattgccccggtcaaactggtgttcgctatcatcaagaaactcatgcgcgccgtttcttgtctgatggggaagctgatggatagaggaagacaggtgattcatgaagaaatcggcgagaatcgggaggggaaccaggacgatgtccgcattgaaatggcccggcccagacgcgtgcggcactggatgtattcccctgtgatcctgacaattctcgctatcggactggcggagggctgcgacgaaatggttcatgccgatagcaaacttgtctcttgtagacaggggagcggcaatatgaaggagtgcgtgacgaccggacgcgctctgctccccgccgtgaaccctggccaagaggcctgtctgcactttacagctcccgggtccccggacagcaagtgcctgaaaattaaggtcaaacggatcaatctcaagtgtaaaaagtcttccagctacttcgtgcctgatgccagatcccgctgcacctctgttcggagatgtcgctgggcgggagactgccagagcggctgtccccctcattttacatccaactctttcagcgacgattgggctgggaagatggaccgggccggactgggcttttccgggtgctctgatggctgcggaggcgccgcttgtgggtgcttcaatgccgctcccagctgtatcttttggagaaaatgggtggaaaaccctcacggaattatctggaaggtctccccctgcgccgcgtgggtgccgagcgccgttattgagcttaccatgccttctggcgaagtgcggacgttccaccccatgtccgggatccccacacaggtcttcaaaggagtgagcgttacctatctgggctctgacatggaggtgtccggcctcaccgatctgtgtgaaattgaggagcttaagagcaaaaagctggctctcgccccttgcaatcaggctgggatgggagtcgtgggcaaagtgggggaaatccaatgttcttccgaggaaagcgcccgcacaatcaagaaggacggatgcatttggaacgcggatctggtcggcatcgagctgagagttgacgatgccgtgtgttactccaaaattaccagcgtggaagctgtcgccaactattctgctatcccgacaacgattgggggactccggtttgagagaagccatgactcccagggcaagatctctggcagccccctggatatcaccgccattcgcgggtccttctctgtgaattaccggggacttagactgagcctctccgagatcacagctacctgcacaggcgaagttaccaacgtgtctgggtgctacagctgtatgacgggagccaaagtctccattaagctgcacagctctaaaaattccaccgcgcatgtgcgctgcaagggcgacgagacagcctttagcgttctggaaggggtgcactcttattccgtcagcctttccttcgatcacgctgtggttgacgagcagtgtcagctcaactgcggaggccatgaatctcaagtgaccctgagaggcaatctgatctttctcgacgtccctaagttcgtggatgggagctacatgcagacatatcactccaccgtgcccacgggagccaacattcctagccccacagactggctgaatgccctttttggcaacgggctgtctcggtggatcctcggagtcatcggcgttctgcttgggggactggctctcttctttctgattatgtccctgttcaaactcggcaccaagcagatctttcgcagcagaacaaaactggcctga

SEQ ID NO: 14737 - RNA, 3222 nt, synthetic construct
  misc_feature 1..3222: note = derived and/or modified CDS sequence (opt5) from SFTSV(HL/Larvae/G2)__KF791955.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattcccggacctctagcggcctgctcccttccgaccgcgtgctgtggatcggggatgttgcctgtcagccgatgacacccattcctgaagagacctttcttgagcttaagagcttctctcagtccgaatttcccgacatctgcaaaattgatggaatcgtgttcaatcagtgtgagggcgaaagcctccctcaaccctttgacgtcgcctggatggatgtggggcactctcataagatcattatgagagagcacaaaacaaagtgggtgcaggagagctcctctaaggacttcgtctgctataaagaaggaaccggcccgtgtagcgagtccgaagagaagacatgcaaaaccagcgggtcttgccggggagacatgcagttttgtaaggttgctggctgcgaacacggcgaggaggcctccgaagctaaatgtcgctgcagcctggtgcataagcctggggaggtggtcgtgtcttacggaggcatgagagttcggcccaaatgttacgggttctcccgcatgatggccacgcttgaagtgagccagcctgagcaaagaatcggacagtgcaccggctgtcacctggaatgcattaacgggggcgtccggctcatcacactgacctccgagctgaagtctgcgacagtgtgtgccagccatttttgctcctctgctaccagcggaaagaaatccacggagattcagttccacagcggctctctcgttgggaagacagccatccacgtgaaaggagctctggtcgatggcaccgagttcacatttgaagggtcctgtatgttccccgacggatgcgatgccgtggactgcaccttttgtcgcgagttccttaagaatccccaatgctatcctgcgaaaaagtggctgtttatcattatcgtcattctcctgggctacgccgggcttatgctgctcaccaacgtgctgaaggctatcggcgtttggggaagctgggtgattgccccggtcaaactggtgttcgctatcatcaagaaactcatgagagccgtttcttgtctgatgggcaagctgatggatcgggggagacaggtgattcatgaagaaatcggagagaatcgcgagggcaaccaggacgatgtccggattgaaatggccagaccccgccgggtgagacactggatgtattcccctgtgatcctgacaattctcgctatcgggctggcggagggatgcgacgaaatggttcatgccgatagcaaacttgtctcttgtcgccagggcagcgggaatatgaaggagtgcgtgacgaccggccgggctctgctccccgccgtgaaccctggacaagaggcctgtctgcactttacagctcccggctccccggacagcaagtgcctgaaaattaaggtcaaaagaatcaatctcaagtgtaaaaagtcttccagctacttcgtgcctgatgcccgctcccggtgcacctctgttagacgctgtcggtgggcgggggactgccagagcggatgtccccctcattttacatccaactctttcagcgacgattgggctggcaagatggacagagccgggctgggattttccggctgctctgatgggtgcggcggagccgcttgtggctgcttcaatgccgctcccagctgtatcttttggcggaaatgggtggaaaaccctcacgggattatctggaaggtctccccctgcgccgcgtgggtgccgagcgccgttattgagcttaccatgccttctggagaagtgcgcacgttccaccccatgtccggcatccccacacaggtcttcaaaggggtgagcgttacctatctgggatctgacatggaggtgtccggcctcaccgatctgtgtgaaattgaggagcttaagagcaaaaagctggctctcgccccttgcaatcaggctggcatgggggtcgtgggaaaagtgggcgaaatccaatgttcttccgaggaaagcgccagaacaatcaagaaggacgggtgcatttggaacgcggatctggtcggaatcgagctgcgggttgacgatgccgtgtgttactccaaaattaccagcgtggaagctgtcgccaactattctgctatcccgacaacgattggcgggctcagatttgagcgcagccatgactcccagggaaagatctctggcagccccctggatatcaccgccattcggggctccttctctgtgaattacagagggcttcgcctgagcctctccgagatcacagctacctgcacaggagaagttaccaacgtgtctggctgctacagctgtatgacgggggccaaagtctccattaagctgcacagctctaaaaattccaccgcgcatgtgagatgcaagggagacgagacagcctttagcgttctggaaggcgtgcactcttattccgtcagcctttccttcgatcacgctgtggttgacgagcagtgtcagctcaactgcgggggacatgaatctcaagtgaccctgcggggcaatctgatctttctcgacgtccctaagttcgtggatggcagctacatgcagacatatcactccaccgtgcccacgggggccaacattcctagccccacagactggctgaatgccctttttggaaacggcctgtctcgctggatcctcggggtcatcggagttctgctgggcgggcttgctctcttctttctgattatgtccctgttcaaactcggaaccaagcagatctttagaagccggacaaaactggcctga

SEQ ID NO: 14738 - RNA, 3222 nt, synthetic construct
  misc_feature 1..3222: note = derived and/or modified CDS sequence (opt5) from SFTSV(JS2011-004)__KC505124.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagcttaagagcttctctcagtccgaatttcccgacatctgcaaaattgatggcatcgtgttcaatcagtgtgggggagagagcctccctcaaccctttgacgtcgcctggatggatgtgggccactctcataagatcattatgcgcgaacacaaaacaaagtgggtgcaggagagctcctctaaggacttcgtctgctataaagaggggaccggaccgtgtagcgaatccgaggaaaagacatgcaaaaccagcggctcttgcagaggcgacatgcagttttgtaaggttgctgggtgcgagcacggagaagaggcctccgaggctaaatgtcggtgcagcctggtgcataagcctggcgaagtggtcgtgtcttacgggggaatgcgcgttagacccaaatgttacggcttctcccggatgatggccacgcttgaggtgaaccagcctgaacaacgcatcgggcagtgcaccggctgtcacctggagtgcattaatggaggcgtcagactcatcacactgaccagcgaactgaagtccgcgacagtgtgtgcctctcatttttgcagctccgctacctctgggaagaaaagcacggagattcagttccactccggaagcctcgttggcaagacagccatccacgtgaaaggggctctggtcgatggaaccgagttcacatttgaaggctcttgtatgttccccgacgggtgcgatgccgtggactgcaccttttgtcgggagttccttaagaacccccaatgctatcctgcgaaaaagtggctgtttatcattatcgtcattctcctgggctacgccggacttatgctgctcaccaatgtgctgaaggctatcggcgtttgggggtcctgggtgattgccccggtcaaactggtgttcgctatcatgaagaaactcatgcgcgccgttagctgtctgatgggaaagctgatggatagaggcagacaggtgatccatgaagagattggggaaaaccgggagggaaatcaggacgatgtccgcatcgagatggcccggcccagacgcgtgcggcactggatgtattctcctgtgattctgacaatcctcgctattggcctggcggaagggtgcgacgagatggttcatgccgattccaaacttgtcagctgtagacagggctctggaaacatgaaggaatgcgtgacgaccggccgcgctctgctccccgccgtgaatcctgggcaagaggcctgtctgcactttacagctcccggaagcccggactccaagtgcctgaaaatcaaggtcaaacggattaacctcaagtgtaaaaagagcagctcctacttcgtgcctgatgccagaagccgctgcacctccgttcggagatgtcgctgggcgggcgactgccagtctgggtgtccccctcattttacaagcaattccttctctgacgattgggctggaaagatggaccgggccggcctggggtttagcggctgctccgatggatgcggcggggccgcttgtggatgcttcaacgccgctccctcttgtatcttttggagaaaatgggtggagaatcctcacggcatcatttggaaggtcagcccctgcgccgcgtgggtgccgtccgccgttatcgaacttaccatgcctagcggggaggtgcggacgttccaccccatgtctggcattcccacacaggtcttcaaaggagtgtccgttacctatctgggcagcgacatggaagtgtctgggctcaccgatctgtgtgagatcgaggaactgaagtccaaaaagctcgctcttgccccttgcaaccaggctggaatgggcgtcgtggggaaagtgggagagattcaatgtagctctgaagagtccgcccgcacaatcaagaaggacggctgcatctggaacgcggatctggtcgggattgaactgagagttgacgatgccgtgtgttacagcaaaatcacctccgtggaggctgtcgccaattatagcgctattccgacaacgatcggaggcctccggtttgaaagatctcatgacagccagggcaagatttccgggtctcccctggatatcaccgccatccgcggatctttctccgtgaactaccggggccttagactgtctctcagcgagattacagctacctgcacaggggaggttaccaatgtgtccggatgctactcttgtatgacgggcgccaaagtcagcatcaagctgcactccagcaaaaactctaccgcgcatgtgcgctgcaagggggacgaaacagccttttccgttctggagggagtgcacagctattctgtctcccttagcttcgatcacgctgtggttgacgaacagtgtcagctcaattgcggcggccatgagtcccacgtgaccctgaaggggaacctgatttttctcgacgtccctaaattcgtggatggatcttacatgcaaacatatcatagcaccgtgcccacgggcgccaatatcccttcccccacagactggctgaacgccctttttgggaatggactgagcagatggattctcggcgtcatcggggttctgctgggaggccttgctctcttctttctgatcatgtctctgttcaagctcggcaccaaacaggtgtttcggtcccgcacaaagctggcctga

SEQ ID NO: 14739 - RNA, 3222 nt, synthetic construct
  misc_feature 1..3222: note = derived and/or modified CDS sequence (opt5) from SFTSV(JS2011-013-1)__KC505127.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgccttggacagtgcacgggctgtcacctggaatgcatcaatgggggcgtcagactcattaccctgacatctgagcttaagagcgcgaccgtgtgtgcctcccatttctgctctagcgctacatccggaaagaaaagcaccgagatccagttccactctggctccctcgttgggaagacggccattcacgtgaaaggagctctggtcgatggcacagaatttaccttcgaggggagctgtatgtttcccgacggatgcgatgccgtggactgcacattctgtcgggaatttcttaagaacccccaatgctatcctgcgaaaaagtggctgttcatcatcattgtcatcctcctgggctacgccgggcttatgctgctcaccaatgtgctgaaggctattggcatctggggatcttgggttattgccccggtgaaactgatgtttgctatcatcaagaaactcatgcgcaccgtctcctgtctgatgagaaagctgatggatcggggcagacaggtgattcatgaggaaatcggggagaaccgcgagggaaatcaggacgatgttcggattgaaatggccagaccccgccgggtgagacactggatgtatagccctgtcatcctgacaattctcgccatcggcctggctgagtcttgcgacgaaatggtgcatgcggatagcaaacttgtgtcctgtcgccaggggagcggaaacatgaaggagtgcgttacgaccggccgggccctgctccccgctgtcaatcctgggcaagaggcctgtctgcacttcacagcccccggctctccggactccaagtgcctgaaaattaaggtgaaaagaatcaacctcaagtgtaaaaagagctcctcttactttgtgcctgatgctcgcagccggtgcacctccgtcagacgctgtcggtgggccggagactgccagtctggctgtccccctcatttcacaagcaattccttttctgacgattgggcggggaagatggacagagctggactgggcttcagcgggtgctccgatggatgcggcggggccgcctgtggctgctttaacgctgcccccagctgtatcttctggcggaaatgggtggaaaatcctcacggaattatctggaaggtttctccctgcgctgcctgggtgccgtccgcggtcattgagcttaccatgcctagcggcgaagtgcgcacgttccaccccatgtctgggatccccacacaggtttttaaaggagtgtccgtcacctatctgggcagcgacatggaggtgtctgggctcaccgatctgtgtgaaattgaggagctgaagtccaaaaagctcgcccttgctccttgcaaccaggccggaatgggcgttgtgggcaaagtcggggaaatccaatgtagctccgaggaaagcgctagaacaatcaagaaggacggatgcatttggaacgccgatctggtgggcatcgagctgcgggtggacgatgcggtctgttactctaaaattaccagcgttgaagccgtggctaattattccgccatcccgacaacgattgggggactcagattcgagcgctctcatgacagccagggcaagatctccgggtctcccctggatatcaccgctattcggggatctttttccgtgaaatacagaggccttcgcctgtctctcagcgagatcacagctacctgcacaggcgaagtcaccaacgtgtccgggtgctacagctgtatgacgggagccaaggtttctattaaactgcactccagcaagaatagcaccgcccatgtgagatgcaagggcgacgagacagcgttctccgtcctggaagggggacacagctataccgtgtccctttcttttgatcacgccgttgtggacgagcagtgtcagctcaactgcggcgggcatgaaagccaagtcacactgaaaggaaatctgatcttcctcgacgtgcctaagtttgttgatggctcctacatgcagacctatcacagcacggtgcccacaggcgctaacattccttctcccaccgactggctgaatgcccttttcgggaacggactgtcccggtggatcctcggcgtcatcggggtgctgctgggaggccttgccctctttttcatgattatgagcctgtttaaactggggacaaaacaggtgttccgctctagaaccaagctcgcttga

SEQ ID NO: 14740 - RNA, 3222 nt, synthetic construct
  misc_feature 1..3222: note = derived and/or modified CDS sequence (opt5) from SFTSV(JS2011-027)__KC505130.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagcttaagagcttctctcagtccgaatttcccgacatctgcaaaattgatggcatcgtgttcaatcagtgtgagggggaaagcctccctcaaccctttgacgtcgcctggatggatgtgggacactctcataagatcattatgcgcgagcacaaaacaaagtgggtgcaggagagctcctctaaggacttcgtctgctataaagaaggcaccgggccgtgtagcgagtccgaagagaagacatgcaaaaccagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacgcttgaagtgaacgagcctgaacagcgcatcggccaatgcaccgggtgtcacctggagtgcattagcggcggagtcagactcatcacactgacctccgagctgaagtctgcgacagtgtgtgccagccatttttgctcctctgctaccagcggcaagaaatccacggaaattcagttccacagcgggtctctcgttggaaagacagccatccacgtgaaaggcgctctggtcgatgggaccgagttcacatttgaaggatcctgtatgttccccgacggctgcgatgccgtggactgcaccttttgtcgggagttccttaagaatccccagtgctatcctgcgaaaaagtggctgtttatcattatcgtcattctcctggggtacgccggccttatgctgctcaccaacgtgctgaaggctatcggagtttggggcagctgggtgattgccccggtcaaactggtgttcgctatcatcaagaaactcatgcgcgccgtttcttgtctgatggggaagctgatggatagaggacggcaagtgattcatgaagagatcggcgagaatagagaagggaaccaggacgatgtccgcattgagatggcccggcccagacgcgtgcggcactggatgtattcccctgtgatcctgacaattctcgctatgggactggcggaaggctgcgacgagatggttcatgccgatagcaaacttgtctcttgtagacaggggagcggcaatatgaaggagtgcgtgacgaccggacgcgctctgctccccgccgtgaaccctggccaggaagcctgtctgcactttacagctcccgggtccccggacagcaagtgcctgaaaatcaaggtcaaacggattaatctcaagtgtaaaaagtcttccagctacttcgtgcctgatgccagatcccgctgcacctctgttcggagatgtcgctgggcgggagactgccaaagcggctgtccccctcattttacatccaactctttcagcgacgattgggctgggaagatggaccgggccggactgggcttttccgggtgctctgatggctgcggaggcgccgcttgtgggtgcttcaatgccgctcccagctgtatcttttggagaaaatgggtggagaaccctcacggaatcatttggaaggtctccccctgcgccgcgtgggtgccgagcgccgttatcgaacttaccatgccttctggcgaggtgcggacgttccaccccatgtccgggattcccacacaggtcttcaaaggagtgagcgttacctatctgggctctgacatggaagtgtccggcctcaccgatctgtgtgagatcgaggaacttaagagcaaaaagctggctctcgccccttgcaatcaggctgggatgggagtcgtgggcaaagtgggggagattcagtgttcttccgaagagagcgcccgcacaatcaagaaggacggatgcatctggaacgcggatctggtcggcattgaactgagagttgacgatgccgtgtgttactccaaaatcaccagcgtggaggctgtcgccaactattctgctattccgacaacgatcgggggactccggtttgagagaagccatgactcccaaggcaagatttctggcagccccctggatatcaccgccatccgcgggtccttctctattaattaccggggacttagactgagcctctccgaaatcacagctacctgcacaggcgaggtgaccaacgtttctgggtgctacagctgtatgacgggagccaaagtgtccattaagctgcacagctctaaaaattccaccgcgcatgtccgctgcaagggcgacgaaacagcctttagcgtgctggagggggttcactcttattccgtgagcctttccttcgatcacgctgtcgtggacgaacagtgtcagctcaactgcggaggccatgagtctcaggttaccctgagaggcaatctgatctttctcgacgtgcctaagttcgtcgatgggagctacatgcaaacatatcactccaccgtgcccacgggagccaacattcctagccccacagactggctgaatgccctttttggcaacgggctgtctcggtggatcctcggagtgatcggcgtcctgcttgggggactggctctcttctttctgattatgtccctgttcaaactcggcaccaagcaggtttttcgcagcagaacaaaactggcctga

SEQ ID NO: 14741 - RNA, 3222 nt, synthetic construct
  misc_feature 1..3222: note = derived and/or modified CDS sequence (opt5) from SFTSV(JS2011-034)__KC505133.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcatcagacccaaatgttacgggttttcccggatgatggccaccctggaagttaaccagcctgagcaacgcattggacagtgcacgggctgtcaccttgaatgcatcaatgggggcgtgagactgattaccctcacatctgagctcaagagcgcgaccgtctgtgcctcccatttctgctctagcgctacatccggaaagaaaagcaccgagatccagttccactctggctccctggtggggaagacggccatccacgttaaaggagctctggtggatggcacagaatttaccttcgaggggagctgtatgtttcccgacggatgcgatgccgtcgactgcacattctgtcgggaatttctgaagaacccccaatgctatcctgcgaaaaagtggcttttcattatcattgtgatcctgctcggctacgccgggctgatgcttctgaccaatgtcctcaaggctattggcatctggggatcttgggtgatcgccccggttaaactgatgtttgctattatcaagaaactgatgcgcaccgtgtcctgtctcatgggcaagctgatggatagagggcggcaggtcattcatgaggaaatcggagagaacagagagggcaatcaggacgatgtgcgcattgaaatggcccggcccagacgcgttcggcactggatgtatagccctgtgatccttacattcctggccattgggctcgctgagtcttgcgacgaaatggtccatgcggatagcaaactggtgtcctgtagacagggaagcggcaacatgaaggagtgcgtgacgaccgggcgcgcccttctgcccgctgttaatcctggccaagaggcctgtctccactttacagcccccggatctccggactccaagtgcctgaaaatcaaggtcaaacggatcaacctgaagtgtaaaaagagctcctcttacttcgtgcctgatgctagaagccgctgcacctccgtgcggagatgtcgctgggccggcgactgccagtctgggtgtccccctcattttacaagcaattccttctctgacgattgggcgggaaagatggaccgggctggcctcgggtttagctgctgctccgatggatgtggcggggccgcctgcggctgtttcaacgctgcccccagctgcattttctggagaaaatgggtcgaaaatcctcacggaatcatttggaaggtgtctccctgtgctgcctgggttccgtccgcggtgatcgagctgaccatgcctagcggcgaagtccggacgtttcaccccatgtctgggattcccacacaggtgttcaaaggagtttccgtgacctatcttggcagcgacatggaggtctctgggctgaccgatctctgcgaaatcgaggagctgaagtccaaaaagctggcccttgctccttgtaaccaggccggaatgggcgtggttggcaaagtgggggaaatccaatgcagctccgaggaaagcgctcgcacaattaagaaggacggatgtatctggaacgccgatctcgtcggcattgagctgagagtggacgatgcggtgtgctactctaaaatcaccagcgtcgaagccgttgctaattattccgccattccgacaacgatcgggggactgcggtttgagagatctcatgacagccagggcaagatctccgggtctcccctcgatattaccgctatccgcgggagcttctccgtgaactaccggggcctgagactttctctgagcgagattacagctacctgcacaggcgaagtgaccaatgtctccgggtgttacagctgcatgacgggagccaaagtgtctatcaagctccactccagcaaaaactctaccgcccatgttcgctgtaagggcgacgagacagcgttttccgtgctggaaggggtccacagctataccgtgtccctgtctttcgatcacgccgttgtggacgagcagtgccagcttaattgtggaggccatgaaagccaagtcacactcaaggggaacctgatttttctggacgtgcctaaattcgttgatggatcctacatgcagacctatcacagcacggtgcccacaggcgctaatatcccttctcccaccgactggctcaacgccctgtttggcaatgggctttccagatggatcctgggagtcattggcgtgctcctgggaggactggcccttttctttatgatcatgagcctcctgaagctgggcacaaaacaggtgtaccggtctcgcaccaagctcgcttga

SEQ ID NO: 14742 - RNA, 3222 nt, synthetic construct
  misc_feature 1..3222: note = derived and/or modified CDS sequence (opt5) from SFTSV(JS2011-062)__KC505136.1__GP
  source 1..3222: mol_type = other RNA
atgatgaaggtgatctggttcagctccctgatttgcctcgtcatccagtgttctggcgacagcgggcccattatctgcgccggacctattcactccaacaagtctgctgatatcccgcatctgcttggctacagcgagaagatctgtcaaattgacagactgatccacgtttcctcttggctccggaatcatagccagtttcaggggtatgtgggacagcgcggcgggagatcccaagtgagctactatcccgccgtcaactcttactcccggtggagcggactgctttctccttgcgatgcggactggctgggcatgctcgtggttaaaaaggctaaaggctccgatatgattgtgcccgggcctagctataagggaaaggtcttctttgaacgccccaccttcgacggctacgtggggtggggatgtggctctgggaaatccagaacagagagcggagaactgtgctcctctgatagcggcacgtccagcggcctgctcccttctaatcgggttctgtggatcggggacgtggcctgtcagccgatgacccccattcctgaggaaacatttcttgagctgaagtccttcagccagtctgagtttcccgatatctgcaaaattgacggaatcgtcttcaaccagtgtgaaggcgagagcctccctcaaccctttgatgtggcctggatggacgtggggcactcccataagatcattatgcgcgaacacaaaaccaagtgggtccaggagtctagctccaaggatttcgtttgctataaagagggaacaggcccgtgtagcgaatctgaggaaaaggcttgcaaaacctccgggagctgcagaggagacatgcagttttgtaaggtggccggctgcgagcacggcgaagaggcttctgaggccaaatgtcggtgctccctggtgcataagcctggggaagtcgtggttagctacggaggcatgcgcgtgagacccaaatgttacgggttctcccggatgatggcgacacttgaggtcaatcctcccgaacagcgcatcggacaatgcaccggctgtcacctggagtgcattaacgggggcgtgagactcatcacgctgacctctgaacttaagagcgccacagtttgtgcttcccatttttgctctagcgccacctccggaaagaaaagcacagagattcagttccactctggctccctcgtggggaagaccgctatccacgtcaaaggagccctggtggacggcacggagttcacatttgaagggagctgtatgttccccgatggatgcgacgcggtcgattgcaccttttgtcgggagttccttaagaatcctcagtgctatccggccaaaaagtggctgtttatcattatcgtgattctcctgggctacgctgggcttatgctgctcacaaacgttctgaaggccatcggcgtgtggggatcttgggtcattgctcccgtgaaactgatgttcgccatcatgaagaaactcatgcgcaccgtttcctgtctgatgggcaagctgatcgacagagggcggcaagtgattcatgaagagatcggagaaaatggcgaggggaacagagatgacgtccgcattgagatggcccggcctagacgcgtgcggcactggatgtatagccccgtgatcctgaccattctcgctatcggactggcggaaggctgcgatgagatggttcatgccgactctaaacttgtcagctgtagacaggggtccggcaatatgaaggaatgcgtgacaacgggacgcgctctgctccctgccgtgaaccccggccaggaggcctgtctgcactttaccgctccggggagccctgattctaagtgcctgaaaattaaggtcaaacggatcaatctcaagtgtaaaaagtccagctcctacttcgtgcccgacgccagatctcgctgcacaagcgttcggagatgtcgctgggcgggagattgccagtccggctgccctccccattttacctctaacagcttctccgacgactgggctgggaagatggatcgggccggactgggcttttctgggtgtagcgacggctgcggaggcgccgcttgtgggtgcttcaatgccgctccttcctgtatcttttggagaaaatgggtggagaacccccacggaattatctggaaggtcagcccgtgcgccgcgtgggtgccttctgccgttattgaacttacaatgccctccggcgaggtgcggaccttccaccccatgagcgggatccctacgcaagtcttcaaaggagtgtctgttacatatctgggctccgatatggaagtgagcggcctcaccgacctgtgtgagattgaggaactgaagtctaaaaagctcgctcttgccccgtgcaaccaggctgggatgggagtcgtgggcaaagtgggggagatccagtgttccagcgaagagtccgcccgcaccatcaagaaggatggatgcatttggaatgcggacctggtcggcatcgaactgagagttgatgacgccgtgtgttacagcaaaattacatctgtggaggctgtcgccaactatagcgctatccccaccacaattgggggactccggtttgaaagatcccatgattctcagggcaagatcagcggctcccctctggacatcacggccattcgcgggtctttcagcgtgaattaccggggacttagactgtccctctctgagatcaccgccacatgcaccggcgaggttacaaacgtgagcgggtgctactcctgtatgaccggagctaaagtcagcattaagctgcactcttccaaaaatagcacggcgcatgtgcgctgcaagggcgatgaaaccgccttttctgttctggagggggtgcactcctatacagtcagcctttccttcgaccacgctgtggttgatgaacaatgtcagctcaactgcggaggccatgagtctcaggtgaccctgaagggcaatctgatctttctcgacgtccccaaattcgtggacgggagctacatgcagacatatcactccaccgtgcctacgggagccaacattcccagccctacagattggctgaatgccctttttggcaacgggctgtctagatggatcctcggactgatcggcgtcctgcttgggggactcgctctgttctttctgattatgtccctcttcaagctgggcaccaaacaagtttttcggagccgcacaaaacttgcctga

SEQ ID NO: 14743 - RNA, 3222 nt, synthetic construct
  misc_feature 1..3222: note = derived and/or modified CDS sequence (opt5) from SFTSV(JS2011-109)__KC505139.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagcttaagagcttctctcagtccgaatttcccgacatctgcaaaattgatggcatcgtgttcaatcagtgtgagggggaaagcctccctcaaccctttgacgtcgcctggatggatgtgggacactctcataagatcattatgcgcgagcacaaaacaaagtgggtgcaggagagctcctctaaggacttcgtctgctataaagaaggcaccgggccgtgtagcgagtccgaagagaagacatgcaaaaccagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacgcttgaagtgaaccagcctgagcaacgcatcggccagtgcaccgggtgtcacctggaatgcattaatggcggagtcagactcatcacactgaccagcgagctgaagtccgcgacagtgtgtgcctctcatttttgcagctccgctacctctggcaagaaaagcacggagattcagttccactccgggagcctcgttggaaagacagccatccacgtgaaaggcgctctggtcgatgggaccgagttcacatttgaaggatcttgtatgttccccgacggctgcgatgccgtggactgcaccttttgtcgggagttccttaagaacccccaatgctatcctgcgaaaaagtggctgtttatcattatcgtcattctcctggggtacgccggccttatgctgctcaccaatgtgctgaaggctatcggagtttggggctcctgggtgattgccccggtcaaactggtgttcgctatcatcaagaaactcatgcgcgccgttagctgtctgatggggaagctgatggatagaggaagacaggtgattcatgaagaaatcggcgagaaccgggaggggaatcaggacgatgtccgcattgaaatggcccggcccagacgcgtgcggcactggatgtattctcctgtgatcctgacaattctcgctatcggactggcggagggctgcgacgaaatggttcatgccgattccaaacttgtcagctgtagacaggggtctggcaacatgaaggagtgcgtgacgaccggacgcgctctgctccccgccgtgaatcctggccaagaggcctgtctgcactttacagctcccgggagcccggactccaagtgcctgaaaattaaggtcaaacggatcaacctcaagtgtaaaaagtctagctcctacttcgtgcctgatgccagaagccgctgcacctccgttcggagatgtcgctgggcgggagactgccagtctggctgtccccctcattttacaagcaattccttctctgacgattgggctgggaagatggaccgggccggactgggctttagcgggtgctccgatggctgcggaggcgccgcttgtgggtgcttcaacgccgctccctcttgtatcttttggagaaaatgggtggaaaatcctcacggaattatctggaaggtcagcccctgcgccgcgtgggtgccgtccgccgttattgagcttaccatgcctagcggcgaagtgcggacgttccaccccatgtctgggatccccacacaggtcttcaaaggagtgtccgttacctatctgggcagcgacatggaggtgtctggcctcaccgatctgtgtgaaattgaggagctgaagtccaaaaagctggctctcgccccttgcaaccaggctgggatgggagtcgtgggcaaagtgggggaaatccaatgtagctctgaggaatccgcccgcacaatcaagaaggacggatgcatttggaacgcggatctggtcggcatcgagctgagagttgacgatgccgtgtgttacagcaaaattacctccgtggaagctgtcgccaattatagcgctatcccgacaacgattgggggactccggtttgagagatctcatgacagccagggcaagatctccggctctcccctggatatcaccgccattcgcgggagcttctccgtgaactaccggggacttagactgtctctcagcgagatcacagctacctgcacaggcgaagttaccaatgtgtccgggtgctactcttgtatgacgggagccaaagtcagcattaagctgcactccagcaaaaactctaccgcgcatgtgcgctgcaagggcgacgagacagccttttccgttctggaaggggtgcacagctattctgtctcccttagcttcgatcacgctgtggttgacgagcagtgtcagctcaattgcggaggccatgaatcccacgtgaccctgagaggcaacctgatctttctcgacgtccctaagttcgtggatgggtcttacatgcaaacatatcatagcaccgtgcccacgggagccaatattccttcccccacagactggctgaacgccctttttggcaatgggctgagccggtggatcctcggagtcatcggcgttctgcttgggggacttgctctcttctttctgattatgtctctgttcaaactcggcaccaaacaggtgtttcgctccagaacaaagctggcctga

SEQ ID NO: 14744 - RNA, 3222 nt, synthetic construct
  misc_feature 1..3222: note = derived and/or modified CDS sequence (opt5) from SFTSV(JS2011-13-2)__KR230770.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagcttaagagcttctctcagtccgaatttcccgacatctgcaaaattgatggcatcgtgttcaatcagtgtgagggggaaagcctccctcaaccctttgacgtcgcctggatggatgtgggacactctcataagatcattatgcgcgagcacaaaacaaagtgggtgcaggagagctcctctaaggacttcgtctgctataaagaaggcaccgggccgtgtagcgagtccgaagagaagacatgcaaaaccagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacgcttgaagtgaaccagcctgagcaacgcatcggccagtgcaccgggtgtcacctggaatgcattaatggcggagtcagactcatcacactgaccagcgagctgaagtccgcgacagtgtgtgcctctcatttttgcagctccgctacctctggcaagaaaagcacggagattcagttccactccgggagcctcgttggaaagacagccatccacgtgaaaggcgctctggtcgatgggaccgagttcacatttgaaggatcttgtatgttccccgacggctgcgatgccgtggactgcaccttttgtcgggagttccttaagaacccccaatgctatcctgcgaaaaagtggctgtttatcattatcgtcattctcctggggtacgccggccttatgctgctcaccaatgtgctgaaggctatcggagtttggggctcctgggtgattgccccggtcaaactggtgttcgctatcatcaagaaactcatgcgcgccgttagctgtctgatggggaagctgatggatagaggaagacaggtgattcatgaagaaatcggcgagaaccgggaggggaatcaggacgatgtccgcattgaaatggcccggcccagacgcgtgcggcactggatgtattctcctgtgatcctgacaattctcgctatcggactggcggagggctgcgacgaaatggttcatgccgattccaaacttgtcagctgtagacaggggtctggcaacatgaaggagtgcgtgacgaccggacgcgctctgctccccgccgtgaatcctggccaagaggcctgtctgcactttacagctcccgggagcccggactccaagtgcctgaaaattaaggtcaaacggatcaacctcaagtgtaaaaagtctagctcctacttcgtgcctgatgccagaagccgctgcacctccgttcggagatgtcgctgggcgggagactgccagtctggctgtccccctcattttacaagcaattccttctctgacgattgggctgggaagatggaccgggccggactgggctttagcgggtgctccgatggctgcggaggcgccgcttgtgggtgcttcaacgccgctccctcttgtatcttttggagaaaatgggtggaaaatcctcacggaattatctggaaggtcagcccctgcgccgcgtgggtgccgtccgccgttattgagcttaccatgcctagcggcgaagtgcggacgttccaccccatgtctgggatccccacacaggtcttcaaaggagtgtccgttacctatctgggcagcgacatggaggtgtctggcctcaccgatctgtgtgaaattgaggagctgaagtccaaaaagctggctctcgccccttgcaaccaggctgggatgggagtcgtgggcaaagtgggggaaatccaatgtagctctgaggaatccgcccgcacaatcaagaaggacggatgcatttggaacgcggatctggtcggcatcgagctgagagttgacgatgccgtgtgttacagcaaaattacctccgtggaagctgtcgccaattatagcgctatcccgacaacgattgggggactccggtttgagagatctcatgacagccagggcaagatctccggctctcccctggatatcaccgccattcgcgggagcttctccgtgaactaccggggacttagactgtctctcagcgagatcacagctacctgcacaggcgaagttaccaatgtgtccgggtgctactcttgtatgacgggagccaaagtcagcattaagctgcactccagcaaaaactctaccgcgcatgtgcgctgcaagggcgacgagacagccttttccgttctggaaggggtgcacagctattctgtctcccttagcttcgatcacgctgtggttgacgagcagtgtcagctcaattgcggaggccatgaatcccacgtgaccctgaagggcaacctgatctttctcgacgtccctaaattcgtggatgggtcttacatgcaaacatatcatagcaccgtgcccacgggagccaatattccttcccccacagactggctgaacgccctttttggcaatgggctgagcagatggatcctcggagtcatcggcgttctgcttgggggacttgctctcttctttctgattatgtctctgttcaagctcggcaccaaacaggtgtttcggtcccgcacaaagctggcctga

SEQ ID NO: 14745 - RNA, 3222 nt, synthetic construct
  misc_feature 1..3222: note = derived and/or modified CDS sequence (opt5) from SFTSV(JS2011-69)__KR230771.1__GP
  source 1..3222: mol_type = other RNA
atgatgaaggtgatctggttcagctccctggtctgcctcgttattcagtgttctggcgacaccgggcccatcatttgcgccggacctatccacagcaacaaatccgctaatattccgcatctgcttggctactctgagaagatctgtcaaatcgatagactgattcacgtgagctcctggctccggaaccattctcagtttcaggggtatgtgggacagcgcggcgggagaagccaagtctcctactatcccgccgaaaatagctactctcggtggtccggactgcttagcccttgcgacgcggattggctgggcatgctcgtggttaaaaaggctaaaggctctgacatgatcgtgcccgggccttcctataagggaaaggtcttctttgagcgccccacattcgatggctacgtggggtggggatgtggcagcgggaaatctagaacggaatccggagagctgtgcagctccgactctggcaccagctccggcctgctccctagcgatcgggttctgtggattggggacgtggcctgtcagccgatgacacccatccctgaagagacctttcttgagctgaagtctttctcccagagcgaatttcccgatatttgcaaaatcgacggaattgtcttcaaccagtgtgattctgagagcctccctcaaccctttgacgtggcctggatggatgtgggccactcccataagatcatcatgcgcgaacacaaaacaaagtgggtccaggagtctagctccaaggacttcgtttgctataaagaggggaccggaccgtgtagcgaatctgaggaaaagacatgcaaaacctccggcagctgcagaggggacatgcagttttgtaaggtggctggatgcgagcacggcgaagaggcctctgaggctaaatgtcggtgctccctggtgcataagcctggcgaagtcgtggttagctacgggggaatgcgcgtgagacccaaatgttacggcttctcccggatgatggccacgcttgaggtcaatcctcccgaacagcgcattgggcaatgcaccggatgtcacctggagtgcatcaacggcggggtgagactcattacactgacctctgaacttaagagcgcgacagtttgtgcctcccatttttgctctagcgctacctccggcaagaaaagcacggagatccagttccactctggatccctcgtgggcaaggccgctattcacgtcaaaggggccctggtggatggaacagagttcacctttgaaggcagctgtatgttccccgacgggtgcgatgcggtcgactgcacattttgtcgggagttccttaagaatcctcagtgctatccggccaaaaagtggctgtttatcatcattgtgatcctcctgggatacgctggccttatgctgctcaccaacgttctgaaggccattggggtgtggggctcttgggtcatggctcccgtgaaactgatgttcgccatcattaagaaactcatgcgctccgttagctgtctgatgggaaagctgatggatagaggccggcaagtgatccatgaagagatcggggaaaatagagagggaaaccaggacgatgtccgcattgagatggcccggcctagacgcgtgcggcactggatgtattctcccgtgatcctgaccattctcgctatcggcctggcggaagggtgcgacgagatggttcatgccgatagcaaacttgtctcctgtagacagggaagcggcaatatgaaggaatgcgtgacaacggggcgcgctctgctccctgccgtgaaccccggccaggaggcctgtctgcactttaccgctccgggatctcctgactccaagtgcctgaaaattaaggtcaaacggatcaatctcaagtgtaaaaagagctcctcttacttcgtgcccgatgccagaagccgctgcacatccgttcggagatgtcgctgggcgggcgactgccaatctgggtgccctagccattttacctccaactctttcagcgacgattgggctggaaagatggaccgggccggcctggggttttccggatgtagcgatggctgcgggggcgccgcttgtggatgcttcaatgccgctccctcttgtatcttttggagaaaatgggtggagaaccctcacggcattatctggaaggtctccccctgcgccgcgtgggtgccgagcgccgttattgaacttacaatgccttctggggaggtgcggaccttccaccccatgtccggaatccccacgcaggtcttcaaaggcgtgagcgttacatatctggggtctgacatggaagtgtccggactcaccgatctgtgtgagattgaggaacttaagagcaaaaagctggctctcgccccttgcaaccaggctggcatgggcgtcgtggggaaagtgggagagatccagtgttccagcgaagagtctgcccgcaccattaagaaggacggctgcatctggaatgcggatctggtcgggatcgaactgagagttgacgatgccgtgtgttacagcaaaattacatccgtggaggctgtcgccaactattctgctatcccgaccacaattggaggcctccggtttgaaagaagccatgactcccaagggaagatctctggaagccccctggatattacggccgtgcgcggctccttctctgttaattaccggggccttagactgagcctctccgagatcaccgccacatgcaccggggaggtgacaaacgtcagcggatgctactcttgtatgaccggcgctaaagtgtccatcaagctgcacagctctaaaaattccacggcgcatgttcgctgcaagggggacgaaaccgcctttagcgtgctggagggagtccactcctatacagtgtctcttagcttcgatcacgctgttgtggacgaacagtgtcagctcaactgcggcgggcatgagtcccaggtcaccctgaagggaaatctgatttttctcgacgtgcctaaattcgtggatggcagctacatgcaaacatatcactcttccgtccccaccggcgccaacatccctagccccacggactggctgaatgccctttttgggaacggactgtctagatggattctcggcgttatcggggtgctgctgggagtgcttgctctcttctttctgattatgagcctgttcaagctcggcacaaaacaggtctttcggtcccgcaccaagctggcctga

SEQ ID NO: 14746 - RNA, 3222 nt, synthetic construct
  misc_feature 1..3222: note = derived and/or modified CDS sequence (opt5) from SFTSV(JS2012-020)__KC505142.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagcttaagagcttctctcagtccgaatttcccgacatctgcaaaattgatggcatcgtgttcaatcagtgtgggggagagagcctccctcaaccctttgacgtcgcctggatggatgtgggccactctcataagatcattatgcgcgaacacaaaacaaagtgggtgcaggagagctcctctaaggacttcgtctgctataaagaggggaccggaccgtgtagcgaatccgaggaaaagacatgcaaaaccagcggctcttgcagaggcgacatgcagttttgtaaggttgctgggtgcgagcacggagaagaggcctccgaggctaaatgtcggtgcagcctggtgcataagcctggcgaagtggtcgtgtcttacgggggaatgcgcgttggccccaaatgttacgggttctccagaatgatggccacgcttgaggtgaaccagcctgaacaacggatcggccagtgcaccggatgtcacctggagtgcattaatggcggggtccgcctcatcacactgaccagcgaactgaagtccgcgacagtgtgtgcctctcatttttgcagctccgctacctctggaaagaaaagcacggagattcagttccactccggcagcctcgttgggaagacagccatccacgtgaaaggagctctggtcgatggcaccgagttcacatttgaagggtcttgtatgttccccgacggctgcgatgccgtggactgcaccttttgtagagagttccttaagaacccccaatgctatcctgcgaaaaagtggctgtttatcattatcattatcctcctgggatacgccggccttatgctgctcaccaatgtcctgaaggctattggggtgtggggatcctgggttatcgccccggtgaaactggtcttcgctatcattaagaaactcatgcgggccgtgagctgtctgatgggcaagctgatggatcgcgggagacaggttatccatgaagagattggagaaaaccgggagggcaatcaggacgatgtgagaatcgagatggcccgcccccggagagtccgccactggatgtattctcctgtgattctgacaatcctcgctattgggctggcggaaggctgcgacgagatggtgcatgccgattccaaacttgttagctgtcggcagggatctggcaacatgaaggaatgcgtcacgaccgggagagctctgctccccgccgtgaatcctggacaagaggcctgtctgcactttacagctcccggcagcccggactccaagtgcctgaaaatcaaggtgaaacgcatcaacctcaagtgtaaaaagtctagctcctacttcgtccctgatgcccggagcagatgcacctccgtgcgccggtgtagatgggcgggggactgccagtctggatgtccccctcattttacaagcaattccttctctgacgattgggctggcaagatggaccgcgccgggctgggctttagcggatgctccgatggctgcgggggagccgcttgtggctgcttcaacgccgctccctcttgtatcttttggcggaaatgggttgagaatcctcacgggattatttggaaggtgagcccctgcgccgcgtgggtcccgtccgccgtgatcgaacttaccatgcctagcggagaggttagaacgttccaccccatgtctggcattcccacacaggtgttcaaaggcgtctccgtgagctatctggggtctgacatggaagtttccggactcaccgatctgtgtgagatcgaggaacttaagagcaaaaagctggctctcgccccttgcaaccaggctggcatgggggtggtcggaaaagtgggcgagatccaatgttcttccgaagagagcgcccggaccattaagaaggacgggtgcatctggaacgcggatctggtgggaattgaactgcgcgtcgacgatgccgtttgttactccaaaatcacaagcgtggaggctgtggccaattattctgctattccgaccacaatcggcggcctcagatttgaacggagccatgactcccaggggaagatctctggaagccccctggatattacggccatcagaggctccttctctgtcaactaccgcgggcttcggctgagcctctccgagattaccgccacatgcaccggagaggtgacaaatgtttctggctgctacagctgtatgaccggggctaaagtgtccatcaagctgcacagctctaaaaactccacggcgcatgtcagatgcaagggagacgaaaccgcctttagcgtgctggagggcgttcactcttattccgtgagcctttccttcgatcacgctgtcgtggacgaacagtgtcagctcaattgcggcgggcatgagtctcacgttacactgaagggaaacctgatttttctcgacgtgcctaaattcgtcgatggcagctacatgcaaacctatcattccacagtgcccaccggggccaatatccctagccccacggactggctgaacgccctttttggaaatggcctgtctcgctggatcctcggggtgattggagtcctgctgggcggccttgctctcttctttctgatcatgtccctgttcaagctcgggacaaaacaggtttttagaagccggaccaagctggcctga

SEQ ID NO: 14747 - RNA, 3222 nt, synthetic construct
  misc_feature 1..3222: note = derived and/or modified CDS sequence (opt5) from SFTSV(JS2012-035)__KC505145.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagcttaagagcttctctcagtccgaatttcccgacatctgcaaaattgatggcatcgtgttcaatcagtgtgagggggaaagcctccctcaaccctttgacgtcgcctggatggatgtgggacactctcataagatcattatgcgcgagcacaaaacaaagtgggtgcaggagagctcctctaaggacttcgtctgctataaagaaggcaccgggccgtgtagcgagtccgaagagaagacatgcaaaaccagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacgcttggcgtgaaccagcctgaacaacgcatcgggcagtgcaccggctgtcacctggagtgcattaatggaggcgtcagactcatcacactgaccagcgaactgaagtccgcgacagtgtgtgcctctcatttttgcagctccgctacctctgggaagaaaagcacggagattcagttccactccggaagcctcgttggcaagacagccatccacgtgaaaggggctctggtcgatggaaccgagttcacatttgaaggctcttgtatgttccccgacgggtgcgatgccgtggactgcaccttttgtcgggagttccttaagaacccccaatgctatcctgcgaaaaagtggctgtttatcattatcgtcattctcctgggctacgccggacttatgctgctcaccaatgtgctgaaggctatcggcgtttgggggtcctgggtgattgccccggtcaaactggtgttcgctatcatcaagaaactcatgcgcgccgttagctgtctgatgggaaagctgatggatagaggcagacaggtgattcatgaagagatcggggaaaaccgggagggaaatcaggacgatgtccgcattgagatggcccggcccagacgcgtgcggcactggatgtattctcctgtgatcctgacaattctcgctatcggcctggcggaagggtgcgacgagatggttcatgccgattccaaacttgtcagctgtagacagggctctggaaacatgaaggaatgcgtgacgaccggccgcgctctgctccccgccgtgaatcctgggcaagaggcctgtctgcactttacagctcccggaagcccggactccaagtgcctgaaaattaaggtcaaacggatcaacctcaagtgtaaaaagagcagctcctacttcgtgcctgatgccagaagccgctgcacctccgttcggagatgtcgctgggcgggcgactgccagtctgggtgtccccctcattttacaagcaattccttctctgacgattgggctggaaagatggaccgggccggcctggggtttagcggctgctccgatggatgcggcggggccgcttgtggatgcttcaacgccgctccctcttgtatcttttggagaaaatgggtggagaatcctcacggcattatctggaaggtcagcccctgcgccgcgtgggtgccgtccgccgttattgaacttaccatgcctagcggggaggtgcggacgttccaccccatgtctggaatccccacacaggtcttcaaaggcgtgtccgttacctatctgggcagcgacatggaagtgtctgggctcaccgatctgtgtgagattgaggaactgaagtccaaaaagctcgctcttgccccttgcaaccaggctggaatgggcgtcgtggggaaagtgggagagatccaatgtagctctgaagagtccgcccgcacaatcaagaaggacggctgcatttggaacgcggatctggtcgggatcgaactgagagttgacgatgccgtgtgttacagcaaaattacctccgtggaggctgtcgccaattatagcgctatcccgacaacgattggaggcctccggtttgaaagatctcatgacagccagggcaagatctccgggtctcccctggatatcaccgccattcgcggatctttctccgtgaactaccggggccttagactgtctctcagcgagatcacagctacctgcacaggggaggttaccaatgtgtccggatgctactcttgtatgacgggcgccaaagtcagcattaagctgcactccagcaaaaactctaccgcgcatgtgcgctgcaagggggacgaaacagccttttccgttctggagggagtgcacagctattctgtctcccttagcttcgatcacgctgtggttgacgaacagtgtcagctcaattgcggcggccatgagtcccacgtgaccctgagagggaacctgatctttctcgacgtccctaagttcgtggatggatcttacatgcaaacatatcatagcaccgtgcccacgggcgccaatattccttcccccacagactggctgaacgccctttttgggaatggactgagccggtggatcctcggcgtcatcggggttctgctgggaggccttgctctcttctttctgattatgtctctgttcaaactcggcaccaaacaggtgtttcgctccagaacaaagctggcctga

SEQ ID NO: 14748 - RNA, 3222 nt, synthetic construct
  misc_feature 1..3222: note = derived and/or modified CDS sequence (opt5) from SFTSV(JS2012-79)__KR230772.1__GP
  source 1..3222: mol_type = other RNA
atgatgaaggtgatctggttcagctccctgacctgctttgtcattcagtgttctggcgacagcgggcccatcatttgcgccggacctatccactccaacaaatctgctgatattccgcatctcctgggctacagcgagaagatctgtcaaatcgacagacttattcacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgatcgttcccgggcctagctataagggaaaggtgtttttcgagcgccccacatttgacggctacgtcgggtggggatgtggctctgggaaatccagaacggaaagcggagagctctgctcctctgatagcggcacctccagcggcctgctgccttctgaccgggtgctctggattggggatgttgcctgtcagccgatgacacccatccctgaagagaccttcctggagcttaagtcctttagccagtctgagttccccgacatttgcaaaatcgatggaattgtgtttaatcagtgtgaaggcgaaagcctgcctcaacccttcgacgtcgcctggatggatgtggggcactcccataagatcatcatgcgcgagcacaaaacaaagtgggtgcaggagtctagctccaaggactttgtctgctataaagaaggaaccggcccgtgtagcgagtctgaagagaagacatgcaaaacctccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcattagacccaaatgttacgggttttcccggatgatggccacgctggaagttaaccagcctgagcaacgccttggacagtgcaccggctgtcacctggaatgcatcaatgggggcgtgagactcattacactgacctctgagcttaagagcgcgacagtctgtgcctcccatttctgctctagcgctacctccggaaagaaaagcacggagatccagttccactctggctccctcgtggggaagacagccattcacgttaaaggagctctggtggatggcaccgaatttacattcgaggggagctgtatgtttcccgacggatgcgatgccgtcgactgcaccttctgtcgggaatttcttaagaacccccaatgctatcctgcgaaaaagtggctgttcatcatcattgtgatcctcctgggctacgccgggcttatgctgctcaccaatgtcctgaaggctattggcatctggggatcttgggtgattgccccggttaaactgatgtttgctatcatcaagaaactcatgcgcacagtgtcctgtctgatgagaaagctgatggatcggggcagacaggtcattcatgaggaaatcggggagaaccgcgagggaaatcaggacgatgtgcggattgaaatggccagaccccgccgggttagacactggatgtatagccctgtgatcctgacgattctcgccatcggcctggctgagtcttgcgacgaaatggtccatgcggatagcaaacttgtgtcctgtcgccaggggagcggaaacatgaaggagtgcgtgaccacaggccgggccctgctctctgctgttaatcccgggcaagaggcctgtctgcacttcaccgcccctggctcccccgacagcaagtgcctgaaaattaaggtcaaaagaatcaacctcaagtgtaaaaagtcctctagctactttgtgccggatgctcgctcccggtgcacatctgtgagacgctgtcggtgggccggagactgccagagcggctgccctccccatttcacctccaattcttttagcgacgattgggcggggaagatggacagagctggactgggcttctccgggtgtagcgatggatgcggcggggccgcctgtggctgctttaacgctgccccttcttgtatcttctggcggaaatgggtcgaaaatccccacggaattatctggaaggtgtccccttgcgctgcctgggttcccagcgcggtgattgagcttacgatgccgtctggcgaagtccgcacattccaccctatgtccgggatccccacccaggtgtttaaaggagttagcgtgacctatctgggctctgacatggaggtctccgggctcacagatctgtgtgaaattgaggagcttaagagcaaaaagctggccctcgctccctgcaaccaggccggaatgggcgtggttggcaaagtgggggaaatccaatgttccagcgaggaatctgctagaaccatcaagaaggacggatgcatttggaacgccgatctggtcggcatcgagctgcgggtggacgatgcggtgtgttacagcaaaattacatccgtcgaagccgttgctaattattctgccatccctacgaccattgggggactcagattcgagcgcagccatgactcccagggcaagatctctgggagcccgctggatatcacagctattcggggatccttttctgtgaactacagaggccttcgcctgagcctctccgagatcaccgccacatgcaccggcgaagtgacgaatgtcagcgggtgctactcttgtatgaccggagccaaagtgtccattaagctgcacagctctaaaaactccacagctcatgttagatgcaagggcgacgagaccgcgttcagcgtgctggaagggggacactcctatacagtctctcttagctttgatcacgccgtggttgacgagcagtgtcagctcaattgcggcgggcatgaatcccaagtgaccctgaagggaaacctgatcttcctcgacgtccccaaatttgtggatggcagctacatgcagacgtatcactctacagttcctaccggcgctaatattccctcccctacagactggctgaacgcccttttcgggaatggactgagccggtggatcctcggcgtgatcggggtcctgctgggaggccttgccctctttttcatgattatgtctctgtttaagctggggaccaaacaggtgttccgcagcagaaccaagctcgcttga

SEQ ID NO: 14749 - RNA, 3222 nt, synthetic construct
  misc_feature 1..3222: note = derived and/or modified CDS sequence (opt5) from SFTSV(JS2013-44)__KR230773.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggagacctctgaagccaaatgtcggtgctccctcgtgcataagcctggggaggtggtcgtgagctacggaggcatgcgcatcagacccaaatgttacgggttttcccggatgatggctacgctggaagttaaccagcctgagcaacgccttggacagtgcaccggctgtcacctggaatgcattaatgggggcgtgagactcatcacactgacctctgagcttaagagcgccacagtctgtgcgtcccatttctgctctagcgccacctccggaaagaaaagcacggagattcagttccactctggctccctcgtggggaagacagctatccacgttaaaggagccctggtggatggcaccgaatttacattcgaggggagctgtatgtttcccgacggatgcgatgctgtcgactgcaccttctgtcgggaatttcttaagaacccccaatgctatcctgccaaaaagtggctgttcatcattatcgtgattctcctgggctacgcggggcttatgctgctcaccaatgtcctgaaggccatcggcatttggggatcttgggtgatcgctccggttaaactgatgtttgccatcattaagaaactcatgcgcacagtgtcctgtctgatgagaaagctgatggatcggggcagacaggtcatccatgaggaaattggggagaaccgcgagggaaatcaggacgatgtgcggatcgaaatggctagaccccgccgggttagacactggatgtatagccctgtgattctgacgatcctcgccattggcctggccgagtcttgcgacgaaatggtccatgctgatagcaaacttgtgtcctgtcgccaggggagcggaaacatgaaggagtgcgtgaccacaggccgggcgctgctccccgccgttaatcctgggcaagaggcttgtctgcacttcaccgcccccggctctccggactccaagtgcctgaaaatcaaggtcaaaagaatcaacctcaagtgtaaaaagagctcctcttactttgtgcctgatgcccgcagccggtgcacatccgtgagacgctgtcggtgggctggagactgccagtctggctgtccccctcatttcaccagcaattccttttctgacgattgggccgggaagatggacagagcgggactgggcttcagcgggtgctccgatggatgcggcggggctgcctgtggctgctttaacgccgctcccagctgtattttctggcggaaatgggtcgaaaatcctcacggaatcatttggaaggtgtctccctgcgccgcttgggttccgtccgccgtgatcgagcttacgatgcctagcggcgaagtccgcacattccaccccatgtctgggattcccacccaggtgtttaaaggagtttccgtgacctatctgggcagcgacatggaggtctctgggctcacagatctgtgtgaaatcgaggagctgaagtccaaaaagctggcgctcgccccttgcaaccaggctggaatgggcgtggttggcaaagtgggggaaatccaatgtagctccgaggaaagcgccagaaccattaagaaggacggatgcatctggaacgctgatctggtcggcattgagctgcgggtggacgatgccgtgtgttactctaaaatcacaagcgtcgaagcggttgccaattattccgctattccgacgaccatcgggggactcagattcgagcgctctcatgacagccagggcaagatctccgggtctcccctggatattagcgccatccggggatccttttctgtgaactacagaggccttcgcctgagcctctccgagattacagctacctgcacaggcgaagtgaccaatgtcagcgggtgctactcttgtatgacgggagccaaagtgtccatcaagctgcacagctctaaaaactccaccgcccatgttagatgcaagggcgacgagacagctttcagcgtgctggaaggggtccactcctatattgtgtctcttagctttgatcacgcggttgtggacgagcagtgtcagctcaattgcggaggccatgaatcccaagtcaccctgaaggggaacctgatcttcctcgacgtgcctaaatttgttgatggaagctacatgcagacatatcactctaccgtgcccacgggcgccaatatcccttcccccacagactggctgaacgctcttttcggcaatgggctgagccggtggattctcggagtcatcggcgtgctgcttgggggacttgccctcttttctatgattatgagcctgttcaagctgggcaccaaacaggtgtttcgctccagaacaaagctcgcctga

SEQ ID NO: 14750 - RNA, 3222 nt, synthetic construct
  misc_feature 1..3222: note = derived and/or modified CDS sequence (opt5) from SFTSV(JS2013-46)__KR230774.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagcttaagagcttctctcagtccgaatttcccgacatctgcaaaattgatggcatcgtgttcaatcagtgtgagggggaaagcctccctcaaccctttgacgtcgcctggatggatgtgggacactctcataagatcattatgcgcgagcacaaaacaaagtgggtgcaggagagctcctctaaggacttcgtctgctataaagaaggcaccgggccgtgtagcgagtccgaagagaagacatgcaaaaccagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacgcttgaagtgaacgagcctgaacagcgcatcggccaatgcaccgggtgtcacctggagtgcattagcggcggagtcagactcatcacactgacctccgagctgaagtctgcgacagtgtgtgccagccatttttgctcctctgctaccagcggcaagaaatccacggaaattcagttccacagcgggtctctcgttggaaagacagccatccacgtgaaaggcgctctggtcgatgggaccgagttcacatttgaaggatcctgtatgttccccgacggctgcgatgccgtggactgcaccttttgtcgggagttccttaagaatccccagtgctatcctgcgaaaaagtggctgtttatcattatcgtcattctcctggggtacgccggccttatgctgctcaccaacgtgctgaaggctatcggagtttggggcagctgggtgattgccccggtcaaactggtgttcgctatcatcaagaaactcatgcgcgccgtttcttgtctgatggggaagctgatggatagaggacggcaagtgattcatgaagagatcggcgagaatagagaagggaaccaggacgatgtccgcattgagatggcccggcccagacgcgtgcggcactggatgtattcccctgtgatcctgacaattctcgctatgggactggcggaaggctgcgacgagatggttcatgccgatagcaaacttgtctcttgtagacaggggagcggcaatatgaaggagtgcgtgacgaccggacgcgctctgctccccgccgtgaaccctggccaggaagcctgtctgcactttatggctcccgggtccccggacagcaagtgcctgaaaatcaaggtcaaacggattaatctcaagtgtaaaaagtcttccagctacttcgtgcctgatgccagatcccgctgcacatctgttcggagatgtcgctgggcgggagactgccaaagcggctgtccccctcattttacctccaactctttcagcgacgattgggctgggaagatggaccgggccggactgggcttttccgggtgctctgatggctgcggaggcgccgcttgtgggtgcttcaatgccgctcccagctgtatcttttggagaaaatgggtggagaaccctcacggaatcatttggaaggtctccccctgcgccgcgtgggtgccgagcgccgttatcgaacttacaatgccttctggcgaggtgcggaccttccaccccatgtccgggattcccacgcaggtcttcaaaggagtgagcgttacatatctgggctctgacatggaagtgtccggcctcaccgatctgtgtgagatcgaggaacttaagagcaaaaagctggctctcgccccttgcaatcaggctgggatgggagtcgtgggcaaagtgggggagattcagtgttcttccgaagagagcgcccgcaccatcaagaaggacggatgcatctggaacgcggatctggtcggcattgaactgagagttgacgatgccgtgtgttactccaaaatcacaagcgtggaggctgtcgccaactattctgctattccgaccacaatcgggggactccggtttgagagaagccatgactcccaaggcaagatttctggcagccccctggatatcacggccatccgcgggtccttctctattaattaccggggacttagactgagcctctccgaaatctctgctacctgcacaggcgaggtgaccaacgttagcgggtgctactcctgtatgacaggagccaaagtgagcattaagctgcactcttccaaaaatagcaccgcgcatgtccgctgcaagggcgacgaaacggccttttctgtgctggagggggttcactcctatagcgtgtccctttctttcgatcacgctgtcgtggacgaacagtgtcagctcaactgcggaggccatgagagccaggttaccctgagaggcaatctgatctttctcgacgtgcctaagttcgtcgatgggtcctacatgcaaacatatcacagcaccgtgcccacaggagccaacattccttctcccaccgactggctgaatgccctttttggcaacgggctgtcccggtggatcctcggagtgatcggcgtcctgcttgggggactggctctcttctttctgattatgagcctgttcaaactcggcacgaagcaggtttttcgctctagaacaaaactggcctga

SEQ ID NO: 14751 - RNA, 3222 nt, synthetic construct
  misc_feature 1..3222: note = derived and/or modified CDS sequence (opt5) from SFTSV(JS2013-52)__KR230775.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagctcaagagcgcgaccgtgtgtgcctcccatttctgctctagcgctacatccggaaagaaaagcaccgagattcagttccactctggctccctggttgggaagacggccatccacgtgaaaggagctctggtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatgtttgctatcattaagaaactgatgcgcaccgtctcctgtctcatgggcaagctgatggatagagggagacaggtgatccatgaggaaattggagagaaccgggagggcaatcaggacgatgttcgcatcgaaatggcccggcccagacgcgtgcggcactggatgtatagccctgtcattcttacattcctggccatcgggctcgctgagtcttgcgacgaaatggtgcatgcggatagcaaactggtgtcctgtagacagggaagcggcaacatgaaggagtgcgttacgaccgggcgcgcccttctgcccgctgtcaatcctggccaagaggcctgtctccactttacagcccccggatctccggactccaagtgcctgaaaattaaggtgaaacggatcaacctgaagtgtaaaaagagctcctcttacttcgtgcctgatgctagaagccgctgcacctccgtccggagatgtcgctgggccggcgactgccagtctgggtgtccccctcattttacaagcaattccttctctgacgattgggcgggaaagatggaccgggctggcctcgggtttagcggatgctccgatggctgcgggggcgccgcctgtggatgcttcaacgctgcccccagctgtatcttctggagaaaatgggtggaaaatcctcacggcattatctggaaggtttctccctgcgctgcctgggtgccgtccgcggtcattgagctgaccatgcctagcggggaagtgcggacgtttcaccccatgtctggaatccccacacaggttttcaaaggcgtgtccgtcacctatcttgggagcgacatggaggtgtctggactgaccgatctctgtgaaattgaggagctgaagtccaaaaagctggcccttgctccttgcaaccaggccggcatgggcgttgtggggaaagtcggagaaatccaatgtagctccgaggaaagcgctcgcacaatcaagaaggacggctgcatttggaacgccgatctcgtggggatcgagctgagagtggacgatgcggtctgttactctaaaattaccagcgttgaagccgtggctaattattccgccatcccgacaacgattggaggcctgcggtttgagagatctcatgacagccaggggaagatctccggatctcccctcgatatcaccgctattcgcggcagcttctccgtgaactaccggggcctgagactttctctgagcgagatcacagctacctgcacaggggaagtcaccaatgtgtccggatgctacagctgtatgacgggcgccaaagtttctattaagctccactccagcaaaaactctaccgcccatgtgcgctgcaagggggacgagacagcgttttccgtcctggaaggagtgcacagctataccgtttccctgtctttcgatcacgccgtggtcgacgagcagtgtcagcttaattgcggcgggcatgaaagccaagtgacactcaagggaaacctgatctttctggacgttcctaaattcgtggatggctcctacatgcagacctatcacagcacggtccccacaggcgctaatattccttctcccaccgactggctcaacgccctgtttgggaatggactttccagatggatcctgggcgtgatcggggtgctcctgggagtcctggcccttttctttctcattatgagcctgttcaagctgggcacaaaacaggtttttcggtctcgcaccaagctcgcttga

SEQ ID NO: 14752 - RNA, 3222 nt, synthetic construct
  misc_feature 1..3222: note = derived and/or modified CDS sequence (opt5) from SFTSV(JS2013-69)__KR230776.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatattatcgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggattggggatgttgcctgtcagccgatgacccccatccctgaagagacattcctggagcttaagtcctttagccagtctgaatttcccgacatttgcaaaatcgatggaatcgtgtttaatcagtgtgagggcgaaagcctgcctcaacccttcgacgtcgcctggatggatgtggggcactcccataagattatcatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgccttggacagtgcacgggctgtcacctggaatgcattaatgggggcgtcagactcatcaccctgacatctgagcttaagagcgcgaccgtgtgtgcctcccatttctgctctagcgctacatccggaaagaaaagcaccgagattcagttccactctggctccctcgttgggaagacggccatccacgtgaaaggagctctggtcgatggcacagaatttacccttgagagctcttgtatgttccccgacgggtgcgatgccgtggactgcacattttgtcgggagttcctgaagaacccccaatgctatcctgcgaaaaagtggctctttatcattatcgtcattctgcttggatacgccggcctgatgctcctgaccaatgtgctgaaggctatcgggatttggggctcctgggttatcgccccggtgaaactcatgttcgctatcattaagaaactgatgcgcaccgtcagctgtcttatgagaaagctgatggatcggggaagacaggtgatccatgaagaaattggcgagaaccgcgaggggaatcaggacgatgttcggatcgaaatggccagaccccgccgggtgagacactggatgtattctcctgtcattctcacaatcctggccattggacttgctgagagctgcgacgaaatggtgcatgcggattccaaactggtgagctgtcgccagggctctgggaacatgaaggagtgcgttacgaccggacgggccctcctgcccgctgtcaatcctggccaagaggcctgtctgcactttacagcccccgggtccccggacagcaagtgcctcaaaatcaaggtgaaaagaatcaacctgaagtgtaaaaagtcctctagctacttcgtgcctgatgctcgctcccggtgcacctctgtcagacgctgtcggtgggccggcgactgccagagcggatgtccccctcattttacatccaattctttcagcgacgattgggcgggcaagatggacagagctgggcttggattttccggctgcagcgatgggtgcggaggcgccgcctgtgggtgcttcaacgctgccccctcttgtattttctggcggaaatgggtggaaaatcctcacggcatcatttggaaggtttccccctgcgctgcctgggtgccgagcgcggtcatcgagctgaccatgccttctggagaagtgcgcacgttccaccccatgtccggcattcccacacaggttttcaaaggggtgagcgtcacctatctcggatctgacatggaggtgtccggcctgaccgatctgtgtgaaatcgaggagcttaagagcaaaaagctcgccctggctccttgcaaccaggccgggatgggagttgtgggcaaagtcggcgaaatccaatgttccagcgaggaatctgctagaacaattaagaaggacgggtgcatctggaacgccgatctggtgggaattgagctccgggtggacgatgcggtctgttacagcaaaatcacctccgttgaagccgtggctaattattctgccattccgacaacgatcggcgggctgagatttgagcgcagccatgactcccagggaaagatctctggcagcccccttgatattaccgctatccgggggtccttctctgtgaactacagaggactgcgcctcagcctgtccgagattacagctacctgcacaggcgaagtcaccaatgtgagcggctgctactcttgtatgacgggggccaaagtttccatcaagctgcacagctctaaaaactccaccgcccatgtgagatgcaagggagacgagacagcgtttagcgtccttgaaggcgtgcactcctataccgtttctctcagcttcgatcacgccgtggtcgacgagcagtgtcagctgaattgcgggggacatgaatcccaagtgacactgaagggcaacctcatttttctggacgttcctaaattcgtggatgggagctacatgcagacctatcactcttccgtccccacgggagctaatatccctagccccacagactggcttaacgccctgtttggcaatggcctctctcggtggatcctgggggtgattggagtgctgcttggcgtcctcgccctgttctttctgatcatgagcctcttcaagctggggaccaaacaggtttttcgctccagaacaaagctggcttga

SEQ ID NO: 14753 - RNA, 3222 nt, synthetic construct
  misc_feature 1..3222: note = derived and/or modified CDS sequence (opt5) from SFTSV(JS2013-71)__KR230777.1__GP
  source 1..3222: mol_type = other RNA
atgatgaaggtgatctggttcagctccctgatttgctttgtcatccagtgtggcggggacaccggacccattatctgcgccggccctattcactctaacaaaagcgctgatatcccgcatctcctggggtactccgagaagatctgtcaaattgacagacttatccacgtttctagctggctgcggaatcattcccagttccagggatatgtgggccagcgcgggggaagatctcaagtgagctactatcccgccgaaaactcctacagccggtggtctggcctcctgtccccttgcgatgcggactggcttggcatgctggtcgtgaaaaaggctaaagggagcgatatgattgttcccggaccttcttataagggcaaggtgtttttcgagcgccccacatttgacgggtacgtcggatggggctgtgggtccggaaaaagcagaacggaatctggcgagctctgctccagcgattccggcacctctagcgggctgctgccttccgaccgggtgctctggatcggagatgttgcctgtcagccgatgacacccattcctgaagagaccttcctggagcttaagagcttttctcagtccgagttccccgacatctgcaaaattgatggcatcgtgtttaatcagtgtgaaggggaaagcctgcctcaacccttcgacgtcgcctggatggatgtgggacactctcataagatcattatgcgcgagcacaaaacaaagtgggtgcaggagagctcctctaaggactttgtctgctataaagaaggcaccgggccgtgtagcgagtccgaagagaagacatgcaaaaccagcggatcttgcagaggcgacatgcagttctgtaaggttgctggctgcgaacacggggaggaggcctccgaagctaaatgtcggtgcagcctcgtgcataagcctggagaggtggtcgtgtcttacggcgggatgcgcgttagacccaaatgttacggattttcccggatgatggccacgctggaagtgaaccagcctgagcaacgcatcggccagtgcaccgggtgtcaccttgaatgcattaatggcggagtcagactgatcacactcaccagcgagctgaagtccgcgacagtgtgtgcctctcatttctgcagctccgctacctctggcaagaaaagcacggagattcagttccactccgggagcctggttggaaagacagccatccacgtgaaaggcgctctcgtcgatgggaccgaatttacattcgagggatcttgtatgtttcccgacggctgcgatgccgtggactgcaccttctgtcgggaatttctgaagaacccccaatgctatcctgcgaaaaagtggcttttcatcattatcgtcattctgctcgggtacgccggcctgatgcttctgaccaatgtgctcaaggctatcggagtttggggctcctgggtgattgccccggtcaaactggtgtttgctatcatcaagaaactgatgcgcgccgttagctgtctcatggggaagctgatggatagaggaagacaggtgattcatgaggaaatcggcgagaaccgggaggggaatcaggacgatgtccgcattgaaatggcccggcccagacgcgtgcggcactggatgtattctcctgtgatccttacaattctggctatcggactcgcggagggctgcgacgaaatggttcatgccgattccaaactggtcagctgtagacaggggtctggcaacatgaaggagtgcgtgacgaccggacgcgcccttctgcccgccgtgaatcctggccaagaggcctgtctccacttcacagctcccgggagcccggactccaagtgcctgaaaattaaggtcaaacggatcaacctgaagtgtaaaaagtctagctcctactttgtgcctgatgccagaagccgctgcacctccgttcggagatgtcgctgggcgggagactgccagtctggctgtccccctcatttcacaagcaattccttttctgacgattgggctgggaagatggaccgggccggactcggcttcagcgggtgctccgatggctgcggaggcgccgcttgtgggtgctttaacgccgctccctcttgtatcttctggagaaaatgggtggaaaatcctcacggaattatctggaaggtcagcccctgcgccgcgtgggtgccgtccgccgttattgagctgaccatgcctagcggcgaagtgcggacgttccaccccatgtctgggatccccacacaggtctttaaaggagtgtccgttacctatcttggcagcgacatggaggtgtctggcctgaccgatctctgtgaaattgaggagctgaagtccaaaaagctggctcttgccccttgcaaccaggctgggatgggagtcgtgggcaaagtgggggaaatccaatgtagctctgaggaatccgcccgcacaatcaagaaggacggatgcatttggaacgcggatctcgtcggcatcgagctgagagttgacgatgccgtgtgttacagcaaaattacctccgtggaagctgtcgccaattatagcgctatcccgacaacgattgggggactgcggttcgagagatctcatgacagccagggcaagatctccggctctcccctcgatatcaccgccattcgcgggagcttttccgtgaactaccggggactgagactttctctgagcgagatcacagctacctgcacaggcgaagttaccaatgtgtccgggtgctactcttgtatgacgggagctaaagtcagcattaagctccactccagcaaaaactctaccgcgcatgtgcgctgcaagggcgacgagacagccttctccgttctggaaggggtgcacagctattctgtctccctgagctttgatcacgctgtggttgacgagcagtgtcagcttaattgcggaggccatgaatcccacgtgaccctcagaggcaacctgatcttcctggacgtccctaagtttgtggatgggtcttacatgcaaacatatcatagcaccgtgcccacgggagccaatattccttcccccacagactggctcaacgccctgttcggcaatgggcttagccggtggatcctgggagtcatcggcgttctccttgggggactggctctgtttttcctcattatgtctctgtttaaactgggcaccaaacaggtgttccgctccagaacaaagctcgcctga

SEQ ID NO: 14754 - RNA, 3222 nt, synthetic construct
  misc_feature 1..3222: note = derived and/or modified CDS sequence (opt5) from SFTSV(JS2014-03)__KR230778.1__GP
  source 1..3222: mol_type = other RNA
atgatgaaggtgatctggttcagctccctgatttactttgtcatccagtgctctggcgacagcgggcccattatctgtgccggacctattcactccaacaaatctgctgatatcccgcatctcctgggctatagcgagaagatctgccaaattgacagacttatccacgtttcctcttggctgcggaatcatagccagttccaggggtacgtgggacagcgcggcgggagatcccaagtgagctattaccccgccgaaaactcttattcccggtggagcggactcctgtctccttgtgatgcggactggcttggcatgctggtcgtgaaaaaggctaaaggctccgatatgattgttcccgggcctagctacaagggaaaggtgtttttcgagcgccccacctttgacggctatgtcgggtggggatgcggctctgggaaatccagaacagaaagcggagagctctgttcctctgatagcggcacgtccagcggcctgctgccttctgaccgggtgctctggatcggggatgttgcctgccagccgatgacccccattcctgaagagacattcctggagcttaagtcctttagccagtctgagttccccgacatctgtaaaattgatggaatcgtgtttaatcagtgcgaaggcgaaagcctgcctcaacccttcgacgtcgcctggatggatgtggggcactcccataagatcattatgcgcgagcacaaaaccaagtgggtgcaggagtctagctccaaggactttgtctgttacaaagaaggaacaggcccgtgcagcgagtctgaagagaagacctgtaaaacatccgggagctgcagaggagacatgcagttctgcaaggttgctggctgtgaacacggcgaggaggcctctgaagctaaatgccggtgttccctcgtgcataagcctggggaggtggtcgtgagctacggaggcatgcgcatcagacccaaatgctatgggttttcccggatgatggccaccctggaagttaaccagcctgagcaacgcattggacagtgtacgggctgccaccttgaatgtatcaatgggggcgtgagactgattaccctcacatctgagctcaagagcgcgaccgtctgcgcctcccatttctgttctagcgctacatccggaaagaaaagcaccgagatccagttccactctggctccctggtggggaagacggccatccacgttaaaggagctctggtggatggcacagaatttaccttcgaggggagctgcatgtttcccgacggatgtgatgccgtcgactgcacattctgccgggaatttctgaagaacccccaatgttaccctgcgaaaaagtggcttttcattatcattgtgatcctgctcggctatgccgggctgatgcttctgaccaatgtcctcaaggctattggcatctggggatcttgggtgatcgccccggttaaactgatgtttgctattatcaagaaactgatgcgcaccgtgtcctgcctcatgggcaagctgatggatagagggcggcaggtcattcatgaggaaatcggagagaacagagagggcaatcaggacgatgtgcgcattgaaatggcccggcccagacgcgttcggcactggatgtacagccctgtgatccttacattcctggccattgggctcgctgagtcttgtgacgaaatggtccatgcggatagcaaactggtgtcctgcagacagggaagcggcaacatgaaggagtgtgtgacgaccgggcgcgcccttctgcccgctgttaatcctggccaagaggcctgcctccactttacagcccccggatctccggactccaagtgtctgaaaatcaaggtcaaacggatcaacctgaagtgcaaaaagagctcctcttatttcgtgcctgatgctagaagccgctgtacctccgtgcggagatgccgctgggccggcgactgtcagtctgggtgtccccctcattttacaagcaattccttctctgacgattgggcgggaaagatggaccgggctggcctcgggtttagcggatgctccgatggctgcgggggcgccgcctgcggatgtttcaacgctgcccccagctgcattttctggagaaaatgggtcgaaaatcctcacggcatcatttggaaggtgtctccctgtgctgcctgggttccgtccgcggtgatcgagctgaccatgcctagcggggaagtccggacgtttcaccccatgtctggcattcccacacaggtgttcaaaggagtttccgtgacctaccttgggagcgacatggaggtctctggactgaccgatctctgcgaaatcgaggagctgaagtccaaaaagctggcccttgctccttgtaaccaggccggcatgggcgtggttgggcgcgtgggagaaatccaatgcagctccgaggaaagcgctagaacaattaaaaaggacggctgtatctggaacgccgatctcgtcgggattgagctgcgggtggacgatgcggtgtgctattctaagatcaccagcgtcgaagccgttgctaattactccgccattccgacaacgatcggaggcctgagatttgagcgctctcatgacagccaggggaaaatctccggatctcccctcgatattaccgctatccggggcagcttctccgtgaactacagaggcctgcgcctttctctgagcgagattacagccacctgtacaggggaagtgaccaatgtctccggatgctatagctgcatgacgggcgccaaggtgtctatcaaactccactccagcaagaactctaccgctcatgttagatgtaaaggggacgagacagcgttttccgtgctggaaggagtccacagctacaccgtgtccctgtctttcgatcacgccgttgtggacgagcagtgccagcttaattgtggcgggcatgaaagccaagtcacactcaagggaaacctgatttttctggacgtgcctaagttcgttgatggctcctatatgcagacctaccacagcacggtgcccacaggcgctaatatcccttctcccaccgactggctcaacgccctgtttgggaatggactttcccggtggatcctgggcgtcattggggtgctcctgggaggcctggcccttttctttatgatcatgagcctcttcaaactggggacaaaacaggtgtttcgctctagaaccaagctggcttga

SEQ ID NO: 14755 - RNA, 3222 nt, synthetic construct
  misc_feature 1..3222: note = derived and/or modified CDS sequence (opt5) from SFTSV(JS2014-16)__KR230780.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaagtggacggaattgtcttcaaccagtgtgattctgagagcctccctcaacccatcgacgtggcctggatggatgtgggccactcccataagatcattatgcgcgaacacaaaacaaagtgggtccaggagtctagctccaaggactttgtttgctataaagaggggaccggaccgtgtagcgaatctgaggaaaagacatgcaaaacctccggcagctgcagaggggacatgcagttctgtaaggtggctggatgcgagcacggcgaagaggcctctgaggctaaatgtcggtgctccctggtgcataagcctggcgaagtcgtggttagctacgggggaatgcgcgtgagacccaaatgttacggcttttcccggatgatggccacgcttgaggtcaatcctcccgaacagcgcatcgggcaatgcaccggatgtcacctggagtgcattaacggcggggtgagactcatcacactgacctctgaacttaagagcgcgacagtttgtgcctcccatttctgctctagcgctacctccggcaagaaaagcacggagattcagtttcactctggatccctcgtgggcaaggccgctatccacgtcaaaggggccctggtggatggaacagagttcaccttcgaaggcagctgtatgtttcccgacgggtgcgatgcggtcgactgcacattctgtcgggagtttcttaagaatcctcagtgctatccggccaaaaagtggctgttcatcattatcgtgattctcctgggatacgctggccttatgctgctcaccaacgttctgaaggccatcggggtgtggggctcttgggtcatggctcccgtgaaactgatgtttgccattatcaagaaactcatgcgctccgttagctgtatgatgggaaagctgatggatagaggccggcaagtgatccatgaagagattggggaaaatagagagggaaaccaggacgatgtccgcatcgagatggcccggcctagacgcgtgcggcactggatgtattctcccgtgattcttaccatcctggctattggcctcgcggaagggtgcgacgagatggttcatgccgatagcaaactggtcctttgtagacagggatccggcaatatgaaggaatgcgtgacaacggggcgcgctctgctccctgccgtgaaccccggccaggaggcctgtctgcacttcaccgctccgggaagccctgactctaagtgcctgaaaatcaaggtcaaacggattaatctcaagtgtaaaaagtccagctcctactttgtgcccgatgccagatctcgctgcacaagcgttcggagatgtcgctgggcgggcgactgccaatccgggtgcccttctcatttcaccagcaactccttttctgacgattgggctggaaagatggaccgggccggcctggggttcagcggatgttccgatggctgcgggggcgccgcttgtggatgctttaatgccgctcccagctgtatcttctggagaaaatgggtggagaaccctcacggcatcatttggaaggtctctccctgcgccgcgtgggtgccgtccgccgttatcgaacttacaatgcctagcggggaggtgcggacctttcaccccatgtctggcattcccacgcaggtcttcaaaggagtgtccgttacatatctggggagcgacatggaagtgtctggactcaccgatctgtgtgagatcgaggaactgaagtccaaaaagctggctctcgccccttgcaaccaggctggcatgggcgtcgtggggaaagtgggagagattcagtgtagctccgaagagagcgcccgcaccatcaagaaggacggctgcatctggaatgcggatctggtcgggattgaactgagagttgacgatgccgtgtgttactctaaaatcacaagcgtggaggctgtcgccaactattccgctattccgaccacaatcggaggcctccggttcgaaagatctcatgacagccaagggaagatttccggatctcccctggatatcacggccatccgcggcagcttttccgtgaattaccggggccttagactgtctctcagcgagattaccgccacatgcaccggggaggttacaaacgtgtccggatgctacagctgtatgaccggcgctaaagtctctatcaagctgcactccagcaaaaattctacggcgcatgtgcgctgcagaggggacgaaaccgccttctccgttctggagggagtgcacagctatacagtctccctttcttttgatcacgctgtggttgacgaacagtgtcagctcaactgcggcgggcatgagagccaggtgaccctgaagggaaatctgattttcctcgacgtccctaagtttgtggatggctcctacatgcaaacatatcacagctctgtgcccaccggcgccaacatcccttcccccacggactggctgaatgcccttttcgggaacggactgagccggtggattctcggcgtcatcggggttctgctgggagtgcttgctctctttttcctgatcatgtctctgtttaaactcggcacaaaacaggtgttccgcagcagaaccaagctggcctga

SEQ ID NO: 14756 - RNA, 3222 nt, synthetic construct
  misc_feature 1..3222: note = derived and/or modified CDS sequence (opt5) from SFTSV(JS2014-18)__KR230781.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgacaacccccattcctgaagagacatttcttgagcttaagagcttctctcagtccgaatttcccgacgtgtgcaaaatcgatggcattgtcttcaatcagtgtgagggggaaagcctccctcaaccctttgacgtggcctggatggatgtgggacactctcataagatcatcatgcgcgagcacaaaaccaagtgggtccaggagagctcctctaaggacttcgtttgctataaagaaggcacagggccgtgtagcgagtccgaagagaagacctgcaaaacgagcggatcttgcagaggcgacatgcagttttgtaaggtggctggctgcgaacacggggaggaggcctccgaagctaaatgtcggtgcagcctggtgcataagcctggagaggtcgtggtttcttacggcgggatgcgcgtgagacccaaatgttacggattctcccggatgatggccacccttgaagtcaaccctcccgagcagcgcattggccaatgcacagggtgtcacctggaatgcatcaatggcggagtgagactcattaccctgacaagcgagctgaagtccgcgaccgtttgtgcctctcatttttgcagctccgctacgtctggcaagaaaagcacagagatccagttccactccgggagcctcgtgggaaagaccgccattcacgtcaaaggcgctctggtggatgggacagagttcacctttgaaggatcttgtatgttccccgacggctgcgatgccgtcgactgcaccttttgtcgggagttccttaagaaccctcagtgctatccggcgaaaaagtggctgtttatcatcattgtgatcctcctggggtacgccggccttatgctgctcacaaatgttctgaaggctattggagtgtggggctcctgggtcatcgcccccgtgaaactggttttcgctattatcaagaaactcatgcgcgccgtgagctgtctgatggggaagctgatggatagaggacggcaagtcatccatgaagaaattggcgagaacagagaggggaatcaggacgatgtgcgcatcgaaatggcccggcctagacgcgtgcggcactggatgtattctcccgttattctgacgatcctcgctattggactggcggagggctgcgacgaaatggtccatgccgattccaaacttgtgagctgtagacaggggtctggcaacatgaaggagtgcgtgaccacaggacgcgctctgctccctgccgtcaatcccggccaggaggcctgtctgcactttaccgctccggggagccctgactccaagtgcctgaaaatcaaggtgaaacggattaacctcaagtgtaaaaagtctagctcctacttcgttcccgatgccagaagccgctgcacatccgtgcggagatgtcgctgggcgggagactgccaatctggctgccctccccattttaccagcaattccttctctgacgattgggctgggaagatggaccgggccggactgggctttagcgggtgttccgatggctgcggaggcgccgcttgtgggtgcttcaacgccgctccttcttgtatcttttggagaaaatgggtcgaaaatccccacggaatcatttggaaggtgagcccgtgcgccgcgtgggttccttccgccgtgatcgagcttacgatgcccagcggcgaagtccggacattccaccccatgtctgggattcctacccaggtgttcaaaggagtttccgtgacctatctgggcagcgacatggaggtctctggcctcacagatctgtgtgaaatcgaggagctgaagtccaaaaagctggctctcgccccgtgcaaccaggctgggatgggagtggtgggcaaagtcggggaaattcagtgtagctctgaggaatccgcccgcaccatcaagaaggacggatgcatctggaacgcggatctggttggcattgagctgagagtggacgatgccgtgtgttacagcaaaatcacatccgtcgaagctgtggccaattatagcgctattcccacgaccatcgggggactccggtttgagagatctcatgacagccaaggcaagatttccggctctcctctggatatcacagccatccgcgggagcttctccgttaactaccggggacttagactgtctctcagcgagattaccgccacatgcaccggcgaagtgacgaatgtctccgggtgctactcttgtatgaccggagctaaagtgagcatcaagctgcactccagcaaaaactctacagcgcatgttcgctgcaagggcgacgagaccgccttttccgtgctggaaggggtccacagctattctgtgtcccttagcttcgatcacgctgttgtggacgagcagtgtcagctcaattgcggaggccatgaatcccaggtcacactgagaggcaacctgatttttctcgacgtgcccaagttcgtggatgggtcttacatgcaaacctatcacagcacggtccctacaggagccaatatcccctcccctaccgactggctgaacgccctttttggcaatgggctgagccggtggattctcggagttatcggcgtgctgcttgggggacttgctctcttctttctgatcatgtctctgttcaaactcggcacaaaacaggtgtttcgctccagaaccaagctggcctga

SEQ ID NO: 14757 - RNA, 3222 nt, synthetic construct
  misc_feature 1..3222: note = derived and/or modified CDS sequence (opt5) from SFTSV(JS2014-31)__KR230782.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcatcagacccaaatgttacgggttttcccggatgatggccaccctggaagttaaccagcctgagcaacgccttggacagtgcacgggctgtcacctggaatgcattaatgggggcgtgagactcatcaccctgacatctgagcttaagagcgcgaccgtctgtgcctcccatttctgctctagcgctacatccggaaagaaaagcaccgagattcagttccactctggctccctcgtggggaagacggccatccacgttaaaggagctctggtggatggcacagaatttaccttcgaggggagctgtatgtttcccgacggatgcgatgccgtcgactgcacattctgtcgggaatttcttaagaacccccaatgctatcctgcgaaaaagtggctgttcatcattatcgtgattctcctgggctacgccgggcttatgctgctcaccaatgtcctgaaggctatcggcatttggggatcttgggtgatcgccccggttaaactgatgtttgctatcattaagaaactcatgcgcaccgtgtcctgtctgatgagaaagctgatggatcggggcagacaggtcatccatgaggaaattggggagaaccgcgagggaaatcaggacgatgtgcggatcgaaatggccagaccccgccgggttagacactggatgtatagccctgtgattctgacaatcctcgccattggcctggctgagtcttgcgacgaaatggtccatgcggatagcaaacttgtgtcctgtcgccaggggagcggaaacatgaaggagtgcgtgacgaccggccgggccctgctccccgctgttaatcctgggcaagaggcctgtctgcacttcacagcccccggctctccggactccaagtgcctgaaaatcaaggtcaaaagaatcaacctcaagtgtaaaaagagctcctcttactttgtgcctgatgctcgcagccggtgcacctccgtgagacgctgtcggtgggccggagactgccagtctggctgtccccctcatttcacaagcaattccttttctgacgattgggcggggaagatggacagagctggactgggcttcagcgggtgctccgatggatgcggcggggccgcctgtggctgctttaacgctgcccccagctgtattttctggcggaaatgggtcgaaaatcctcacggaatcatttggaaggtgtctccctgcgctgcctgggttccgtccgcggtgatcgagcttaccatgcctagcggcgaagtccgcacgttccaccccatgtctgggattcccacacaggtgtttaaaggagtttccgtgacctatctgggcagcgacatggaggtctctgggctcaccgatctgtgtgaaatcgaggagctgaagtccaaaaagctcgcccttgctccttgcaaccaggccggaatgggcgtggttggcaaagtgggggaaatccaatgtagctccgaggaaagcgctagaacaattaagaaggacggatgcatctggaacgccgatctggtcggcattgagctgcgggtggacgatgcggtgtgttactctaaaatcaccagcgtcgaagccgttgctaattattccgccattccgacaacgatcgggggactcagattcgagcgctctcatgacagccagggcaagatctccgggtctcccctggatattaccgctatccggggcagcttttccgtgaactacagaggacttcgcctgtctctcagcgagattacagctacctgcacaggcgaagtgaccaatgtctccgggtgctacagctgtatgacgggagccaaagtgtctatcaagctgcactccagcaaaaactctaccgcccatgttagatgcaagggcgacgagacagcgttctccgtgctggaaggggtccacagctataccgtgtccctttcttttgatcacgccgttgtggacgagcagtgtcagctcaattgcggaggccatgaaagccaagtcacactgaaggggaacctgattttcctcgacgtgcctaaatttgttgatggatcctacatgcagacctatcacagcacggtgcccacaggcgctaatatcccttctcccaccgactggctgaacgcccttttcggcaatgggctgtcccggtggatcctcggagtcattggcgtgctgctgggggtgcttgccctctttttcctgatcatgagcctgtttaagctcggaacaaaacaggtcttccgctctagaaccaagctggcttga

SEQ ID NO: 14758 - RNA, 3222 nt, synthetic construct
  misc_feature 1..3222: note = derived and/or modified CDS sequence (opt5) from SFTSV(JS2014-33)__KR230783.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggaactgtatgtttcccgacggatgcgatgccgtggactgcacattctgtcgggaatttctgaagaatccccaatgctatcctgcgaaaaagtggcttttcatcattatcgtcattctgctcggctacgccgggctgatgcttctgaccaacgtgctcaaggctatcggcatttggggaagctgggttatcgccccggtgaaactgatctttgctattatcaagaaactgatgcgcgccgtcggctgtctcatggggaagctgatggatagaggaagacaggtgattcatgaggaaatcggcgagaatcgggaggggaaccaggacgatgttcgcattgaaatggcccggcccagacgcgtgcggcactggatgtattctcctgtcatccttaccattctggctatcggactcgcggagtcctgcgacgaaatggtgcatgccgatagcaaactggtgtcttgtagacagggcgggggcaatatgaaggagtgcgttacaacgggacgcgctctgctgcccgccgtcaaccctggccaagaggcctgtctccacttcaccgctcccgggagcccggactccaagtgcctgaaaatcaaggtgaaacggattaatctgaagtgtaaaaagtctagctcctactttgtgcctgatgccagaagccgctgcacatccgtccggagatgtcgctgggcgggagactgccagtctggctgtccccctcatttcaccagcaactccttttctgacgattgggctgggaagatggaccgggccggactcggcttcagcgggtgctccgatggctgcggaggcgccgcttgtgggtgctttaatgccgctccctcttgtatcttctggagaaaatgggtggaaaaccctcacggaattatctggaaggttagcccctgcgccgcgtgggtgccgtccgccgtcattgagctgacaatgcctagcggcgaagtgcggaccttccaccccatgtctgggatccccacgcaggtttttaaaggagtgtccgtcacatatcttggcagcgacatggaggtgtctggcctgaccgatctctgtgaaatcgaggagctgaagtccaaaaagctggctcttgccccttgcaaccaggctgggatgggagttgtgggcaaagtcggggaaattcaatgtagctctgaggaatccgcccgcaccatcaagaaggacggatgcatttggaatgcggatctcgtgggcatcgagctgagagtggacgatgccgtctgttacagcaaaattacatccgttgaagctgtggccaactatagcgctatcccgaccacaatcgggggactgcggttcgagagatctcatgacagccagggcaagatttccggctctcccctcgatatcacggccattcgcgggagcttttccgtgaattaccggggactgagactttctctgagcgagatcaccgccacatgcaccggcgaagtcacaaacgtgtccgggtgctactcttgtatgaccggagctaaagttagcattaagctccactccagcaaaaattctacggcgcatgtgcgctgcaagggcgacgagaccgccttctccgtcctggaaggggtgcacagctatacagtttctctgtcctttgatcacgctgtggtcgacgagcagtgtcagcttaactgcggaggccatgaaagccaagtgaccctcaagggcaatctgatcttcctggacgttcctaaatttgtggatgggtcctacatgcagacatatcactctgccgtccccaccggagccaacatccctagccccacggactggctcaatgctctgttcggcaacgggctttccagatggattctgggagtgatcggcgtgctccttgggggactggccctgtttttcatgattatgagcctctttaagctgggcacaaaacaggcgttccggtctcgcaccaagctggcttga

SEQ ID NO: 14759 - RNA, 3222 nt, synthetic construct
  misc_feature 1..3222: note = derived and/or modified CDS sequence (opt5) from SFTSV(JS2014-39)__KR230784.1__GP
  source 1..3222: mol_type = other RNA
atgatgaaggtgatctggttcagctccctgacctgctttgtcattcagtgttctggcgacagcgggcccatcatttgcgccggacctatccactccaacaaatctgctgatattccgcatctcctgggctacagcgagaagatctgtcaaatcgacagacttattcacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgatcgttcccgggcctagctataagggaaaggtgtttttcgagcgccccacatttgacggctacgtcgggtggggatgtggctctgggaaatccagaacggaaagcggagagctctgctcctctgatagcggcacctccagcggcctgctgccttctgaccgggtgctctggattggggatgttgcctgtcagccgatgacacccatccctgaagagaccttcctggagcttaagtcctttagccagtctgagttccccgacatttgcaaaatcgatggaattgtgtttaatcagtgtgaaggcgaaagcctgcctcaacccttcgacgtcgcctggatggatgtggggcactcccataagatcatcatgcgcgagcacaaaacaaagtgggtgcaggagtctagctccaaggactttgtctgctataaagaaggaaccggcccgtgtagcgagtctgaagagaagacatgcaaaacctccgggagctgcagaggagacatgcagttctgtaaggttgctggctgcgaacacggcgaggagacgtctgaagccaaatgtcggtgctccctcgtgcataagcctggggaggtggtcgtgagctacggaggcatgcgcattagacccaaatgttacgggttttcccggatgatggctaccctggaagttaaccagcctgagcaacgccttggacagtgcacaggctgtcacctggaatgcatcaatgggggcgtgagactcattaccctgacatctgagcttaagagcgccaccgtctgtgcgtcccatttctgctctagcgccacgtccggaaagaaaagcacagagatccagttccactctggctccctcgtggggaagaccgctattcacgttaaaggagccctggtggatggcacagaatttaccttcgaggggagctgtatgtttcccgacggatgcgatgctgtcgactgcaccttctgtcgggaatttcttaagaacccccaatgctatcctgccaaaaagtggctgttcatcatcattgtgatcctcctgggctacgcggggcttatgctgctcacaaatgtcctgaaggccattggcatctggggatcttgggtgattgctccggttaaactgatgtttgccatcatcaagaaactcatgcgcacggtgtcctgtctgatgagaaagctgatggatcggggcagacaggtcattcatgaggaaatcggggagaaccgcgagggaaatcaggacgatgtgcggattgaaatggctagaccccgccgggttagacactggatgtatagccctgtgatcctgaccattctcgccatcggcctggccgagtcttgcgacgaaatggtccatgctgatagcaaacttgtgtcctgtcgccaggggagcggaaacatgaaggagtgcgtgacaaccggccgggcgctgctccccgccgttaatcctgggcaagaggcttgtctgcacttcacagcccccggctctccggactccaagtgcctgaaaattaaggtcaaaagaatcaacctcaagtgtaaaaagagctcctcttactttgtgcctgatgcccgcagccggtgcacctccgtgagacgctgtcggtgggctggagactgccagtctggctgtccccctcatttcacgagcaattccttttctgacgattgggccgggaagatggacagagcgggactgggcttcagcgggtgctccgatggatgcggcggggctgcctgtggctgctttaacgccgctcccagctgtatcttctggcggaaatgggtcgaaaatcctcacggaattatctggaaggtgtctccctgcgccgcttgggttccgtccgccgtgattgagcttacaatgcctagcggcgaagtccgcaccttccaccccatgtctgggatccccacccaggtgtttaaaggagtttccgtgacatatctgggcagcgacatggaggtctctgggctcaccgatctgtgtgaaattgaggagctgaagtccaaaaagctggcgctcgccccttgcaaccaggctggaatgggcgtggttggcaaagtgggggaaatccaatgtagctccgaggaaagcgccagaacaatcaagaaggacggatgcatttggaacgctgatctggtcggcatcgagctgcgggtggacgatgccgtgtgttactctaaaattacgagcgtcgaagcggttgccaattattccgctatcccgaccacaattgggggactcagattcgagcgctctcatgacagccagggcaagatctccgggtctcccctggatatcagcgccattcggggatccttttctgtgaactacagaggccttcgcctgagcctctccgagatcaccgctacatgcaccggcgaagtgacgaatgtcagcgggtgctactcttgtatgaccggagccaaagtgtccattaagctgcacagctctaaaaactccacagcccatgttagatgcaagggcgacgagaccgctttcagcgtgctggaaggggtccactcctatatcgtgtctcttagctttgatcacgcggttgtggacgagcagtgtcagctcaattgcggaggccatgaatcccaagtcacactgaaggggaacctgattttcctcgacgtgcctaaatttgttgatggaagctacatgcagacctatcactctacggtgcccacaggcgccaatatcccttcccccaccgactggctgaacgctcttttcggcaatgggctgagccggtggatcctcggagtcattggcgtgctgcttgggggacttgccctcttttctatgatcatgagcctgttcaagctgggcacaaaacaggtgtttcgctccagaaccaagctcgcctga

SEQ ID NO: 14760 - RNA, 3222 nt, synthetic construct
  misc_feature 1..3222: note = derived and/or modified CDS sequence (opt5) from SFTSV(JS2014-H.longicornis-02)__KR230786.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgtggaagccttcctggagcttaagtcctttagccagtctgagttccccgacatctgcaaaattgatggaatcgtctttaatcagtgtgaaggcgagagcctgcctcaacccttcgacgtggcttggatggatgtggggcactcccataagatcattatgcgcgaacacaaaacaaagtgggtccaggagtctagctccaaggactttgtttgctataaagagggaaccggcccgtgtcctgaaagcgaggaaaagacatgcaaaacctctgggtcctgcagaggagacatgcagttctgtaaggtggccggctgcgagcacggcgaagaggctagcgaggccaaatgtcggtgctctctcgtgcataagcccggggaagtcgtggtttcctacggaggcatgcgcatcagacctaaatgttacgggtttagccggatgatggcgacactggaggtgaaccagcccgaacaacgccttggacagtgcaccggctgtcacctggagtgcattaatgggggcgtcagactcatcacgctgacctccgaactgaagtctgccacagtgtgtgctagccatttctgctcctctgccaccagcggaaagaaatccacagagattcagttccacagcggctctctcgttgggaagaccgctatccacgtgaaaggagccctggtcgatggcacggagtttacattcgaagggtcctgtatgtttcccgacggatgcgatgcggtggactgcaccttctgtcgggagtttcttaagaaccctcaatgctatccggccaaaaagtggctgttcatcattatcgtcattctcctgggctacgctgggcttatgctgctcacaaatgtgctgaaggccatcggcatttggggaagctgggttatcgctcccgtgaaactgatgtttgccatcattaagaaactcatgcgcaccgtctcttgtctgatgagaaagctgatggatcggggcagacaggtgatccatgaagagattggggaaaaccgcgagggaaatcaggacgatgttcggatcgagatggccagacctcgccgggtgagacactggatgtattcccccgtcattctgaccatcctcgctattggcctggcggaaagctgcgacgagatggtgcatgccgattctaaacttgtgagctgtcgccaggggtccggaaacatgaaggaatgcgttacaacgggccgggctctgctccctgccgtcaatcccgggcaagaggcctgtctgcacttcaccgctccgggcagccctgactctaagtgcctgaaaatcaaggtgaaaagaatcaacctcaagtgtaaaaagtccagctcctactttgtgcccgatgcccgctctcggtgcacaagcgtcagacgctgtcggtgggcgggagactgccagtccggctgccctccccatttcacctctaatagcttttccgacgattgggctgggaagatggacagagccggactgggcttctctgggtgtagcgatggatgcggcggggccgcttgtggctgctttaacgccgctccttcctgtattttctggcggaaatgggtggagaatccccacggaatcatttggaaggttagcccgtgcgccgcgtgggtgccttctgccgtcatcgaacttacaatgccctccggcgaggtgcgcaccttccaccccatgagcgggattcctacgcaggtttttaaaggagtgtctgtcacatatctgggctccgacatggaagtgagcgggctcaccgatctgtgtgagatcgaggaactgaagtctaaaaagctcgctcttgccccgtgcaaccaggctggaatgggcgttgtgggcaaagtcggggagatccaatgttccagcgaagagtccgccagaaccattaagaaggacggatgcatctggaacgcggatctggtgggcattgaactgcgggtggacgatgccgtctgttacagcaaaatcacatctgttgaggctgtggccaattatagcgctattcccaccacaatcgggggactcagattcgaacgctcccatgactctcagggcaagatcagcgggtcccctctggatattacggccatccggggatcttttagcgtgaactacagaggccttcgcctgtccctctctgagattaccgccacatgcaccggcgaggtcacaaatgtgagcgggtgctactcctgtatgaccggagctaaagttagcatcaagctgcactcttccaaaaacagcacggcgcatgtgagatgcaagggcgacgaaaccgccttctctgtcctggagggggtgcactcctatacagttagcctttcctttgatcacgctgtggtcgacgaacagtgtcagctcaattgcggaggccatgagtctcaagtgaccctgaaggggaacctgattttcctcgacgttcccaaatttgtggatggaagctacatgcagacatatcactccaccgtccctacgggcgccaatatccccagccctacagactggctgaacgcccttttcggcaatgggctgtctcggtggatcctcggagtgattggcgtgctgcttgggggacttgctctctttttcatgatcatgtccctgtttaagctgggcaccaaacaggtcttccgcagcagaacaaagctcgcctga

SEQ ID NO: 14761 - RNA, 3222 nt, synthetic construct
  misc_feature 1..3222: note = derived and/or modified CDS sequence (opt5) from SFTSV(JS2014-H.longicornis-03)__KR230787.1__GP
  source 1..3222: mol_type = other RNA
atgatgaaggtgatctggttcagctccctgacctgctttgtcattcagtgttctggcgacagcgggcccatcatttgcgccggacctatccactccaacaaatctgctgatattccgcatctcctgggctacagcgagaagatctgtcaaatcgacagacttattcacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgatcgttcccgggcctagctataagggaaaggtgtttttcgagcgccccacatttgacggctacgtcgggtggggatgtggctctgggaaatccagaacggaaagcggagagctctgctcctctgatagcggcacctccagcggcctgctgccttctgaccgggtgctctggattggggatgttgcctgtcagccgatgacacccatccctgaagagaccttcctggagcttaagtcctttagccagtctgagttccccgacatttgcaaaatcgatggaattgtgtttaatcagtgtgaaggcgaaagcctgcctcaacccttcgacgtcgcctggatggatgtggggcactcccataagatcatcatgcgcgagcacaaaacaaagtgggtgcaggagtctagctccaaggactttgtctgctataaagaaggaaccggcccgtgtagcgagtctgaagagaagacatgcaaaacctccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcattagacccaaatgttacgggttttcccggatgatggccacgctggaagttaaccagcctgagcaacgcatcggacagtgcaccggctgtcaccttgaatgcattaatgggggcgtgagactgatcacactcacctctgagctcaagagcgcgacagtctgtgcctcccatttctgctctagcgctacctccggaaagaaaagcacggagattcagttccactctggctccctggtggggaagacagccatccacgttaaaggagctctggtggatggcaccgaatttacattcgaggggagctgtatgtttcccgacggatgcgatgccgtcgactgcaccttctgtcgggaatttctgaagaacccccaatgctatcctgcgaaaaagtggcttttcatcattatcgtgattctgctcggctacgccgggctgatgcttctgaccaatgtcctcaaggctatcggcatttggggatcttgggtgatcgccccggttaaactgatgtttgctatcattaagaaactgatgcgcacagtgtcctgtctcatgggcaagctgatggatagagggcggcaggtcatccatgaggaaattggagagaacagagagggcaatcaggacgatgtgcgcatcgaaatggcccggcccagacgcgttcggcactggatgtatagccctgtgattcttacgttcctggccatcgggctcgctgagtcttgcgacgaaatggtccatgcggatagcaaactggtgtcctgtagacagggaagcggcaacatgaaggagtgcgtgaccacagggcgcgcccttctgcccgctgttaatcctggccaagaggcctgtctccactttaccgcccccggatctccggactccaagtgcctgaaaattaaggtcaaacggatcaacctgaagtgtaaaaagagctcctcttacttcgtgcctgatgctagaagccgctgcacatccgtgcggagatgtcgctgggccggcgactgccagtctgggtgtccccctcattttaccagcaattccttctctgacgattgggcgggaaagatggaccgggctggcctcgggtttagcggatgctccgatggctgcgggggcgccgcctgtggatgcttcaacgctgcccccagctgtatcttctggagaaaatgggtcgaaaatcctcacggcattatctggaaggtgtctccctgcgctgcctgggttccgtccgcggtgattgagctgacgatgcctagcggggaagtccggacatttcaccccatgtctggaatccccacccaggtgttcaaaggcgtttccgtgacctatcttgggagcgacatggaggtctctggactgacagatctctgtgaaattgaggagctgaagtccaaaaagctggcccttgctccttgcaaccaggccggcatgggcgtggttgggaaagtgggagaaatccaatgtagctccgaggaaagcgctcgcaccatcaagaaggacggctgcatttggaacgccgatctcgtcgggatcgagctgagagtggacgatgcggtgtgttactctaaaattacaagcgtcgaagccgttgctaattattccgccatcccgacgaccattggaggcctgcggtttgagagatctcatgacagccaggggaagatctccggatctcccctcgatatcacagctattcgcggcagcttctccgtgaactaccggggcctgagactttctctgagcgagatcaccgccacatgcaccggggaagtgacgaatgtctccggatgctacagctgtatgaccggcgccaaagtgtctattaagctccactccagcaaaaactctacagctcatgttcgctgcaagggggacgagaccgcgttttccgtgctggaaggagtccacagctatacagtgtccctgtctttcgatcacgccgttgtggacgagcagtgtcagcttaattgcggcgggcatgaaagccaagtcaccctcaagggaaacctgatctttctggacgtgcctaaattcgttgatggctcctacatgcagacgtatcacagcacagtgcccaccggcgctaatattccttctcccacagactggctcaacgccctgtttgggaatggactttccagatggatcctgggcgtcatcggggtgctcctgggaggcctggcccttttctttatgattatgagcctcttcaagctggggaccaaacaggtgtttcggtctcgcaccaagctggcttga

SEQ ID NO: 14762 - RNA, 3222 nt, synthetic construct
  misc_feature 1..3222: note = derived and/or modified CDS sequence (opt5) from SFTSV(JS2014-Hedgehog-02)__KR230789.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcatcagacccaaatgttacgggttttcccggatgatggccaccctggaagttaaccagcctgagcaacgcattggacagtgcacgggctgtcaccttgaatgcatcaatgggggcgtgagactgattaccctcacatctgagcttaagagcgcgaccgtctgtgcctcccatttctgctctagcgctacatccggaaagaaaagcaccgagatccagttccactctggctccctggtggggaagacggccatccacgttaaaggagctctcgtggatggcacagaatttaccttcgaggggagctgtatgtttcccgacggatgcgatgccgtcgactgcacattctgtcgggaatttctgaagaacccccaatgctatcctgcgaaaaagtggcttttcattatcattgtgatcctgctcggctacgccgggctgatgcttctgaccaatgtcctcaaggctattggcatctggggatcttgggtgatcgccccggttaaactgatgtttgctattatcaagaaactgatgcgcaccgtgtcctgtctcatgggcaagctgatggatagagggcggcaggtcattcatgaggaaatcggagagaacagagagggcaatcaggacgatgtgcgcattgaaatggcccggcccagacgcgttcggcactggatgtatagccctgtgatccttacaattctggccatcgggctcgctgagtcttgcgacgaaatggtccatgcggatagcaaactggtgtcctgtagacagggaagcggcaacatgaaggagtgcgtgacgaccgggcgcgcccttctgcccgctgttaatcctggccaagaggcctgtctccacttcacagcccccggatctccggactccaagtgcctgaaaatcaaggtcaaacggattaacctgaagtgtaaaaagagctcctcttactttgtgcctgatgctagaagccgctgcacctccgtgcggagatgtcgctgggccggcgactgccagtctgggtgtccccctcatttcacaagcaattccttttctgacgattgggcgggaaagatggaccgggctggcctcgggttcagcggatgctccgatggctgcgggggcgccgcctgtggatgctttaacgctgcccccagctgtatcttctggagaaaatgggtcgaaaatcctcacggcattatctggaaggtgtctccctgcgctgcctgggttccgtccgcggtgattgagctgaccatgcctagcggggaagtccggacgttccaccccatgtctggaatccccacacaggtgtttaaaggcgtttccgtgacctatcttgggagcgacatggaggtctctggactgaccgatctctgtgaaatcgaggagctgaagtccaaaaagctggcccttgctccttgcaaccaggccggcatgggcgtggttgggaaagtgggagaaattcaatgtagctccgaggaaagcgctcgcacaatcaagaaggacggctgcatttggaacgccgatctcgtcgggatcgagctgagagtggacgatgcggtgtgttactctaaaattaccagcgtcgaagccgttgctaattattccgccatcccgacaacgatcggaggcctgcggttcgagagatctcatgacagccaggggaagatttccggatctcccctcgatatcaccgctattcgcggcagcttttccgtgaactaccggggcctgagactttctctgagcgagatcacagctacctgcacaggggaagtgaccaatgtctccggatgctacagctgtatgacgggcgccaaagtgtctattaagctccactccagcaaaaactctaccgcccatgttcgctgcaagggggacgagacagcgttctccgtgctggaaggagtccacagctataccgtgtccctgtcttttgatcacgccgttgtggacgagcagtgtcagcttaattgcggcgggcatgaaagccaagtcacactcaagggaaacctgatcttcctggacgtgcctaaatttgttgatggctcctacatgcagacctatcacagcacggtgcccacaggcgctaatatcccttctcccaccgactggctcaacgccctgttcgggaatggactttccagatggattctgggcgtcatcggggtgctcctgggaggcctggccctgtttttcatgattatgagcctctttaagctggggacaaaacaggtgttccggtctcgcaccaagctggcttga

SEQ ID NO: 14763 - RNA, 3222 nt, synthetic construct
  misc_feature 1..3222: note = derived and/or modified CDS sequence (opt5) from SFTSV(KACNH)__KU507558.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctagcatcccgcatctgcttggctactccgagaagatctgtcaaattgatagactgatccacgtttctagctggctccggaatcattcccagtttcaggggtatgtgggacagcgcggcgggagaagccaagtgtcttactatcccgccgaaaactcctacagccggtggtctggactgctttccccttgcgacgcggattggctgggcatgctcgtcgtgaaaaaggctaaaggcagcgacatgattgttcccgggccttcttataagggaaaggtgttctttgagcgccccaccttcgatggctacgtcgggtggggatgtggctccgggaaaagcagaacagaatccggagagctgtgctctagcgactccggcacgagctctggcctgctcccttccgatcgggtgctgtggatcggggacgttgcctgtcagccgatgacccccattcctgaagagacatttcttgagcttaagagcttctctcagagcgaatttcccgatatctgcaaaattgacggaatcgtgttcaatcagtgtgagggcgaatccctccctcaaccctttgatgtcgcctggatggacgtggggcactctcataagatcattatgcgcgagcacaaaaccaagtgggtgcaggagagctccagcaaggatttcgtctgctataaagaaggaacaggcccgtgttctgagtccgaagagaaggcttgcaaaaccagcgggtcttgcagaggagacatgcagttttgtaaggttgccggctgcgaacacggcgaggaggcttccgacgccaaatgtcggtgcagcctggtgcataagcctggggaagtggtcgtgtcctacggaggcatgcgcgttagacccaaatgttacgggttctctcggatgatggcgacacttgaggtgaaccctcccgaacagcgcatcggacaatgcaccggctgtcacctggagtgcattaatgggggcgtcagactcatcacgctgaccagcgaactgaagtccgccacagtgtgtgcttctcatttttgcagctccgccaccagcggaaagaaatctacagagattcagttccactccggcagcctcgttgggaagaccgctatccacgtgaaaggagccctggtcgatggcacggagttcacatttgaagggtcttgtatgttccccgacggatgcgatgcggtggactgcaccttttgtcgggagttccttaagaaccctcagtgctatccggccaaaaagtggctgtttatcctcattgtcatcctgcttggctacgctgggctgatgctcattacaaatgtgctgaaggccatcggcgtttggggatcctgggtgattgctcccgtcaaactgatgttcgccatcatcaagaaactcatgcgcaccgtgagctgtctgatgggcaagctgatggatagagggcggcaagttattcatgaagagatcggagaaaacggcgaggggaatcaggacgatgtgagaattgagatggcccgccctcggagagtccgccactggatgtattctcccgtgatcctgaccattctcgctatcggactggcggaaggctgcgacgagatggtgcatgccgatagcaaacttgtttcctgtcggcaggggagcggcaacatgaaggaatgcgtcacaacgggcagagctctgctccctgccgtgaatcccggacaggaggcctgtctgcactttaccgctccggggtctcctgactccaagtgcctgaaaattaaggtgaaacgcatcaacctcaagtgtaaaaagagctcctcttacttcgtccccgatgcccggagcagatgcacatccgtgcgccggtgtagatgggcgggagactgccaatctggctgccctccccattttaccagcaattccttctctgacgattgggctgggaagatggaccgcgccggactgggctttagcgggtgttccgatggctgcggaggcgccgcttgtgggtgcttcaacgccgctcctagctgtatcttttggcggaaatgggttgagaatccccacggaattatctggaaggtgtctccgtgcgccgcgtgggtcccttccgccgtgattgaacttacaatgcccagcggcgaggttagaaccttccaccccatgtctgggatccctacacaggtgttcaaaggagtctccgtgacgtatctgggcagcgacatggaagtttctggcctcaccgatctgtgtgagattgaggaactgaagtccaaaaagctggctctcgccccgtgcaaccaggctgggatgggagtggtcggcaaagtgggggagatccagtgtagctccgaagagagcgcccggaccatcaagaaggacggatgcatttggaacgcggatctggtgggcatcgaactgcgcgtcgacgatgccgtttgttactctaaaattacaagcgtggaggctgtggccaattattccgctatccccaccacaattgggggactcagatttgaacggtctcatgacagccaaggcaagatctccggctctcctctggatatcacggccattagagggagcttctccgtcaactaccgcggacttcggctgtctctcagcgagatcaccgccacatgcaccggcgaggtgacaaatgtttccgggtgctacagctgtatgaccggagctaaagtgtctattaagctgcactccagcaaaaactctacggcgcatgtcagatgcaagggcgacgaaaccgccttttccgtgctggagggggttcacagctatacagtgtccctttctttcgatcacgctgtcgtggacgaacagtgtcagctcaattgcggaggccatgagagccaggttaccctgaagggcaacctgatctttctcgacgtgcccaaattcgtcgatgggtcctacatgcaaacatatcacagcaccgtgcctacgggagccaatattccctctcctacagactggctgaacgccctttttggcaatgggctgtcccgctggatcctcggagtgatcggcgtcctgcttgggggacttgctctcttctttctgattatgagcctgttcaagctcggcaccaaacaggtttttagatctcggacaaagctggcctga

SEQ ID NO: 14764 - RNA, 3222 nt, synthetic construct
  misc_feature 1..3222: note = derived and/or modified CDS sequence (opt5) from SFTSV(KACNH2)__KU507559.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcaaccgggtgctgtggatcggggatgttgcctgtcagccgatgacacccattcctgaagagacctttcttgagctgaagtctttctcccagagcgaatttcccgacatctgcaaaattgatggaatcgtgttcaatcagtgtgagtctgaaagcctccctcaaccctttgacgtcgcctggatggatgtgggccactcccataagatcattatgcgcgagcacaaaacaaagtgggtgcaggagtctagctccaaggacttcgtctgctataaagaagggaccggaccgtgtagcgagtctgaagagagaacatgcaagacctccggcagctgccgcggggatatgcagttttgtaaagttgctggatgcgaacacggcgaggaggcctctgaagctaagtgtcggtgctccctggtgcataaacctggcgaggtggtcgtgagctacgggggaatgagagttcggcccaagtgttacggcttctcccgcatgatggccacgcttgaagtgaaccctcccgagcagagaatcgggcaatgcaccggatgtcacattgaatgcatcaatggcggggtccggctgattacactcacctctgagctgaaaagcgcgacagtgtgtgcctcccatttttgctctagcgctacctccggcaaaaagagcacggagatccagttccactctggatccctggttggcaaggccgctatccacgtgaagggggccctcgtcgacggaacagaatttacctttgagggcagctgtatgttccccgacgggtgcgatgcggtggactgcacattttgtcgcgagttcctgaaaaaccctcagtgctatccggccaagaaatggctttttattatcattgtcatcctgctcggatacgctggcctgatgcttctgaccaatgtgctcaaggccattggggtttggggctcttgggtgatcgctcccgtcaagctgatgttcgccatcattaaaaagctgatgagatccgtgagctgtctcatgggaaaactgatggatcggggcagacaagttatccatgaagaaattggggagaaccgcgagggaaatcaggacgatgtgcggatcgaaatggccagacctcgccgggtcagacactggatgtattctcccgtgattcttaccatcctggctattggcctcgcggaggggtgcgacgaaatggtgcatgccgatagcaagctggtttcctgtcgccagggaggcgggaacatgaaagagtgcgtcacaacgggccgggcccttctgcctgctgtgaatcccggacaggaggcctgtctccactttaccgctccgggcagccctgactctaagtgcctgaagatcaaagtgaagagaatcaacctgaaatgtaagaaatccagctcctacttcgtccccgatgcccgctctcggtgcacaagcgtgagacgctgtcggtgggcgggggactgccaatccggatgcccttctcattttaccagcaattccttctctgatgactgggctggcaagatggacagagccgggctcggatttagcggctgttccgatgggtgcggcggagccgcttgtggctgcttcaacgccgctcccagctgtattttctggcggaagtgggttgaaaaccctcacgggatcatttggaaagtgtctccctgcgccgcgtgggtcccgtccgccgtgatcgagctgacaatgcctagcggagaagttcgcaccttccaccccatgtctggcattcccacacaggtgttcaagggggtctccgtgacgtatcttggaagcgacatggaggtttctggcctgaccgatctctgtgaaatcgaggagctgaaatccaagaaactggctcttgccccttgcaatcaggctggcatgggggtggtcggaaaggtgggcgaaatccagtgtagctccgaggaaagcgccagaaccattaaaaaggacgggtgcatctggaacgcggatctcgtgggaattgagctgcgggtcgacgatgccgtttgttactctaagatcacaagcgtggaagctgtggccaattattccgctattccgaccacaatcggcgggctgagatttgagcgctctcatgacagccaaggaaaaatctccggctctcccctcgatattacggccatccggggcagcttctccgtcaactacagagggctgcgcctttctctgagcgagattaccgccacatgcaccggagaagtgacaaatgtttccggctgctacagctgtatgaccggggctaaggtgtctatcaaactccactccagcaagaactctacggcgcatgtcagatgcaaaggagacgagaccgccttttccgtgctggaaggcattcacagctatacagtttccctgtctttcgatcacgctgtggtcgacgagcagtgtcagcttaattgcgggggacatgaaagccaggtgaccctcaagggcaacctgatctttctggatgttcctaagttcgtggacggctcctacatgcaaacatatcacagctctgtccccaccggggccaatatcccttcccccacggactggctcaacgccctgtttggaaatggccttagccggtggattctgggggtgatcggagtgctcctgggcgggctggctcttttctttctcattatgtctctgttcaaactgggaacaaagcaggtctttcgcagcagaaccaaactcgcctga

SEQ ID NO: 14765 - RNA, 3222 nt, synthetic construct
  misc_feature 1..3222: note = derived and/or modified CDS sequence (opt5) from SFTSV(KACNH3)__KP663744.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctccctcaaccctttgatgtcgcctggatggacgtgggccactcccataagatcattatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatgcagttttgtaaggttgctggatgcgaacacggcgaggaggcctctggcgctaaatgtcggtgctccctggtgcataagcctggggaagtggtcgtgagctacggaggcatgcgcgttagacccaaatgttacgggttctcccggatgatggccacgcttgaggtgaatcctcccgaacagcgcatcggacaatgcaccggctgtcacctggagtgcattaacgggggcgtcagactcatcacactgacctctgaacttaagagcgcgacagtgtgtgcctcccatttttgctctagcgctacctccggaaagaaaagcacggagattcagttccactctggctccctcgttgggaagacagccatccacgtgaaaggagctctggtcgacggcaccgagttcacatttgaagggagctgtatgttccccgatggatgcgacgccgtggattgcaccttttgtcgggagttccttaagaatcctcagtgctatccggcgaaaaagtggctgtttatcattatcgtcattctcctgggctacgccgggcttatgctgctcaccaacgtgctgaaggctatcggcgtttggggatcttgggtgattgcccccgtcaaactgatgttcgctatcatcaagaaactcatgcgctccgtgagctgtctgatgggcaagctgatggacagagggcggcaagttattcatgaagagatcggagaaaatagagagggcaaccaggatgacgtgcgcattgagatggcccggcctagacgcgtccggcactggatgtattctcccgtgatcctgacaattctcgccatcgggctggctgaaggatgcgatgagatggtgcatgcggacagcaaacttgtttcctgtaagcagggcagcgggaatatgaaggaatgcgtcacgaccggcagagccctgctccctgctgtgaaccccggacaggaggcctgtctgcactttacagccccgggctctcctgattccaaatgcctgaagattaaagtgaagcgcatcaatctcaaatgtaagaagtcctcctcttacttcgtccccgacgctcggagcagatgcacctccgtgcgccggtgtagatgggccggggattgccaatctggatgccctagccattttacatccaactctttcagcgacgactgggcgggcaaaatggatcgcgctgggctgggattttccggctgtagcgacgggtgcggcggagccgcctgtggctgcttcaatgctgccccctcttgtatcttttggcggaagtgggttgagaaccctcacgggattatctggaaagtgtccccctgcgctgcctgggtcccgagcgcggtgattgaacttaccatgccttctggagaggttagaacgttccaccccatgtccggcatccccacacaggtgttcaagggggtcagcgtgacctatctgggatctgatatggaagtttccggcctcaccgacctgtgtgagattgaggaactgaaaagcaagaaacttgccctcgctccttgcaaccaggccggcatgggggtggtcggaaaggtgggcgagatccagtgttccagcgaagagtctgctcggacaatcaagaaagatgggtgcatttggaatgccgacctggtgggaatcgaactgcgcgtcgatgacgcggtttgttacagcaagattacctccgtggaggccgtggctaactattctgccatcccgacaacgattggcgggctcagatttgaacggagccatgattcccaaggaaaaatctctggcagccccctggacatcaccgctattagaggctccttctctgtcaattaccgcgggcttcggctgagcctctccgaggtgacagctacctgcacaggagaggttaccaacgtgagcggctgctactcttgtatgacgggggccaaggtctccatcaaactgcacagctctaagaatagcaccgcccatgtgagatgcaagggagatgaaacagcgtttagcgttctggagggcgtgcactcctataccgtctctcttagcttcgaccacgccgtggttgatgaacagtgtcagctcaactgcgggggacatgagtcccaggtgacactgaaaggcaatctgatttttctcgacgtccctaagttcgtggacggcagctacatgcaaacctatcactcttccgtgcccacgggggctaacatccctagccccacagattggctgaatgccctttttggaaacggcctgtctcgctggattctcggggtcatcggagttctgctgggcgggcttgccctcttctttctgatcatgagcctgttcaaactcggaaccaaacaggtgtttagatcccggacaaagctggcttga

SEQ ID NO: 14766 - RNA, 3222 nt, synthetic construct
  misc_feature 1..3222: note = derived and/or modified CDS sequence (opt5) from SFTSV(KADGH)__KU507548.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctcgcccaaccttttgatgtcgcttggatggacgtgggccactcccataagatcattatgcgcgagcacaaaacaaagtgggtgcaggagtctagctccaaggatttcgtctgctataaagaagggaccggaccctgtagcgagtctgaagagaagacatgcaaaacctccggcagctgcagaggggacatgcagttttgtaaggttgccggatgcgaacacggcgaggagacgtctgtggctaaatgtcggtgctccctggtgcataagccgggcgaagtcgtggttagctacgggggaatgcgcgtgagacctaaatgttacggcttctcccggatgatggccacccttgaggtcaatccccctgaacagcgcatcgggcaatgcacaggatgtcacctggagtgcatttctggcggggtgagactcatcaccctgacaagcgaactgaagtccgcgaccgtttgtgcctctcatttttgcagctccgctacgagcggcaagaaatctacagagattcagttccactccggaagcctcgtgggcaaggccgctatccacgtcaaaggggtgctggtcgacggaaccgagttcacatttgaaggctcttgtatgttccccgatgggtgcgacgccgtggattgcaccttttgtcgggagttccttaagaacccccagtgctatcctgcgaaaaagtggctgtttatcattatcgttattctcctgggatacgccggccttatgctgctcaccaatgtgctgaaggctatcggggtctggggctcctgggtgattgccccggttaaactgatgttcgctatcatcaagaaactcatgcgcagcgtgtcttgtctgatgggaaagctgatggacagaggccggcaagtcattcatgaagagatcggggaaaacagagagggaaatcaggatgacgtgcgcattgagatggcccggcccagacgcgtgcggcactggatgtatagccctgttatcctgacaattctcgccatcggcctggctgaagggtgcgatgagatggtccatgcggactccaaacttgtgagctgtagacagggatctggcaacatgaaggaatgcgtgacgaccgggcgcgccctgctccccgctgtcaatcctggccaggaggcctgtctgcactttacagcccccggatccccggatagcaagtgcctgaaaattaaggtgaaacggatcaacctcaagtgtaaaaagtcctctagctacttcgttcctgacgctagatcccgctgcacctctgtgcggagatgtcgctgggccggcgattgccaaagcgggtgcccctcccattttacatctaatagcttctccgacgactgggcgggaaagatggatcgggctggcctggggtttagcggatgttctgacggctgcgggggcgccgcctgtggatgcttcaacgctgccccttcctgtatcttttggagaaaatgggtcgagaatccccacggcattatctggaaggtgagcccttgcgctgcctgggttccctctgcggtgattgaacttaccatgccgtccggggaggtccggacgttccaccctatgagcggaatccccacacaggtgttcaaaggcgtttctgtgacctatctggggtccgatatggaagtcagcggactcaccgacctgtgtgagattgaggaactgaagtccaaaaagctcgcccttgctccctgcaaccaggccggcatgggcgtggtggggaaagtcggagagatccagtgtagctctgaagagagcgctcgcacaatcaagaaggatggctgcatttggaacgccgacctggttgggatcgaactgagagtggatgacgcggtgtgttactccaaaattacctctgtcgaggccgtggctaattatagcgccatccctacaacgattggaggcctccggtttgaaagatcccatgattctcaagggaagatcagcggatccccgctggacatcaccgctattcgcggctctttcagcgttaactaccggggccttagactgtccctcagcgagatcacagctacctgcacaggggaggtgaccaatgtctctggatgctactcctgtatgacgggcgccaaagtgagcattcgcctgcactcttccaagaacagcaccgcccatgttagatgcaaagaagatgagacagcgttttccgtgctggaaggggtccactcttataccgtgagcctttccttcgaccacgccgttgtggatgagcagtgtcagctcaattgcggaggccatgaaagccaggtcacactgaaggggaacctgatctttctcgacgtgcccaagttcgtggacggatcttacatgcaaacctatcactccagcgtccctacgggcgctaatattccctctcctacagattggctgaacgccctttttggcaatgggctgagccggtggatcctcggagttatcggcgtgctgcttgggggacttgccctcttctttctgattatgtccctgttcaaactcggcaccaaacaggtgtttcgctctagaacaaagctggcttga

SEQ ID NO: 14767 - RNA, 3222 nt, synthetic construct
  misc_feature 1..3222: note = derived and/or modified CDS sequence (opt5) from SFTSV(KAGBH)__KU507560.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttccttgagctgaagtctttttcccagagcgagttccccgatatctgcaaaattgacggaatcgtgtttaaccagtgtgaatctgaaagcctccctcaacccttcgatgtcgcctggatggacgtgggccactcccataagatcattatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggaggcctctgaagctaaatgtcggtgctccctggtgcataagcctggcgaggtggtcgtgagctatgggggaatgcgcgttagacccaaatgttacggcttttcccggatgatggccacgcttgaagtgaatcctcccgagcagcgcatcgggcaatgcaccggatgtcacctggaatgcattaacggcggggtcagactcatcacactgacctctgagcttaagagcgcgacagtgtgtgcctcccatttctgctctagcgctacctccggcaagaaaagcacggagattcagttccactctggatccctcgttggcaagacagccatccacgtgaaaggggctctggtcgacggaaccgaatttacattcgagggcagctgtatgtttcccgatgggtgcgacgccgtggattgcaccttctgtcgggaatttcttaagaatcctcagtgctacccggcgaaaaagtggctgttcatcattatcgtcattctcctgggatatgccggccttatgctgctcaccaacgtgctgaaggctatcggggtttggggctcttgggtgattgcccccgtcaaactgatgtttgctatcatcaagaaactcattcgctccgtgagctgtctgatgggaaagctgatggacagaggccggcaagttatccatgaggaaattggggagaatagagagggaaaccaggatgacgtgcgcatcgaaatggcccggcctagacgcgtccggcactggatgtactctcccgtgattctgacaatcctcgccattggcctggctgaggggtgcgatgaaatggtgcatgcggacagcaaacttgtttcctgtaagcagggaagcggcaatatgaaggagtgcgtcacgaccgggagagccctgctccctgctgtgaaccccggccaggaggcctgtctgcacttcacagccccgggatctcctgattccaaatgcctgaagatcaaagtgaagcgcatcaatctcaaatgtaagaagtcctcctcttattttgtccccgacgctcggagcagatgcacctccgtgcgccggtgtagatgggccggcgattgccaatctgggtgccctagccatttcacatccaactcttttagcgacgactgggcgggaaaaatggatcgcgctggcctggggttctccggatgtagcgacggctgcgggggcgccgcctgtggatgctttaatgctgccccctcttgtattttctggcggaagtgggttgaaaaccctcacggcatcatttggaaagtgtccccctgcgctgcctgggtcccgagcgcggtgatcgagcttaccatgccttctggggaagttagaacgttccaccccatgtccggcattcccacacaggtgtttaagggagtcagcgtgacctacctggggtctgatatggaggtttccggactcaccgacctgtgtgaaatcgaggagctgaaaagcaagaaacttgccctcgctccttgcaaccaggccggcatgggcgtggtcgggaaggtgggagaaatccagtgttccagcgaggaatctgctcggacaattaagaaagatggctgcatctggaatgccgacctggtggggattgagctgcgcgtcgatgacgcggtttgttatagcaagatcacctccgtggaagccgtggctaactactctgccattccgacaacgatcggaggcctcagattcgagcggagccatgattcccaagggaaaatctctggaagccccctggacattaccgctatcagaggctccttttctgtcaattatcgcggccttcggctgagcctctccgagattacagctacctgcacaggggaagtgaccaacgttagcggatgctactcttgtatgacgggcgccaaggtgtccatcaaactgcacagctctaagaatagcaccgcccatgtcagatgcaagggggatgagacagcgttcagcgtgctggaaggagttcactcctacaccgtgtctcttagctttgaccacgccgtcgtggatgagcagtgtcagctcaactgcggcgggcatgaatcccaggttacactgaaaggaaatctgattttcctcgacgtgcctaagtttgtcgacggcagctatatgcaaacctaccactcttccgtgcccacgggcgctaacatccctagccccacagattggctgaatgcccttttcgggaacggactgtctcgctggatcctcggcgtgattggggtcctgctgggaggccttgccctctttttcctgatcatgagcctgtttaaactcgggaccaagcaggttttcagatcccggacaaaactggcttga

SEQ ID NO: 14768 - RNA, 3222 nt, synthetic construct
  misc_feature 1..3222: note = derived and/or modified CDS sequence (opt5) from SFTSV(KAGBH3)__KU507561.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcaaccgggtgctgtggatcggggatgttgcctgtcagccgatgacacccattcctgaagagaccttccttgagctgaagtctttttcccagagcgagttccccgacatctgcaaaattgatggaatcgtgtttaatcagtgtgaatctgaaagcctccctcaacccttcgacgtcgcctggatggatgtgggccactcccataagatcattatgcgcgagcacaaaacaaagtgggtgcaggagtctagctccaaggactttgtctgctacaaagaagggaccggaccgtgtagcgagtctgaagagaagacatgcaaaacctccggcagctgcagaggggatatgcagttctgtaaggttgctggatgcgaacacggcgaggagacgtctgaagccaaatgtcggtgctccctggtgcataagcctggcgaggtggtcgtgagctatgggggaatgcgcgttagacccaaatgttacggcttttcccggatgatggctacccttgaagtgaaccctcccgagcagcgcatcgggcaatgcacaggatgtcacctggaatgcattaatggcggggtcagaatcattaccctcacatctgagctcaagagcgccaccgtgtgtgcgtcccatttctgctctagcgccacgtccggcaagaaaagcacagagatccagttccactctggatccctggttggcaagaccgctatccacgtgaaaggggccctggtcgacggaacagaatttaccttcgagggcagctgtatgtttcccgacgggtgcgatgctgtggactgcaccttctgtcgggaatttctgaagaaccctcagtgctacccggccaaaaagtggcttttcattatcattgtcatcctgctcggatatgcgggcctgatgcttctgacaaatgtgctcaaggccattggggtttggggctcttgggtgatcgctcccgtcaaactgatgtttgccatcattaagaaactgatgcgctccgtgagctgtctcatgggaaagctgatggatagaggccggcaagttatccatgaggaaattggggagaacagagagggaaatcaggacgatgtgcgcatcgaaatggctcggcctagacgcgtccggcactggatgtactctcccgtgattcttacgatcctggccattggcctcgccgaggggtgcgacgaaatggtgcatgctgatagcaaactggttctttgtaagcagggatccggcaacatgaaggagtgcgtcaccacagggagagcgctgctccctgccgtgaatcccggccaggaggcttgtctgcacttcaccgccccgggaagccctgactctaaatgcctgaagatcaaagtgaagcgcatcaacctcaaatgtaagaagtccagctcctattttgtccccgatgcccggtctagatgcacaagcgtgcgccggtgtagatgggctggcgactgccaatccgggtgcccttctcatttcaccagcaattccttttctgatgactgggccggaaaaatggaccgcgcgggcctggggttcagcggatgttccgatggctgcgggggcgctgcctgtggatgctttaacgccgctcccagctgtattttctggcggaagtgggttgaaaaccctcacggcatcatttggaaagtgtctccctgcgccgcttgggtcccgtccgccgtgatcgagcttacgatgcctagcggggaagttagaacattccaccccatgtctggcattcccacccaggtgtttaagggagtctccgtgacctacctggggagcgacatggaggtttctggactcacagatctgtgtgaaatcgaggagctgaaatccaagaaacttgcgctcgccccttgcaatcaggctggcatgggcgtggtcgggaaggtgggagaaatccagtgtagctccgaggaaagcgcccggaccattaagaaagacggctgcatctggaacgctgatctggtggggattgagctgcgcgtcgacgatgccgtttgttattctaagatcacaagcgtggaagcggtggccaattactccgctattccgacgaccatcggaggcctcagattcgagcggtctcatgacagccaagggaaaatctccggatctcccctggatattacagccatcagaggcagcttttccgtcaactatcgcggccttcggctgtctctcagcgagattaccgctacatgcaccggggaagtgacgaatgtttccggatgctacagctgtatgaccggcgccaaggtgtctatcaaactgcactccagcaagaactctacagcccatgtcagatgcaagggggacgagaccgctttctccgtgctggaaggagttcacagctacgcggtgtccctttcttttgatcacgccgtcgtggacgagcagtgtcagctcaattgcggcgggcatgaaagccaggttacactgaaaggaaacctgattttcctcgatgtgcctaagtttgtcgacggctcctatatgcaaacctaccacagctctgtgcccacgggcgctaatatcccttcccccacagactggctgaacgcccttttcgggaatggactgagccgctggatcctcggcgtgattggggtcctgctgggaggccttgccctctttttcctgatcatgtctctgtttaaactcgggaccaagcaggttttcagaagccggacaaaactggcttga

SEQ ID NO: 14769 - RNA, 3222 nt, synthetic construct
  misc_feature 1..3222: note = derived and/or modified CDS sequence (opt5) from SFTSV(KAGBH4)__KU507562.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttccttgagctgaagtctttttcccagagcgagttccccgatatctgcaaaattgacggaatcgtgtttaaccagtgtgaatctgaaagcctccctcaacccttcgatgtcgcctggatggacgtgggccactcccataagatcattatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggaggcctctgaagctaaatgtcggtgctccctggtgcataagcctggcgaggtggtcgtgagctatgggggaatgcgcgttagacccaaatgttacggcttttcccggatgatggccacgcttgaagtgaatcctcccgagcagcgcatcgggcaatgcaccggatgtcacctggaatgcattaacggcggggtcagactcatcacactgacctctgagcttaagagcgcgacagtgtgtgcctcccatttctgctctagcgctacctccggcaagaaaagcacggagattcagttccactctggatccctcgttggcaagacagccatccacgtgaaaggggctctggtcgacggaaccgaatttacattcgagggcagctgtatgtttcccgatgggtgcgacgccgtggattgcaccttctgtcgggaatttcttaagaatcctcagtgctacccggcgaaaaagtggctgttcatcattatcgtcattctcctgggatatgccggccttatgctgctcaccaacgtgctgaaggctatcggggtttggggctcttgggtgattgcccccgtcaaactgatgtttgctatcatcaagaaactcatgcgctccgtgagctgtctgatgggaaagctgatggacagaggccggcaagttattcatgaggaaatcggggagaatagagagggaaaccaggatgacgtgcgcattgaaatggcccggcctagacgcgtccggcactggatgtactctcccgtgatcctgacaattctcgccatcggcctggctgaggggtgcgatgaaatggtgcatgcggacagcaaacttgtttcctgtaagcagggaagcggcaatatgaaggagtgcgtcacgaccgggagagccctgctccctgctgtgaaccccggccaggaggcctgtctgcacttcacagccccgggatctcctgattccaaatgcctgaagattaaagtgaagcgcatcaatctcaaatgtaagaagtcctcctcttattttgtccccgacgctcggagcagatgcacctccgtgcgccggtgtagatgggccggcgattgccaatctgggtgccctagccatttcacatccaactcttttagcgacgactgggcgggaaaaatggatcgcgctggcctggggttctccggatgtagcgacggctgcgggggcgccgcctgtggatgctttaatgctgccccctcttgtatcttctggcggaagtgggttgaaaaccctcacggcattatctggaaagtgtccccctgcgctgcctgggtcccgagcgcggtgattgagcttaccatgccttctggggaagttagaacgttccaccccatgtccggaatccccacacaggtgtttaagggcgtcagcgtgacctacctggggtctgatatggaggtttccggactcaccgacctgtgtgaaattgaggagctgaaaagcaagaaacttgccctcgctccttgcaaccaggccggcatgggcgtggtcgggaaggtgggagaaatccagtgttccagcgaggaatctgctcggacaatcaagaaagatggctgcatttggaatgccgacctggtggggatcgagctgcgcgtcgatgacgcggtttgttatagcaagattacctccgtggaagccgtggctaactactctgccatcccgacaacgattggaggcctcagattcgagcggagccatgattcccaagggaaaatctctggaagccccctggacatcaccgctattagaggctccttttctgtcaattatcgcggccttcggctgagcctctccgagatcacagctacctgcacaggggaagtgaccaacgttagcggatgctactcttgtatgacgggcgccaaggtgtccattaaactgcacagctctaagaatagcaccgcccatgtcagatgcaagggggatgagacagcgttcagcgtgctggaaggagttcactcctacaccgtgtctcttagctttgaccacgccgtcgtggatgagcagtgtcagctcaactgcggcgggcatgaatcccaggttacactgaaaggaaatctgatcttcctcgacgtgcctaagtttgtcgacggcagctatatgcaaacctaccactcttccgtgcccacgggcgctaacattcctagccccacagattggctgaatgcccttttcgggaacggactgtctcgctggatcctcggcgtgatcggggtcctgctgggaggccttgccctctttttcctgattatgagcctgtttaaactcgggaccaagcaggttttcagatcccggacaaaactggcttga

SEQ ID NO: 14770 - RNA, 3222 nt, synthetic construct
  misc_feature 1..3222: note = derived and/or modified CDS sequence (opt5) from SFTSV(KAGBH5)__KP663738.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcagattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggcctctgtacaagggaaaggtgtttttcgagcgccccacatttgatggctatgtcgggtggggatgtggctccgggaaaagcagaacggaatctggagagctgtgctccagcgactccggcacctctagcggcctcctgccttccgatcgggtgctttggatcggggacgttgcctgtcagccgatgacacccattcctgaagagaccttcctggagctcaagagcttttctcagtccgagttccccgatatctgcaaaattgacggaatcgtgtttaaccagtgtgaaagcgaatctctgcctcaacccttcgatgtcgcctggatggacgtgggccacagccataagatcattatgcgcgagcacaaaacaaagtgggtgcaggagtcctctagcaaggattttgtctgctacaaagaagggaccggaccgtgttccgagagcgaagagaagacatgcaaaacctctggctcctgcagaggggacatgcagttctgtaaggttgctggatgcgaacacggcgaggagacgagcgaagccaaatgtcggtgctctcttgtgcataagcctggcgaggtggtcgtgtcctatgggggaatgcgcgttagacccaaatgttacggctttagccggatgatggctaccctggaagtgaatcctcccgagcagcgcatcgggcaatgcacaggatgtcacctcgaatgcattaacggcggggtcagactgatcaccctgacatccgagctcaagtctgccaccgtgtgtgcgagccatttctgctcctctgccacgagcggcaagaaatccacagagattcagttccacagcggatctctggttggcaagaccgctatccacgtgaaaggggcccttgtcgacggaacagaatttaccttcgagggccggtgtatgtttcccgatgggtgcgacgctgtggattgcaccttctgtcgcgaatttctgaagaatcctcagtgctacccggccaaaaagtggctgttcatcattatcgtcattctccttggatatgcgggcctgatgctcctgacaaacgtgctgaaggccgttggggtgtggggctcctgggtcatcgctcccgtgaaactcatgtttgccattatcaagaaactgatgagaagcgtttcttgtcttatgggaaagctgatggaccggggcagacaagtgatccatgaggaaattggggagaatcgcgagggaaaccaggatgacgtccggatcgaaatggctagacctcgccgggtgagacactggatgtactcccccgtgattctcgccatcctggccattggccttgctgaggggtgcgatgaaatggttcatgcggacagcaaactggtctcttgtaagcagggaagcggcaatatgaaggagtgcgtgacgaccgggcgcgccctcctgcctgctgtgaaccccggccaggaggcctgtctgcacttcacagccccgggatcccctgatagcaaatgcctcaagatcaaagtcaagcggattaatctgaaatgtaagaagtcttccagctattttgtgcccgacgctagatcccgctgcacctctgttcggagatgtcgctgggccggcgattgccaaagcgggtgcccttcccatttcacatctaacagcttttccgacgactgggcgggaaaaatggatcgggctggccttgggttctctggatgtagcgacggctgcgggggcgccgcctgtggatgctttaatgctgccccctcctgtatcttctggagaaagtgggtggaaaaccctcacggcatcatttggaaagtcagcccctgcgctgcctgggtgccgtctgcggttatcgagctgaccatgccttccggggaagtgcggacgttccaccccatgagcggcattcccacacaggtctttaagggagtgtctgttacctacctcgggtccgatatggaggtgagcggactgaccgacctgtgtgaaatcgaggagcttaaatctaagaaactcgccctggctccttgcaaccaggccggcatgggcgtcgtggggaaggtgggagaaattcagtgttccagcgaggaatccgctcgcacaatcaagaaagatggctgcatctggaatgccgacctggtcgggattgagctcagagttgatgacgcggtgtgttatagcaagatcacctctgtggaagccgtcgctaactacagcgccattccgacaacgatcggaggcctgcggttcgagagatcccatgattctcaagggaaaattagcggatctccccttgacatcaccgctatccgcggctcctttagcgtgaattatcggggcctgagactctccctgtctgagattacagctacctgcacaggggaagttaccaacgtgagcggatgctactcctgtatgacgggcgccaaggtcagcatcaaactgcactcttccaagaatagcaccgcccatgtgcgctgcaagggggatgagacagcgttctctgttcttgaaggagtgcactcctacaccgtcagcctctcctttgaccacgccgtggttgatgagcagtgtcagctgaactgcggcgggcatgaatctcaggtgacactgaaaggaaatctcattttcctggacgtccctaagtttgtggacggcagctatatgcaaacctaccactccagcgtgcccacgggcgctaacatcccttctcccacagattggcttaatgccctgttcgggaacggactctccagatggattctgggcgtcatcggggttctgcttggaggcctcgccctgtttttcctgatcatgagcctctttaaactggggaccaagcaagtgttccggtctcgcacaaaacttgcttga

SEQ ID NO: 14771 - RNA, 3222 nt, synthetic construct
  misc_feature 1..3222: note = derived and/or modified CDS sequence (opt5) from SFTSV(KAGBH6)__KP663741.1__GP
  source 1..3222: mol_type = other RNA
atgatcaaggtgatttggttcagctccctgatctgcctcgtcattcagtgttctggcgacaccgggcccatcatttgcgccggacctatccacagcaacaaatccgctaatatcccgcatctgcttggctactctgagaagatttgtcaaatcgatagactgattcacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgatcgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggattggggacgttgcctgtcagccgatgacacccatccctgaagagaccttccttgagctgaagtctttttcccagagcgagttccccgatatttgcaaaatcgacggaatcgtgtttaaccagtgtgaatctgaaagcctccctcaacccttcgatgtcgcctggatggacgtgggccactcccataagattatcatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggaggcctctgaagctaaatgtcggtgctccctggtgcataagcctggcgaggtggtcgtgagctatgggggaatgcgcgttagacccaaatgttacggcttttcccggatgatggccacgcttgaagtgaatcctcccgagcagcgcattgggcaatgcaccggatgtcacctggaatgcatcaacggcggggtcagactcattacactgacctctgagcttaagagcgcgacagtgtgtgcctcccatttctgctctagcgctacctccggcaagaaaagcacggagatccagttccactctggatccctcgttggcaagacagccatccacgtgaaaggggctctggtcgacggaaccgaatttacattcgagggcagctgtatgtttcccgatgggtgcgacgccgtggattgcaccttctgtcgggaatttcttaagaatcctcagtgctacccggcgaaaaagtggctgttcattatcattgtcatcctcctgggatatgccggccttatgctgctcaccaacgtgctgaaggctattggggtttggggctcttgggtgatcgcccccgtcaaactgatgtttgctatcattaagaaactcatccgctccgtgagctgtctgatgggaaagctgatggacagaggccggcaagttattcatgaggaaatcggggagaatagagagggaaaccaggatgacgtgcgcattgaaatggcccggcctagacgcgtccggcactggatgtactctcccgtgatcctgacaattctcgccatcggcctggctgaggggtgcgatgaaatggtgcatgcggacagcaaacttgtttcctgtaagcagggaagcggcaatatgaaggagtgcgtcacgaccgggagagccctgctccctgctgtgaaccccggccaggaggcctgtctgcacttcacagccccgggatctcctgattccaaatgcctgaagatcaaagtgaagcgcattaatctcaaatgtaaaaagagctcctcttattttgtccccgacgctcggagcagatgcacctccgtgcgccggtgtagatgggccggcgattgccaatctgggtgccctagccatttcacatccaactcttttagcgacgactgggcgggaaagatggatcgcgctggcctggggttctccggatgtagcgacggctgcgggggcgccgcctgtggatgctttaatgctgccccctcttgtatcttctggcggaagtgggttgaaaaccctcacggcattatctggaaagtgtccccctgcgctgcctgggtcccgagcgcggtgattgagcttaccatgccttctggggaagttagaacgttccaccccatgtccggaatccccacacaggtgtttaagggcgtcagcgtgacctacctggggtctgatatggaggtttccggactcaccgacctgtgtgaaatcgaggagctgaaaagcaagaaacttgccctcgctccttgcaaccaggccggcatgggcgtggtcgggaaggtgggagaaattcagtgttccagcgaggaatctgctcggacaatcaagaaagatggctgcatttggaatgccgacctggtggggatcgagctgcgcgtcgatgacgcggtttgttatagcaagattacctccgtggaagccgtggctaactactctgccatcccgacaacgatcggaggcctcagattcgagcggagccatgattcccaagggaaaatttctggaagccccctggacatcaccgctattagaggctccttttctgtcaattatcgcggccttcggctgagcctctccgagatcagcgccacatgcaccggggaagtgacaaacgtttctggatgctactcctgtatgaccggcgccaaggtgagcattaaactgcactcttccaagaatagcacggctcatgtcagatgcaagggggatgagaccgcgttctccgtgctggaaggagttcactcttacacagtgagcctttcctttgaccacgccgtcgtggatgagcagtgtcagctcaactgcggcgggcatgaaagccaggttaccctgaaaggaaatctgatcttcctcgacgtgcctaagtttgtcgacggctcttatatgcaaacataccactccagcgtgcccaccggcgctaacatcccttctcccacggattggctgaatgcccttttcgggaacggactgagccgctggattctcggcgtgatcggggtcctgctgggaggccttgccctctttttcctgattatgtccctgtttaaactcgggacaaagcaggctttcagatctcggaccaaactggcctga

SEQ ID NO: 14772 - RNA, 3222 nt, synthetic construct
  misc_feature 1..3222: note = derived and/or modified CDS sequence (opt5) from SFTSV(KAGNH)__KU507550.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacgcagaggcgggcggagccaggtgtcctacttccccgccgaaaatagctattctcgctggtccggactgcttagcccttgcgacgcggattggctgggcatgctcgtcgtgaaaaaggctaaaggctctgacatgattgttcccgggccttcctacaagggaaaggtgtttttcgagagacccacatttgatggctatgtcgggtggggatgtggcagcgggaaatctcggacggaatccggagagctgtgcagctccgactctggcaccagctccggcctgctccctagcgatcgcgtgctgtggatcggggacgttgcctgtcaaccgatgacacccattcctgaagagaccttccttgagctgaagtctttttcccagagcgagttccccgatatctgcaaaattgacggaatcgtgtttaaccagtgtgaatctgaaagcctccctcagcccttcgatgtcgcctggatggacgtgggccactcccataagatcattatgagagagcacaaaacaaagtgggtgcaagagtctagctccaaggattttgtctgctacaaagaagggaccggaccgtgtagcgagtctgaagagaagacatgcaaaacctccggcagctgccggggagacatgcagttctgtaaggttgctggatgcgaacacggcgaggaggcctctgaagctaaatgtcgctgctccctggtgcataagcctggcgaggtggtcgtgagctatgggggaatgagagttcggcccaaatgttacggcttttcccgcatgatggccacgcttgaagtgaatcctcccgagcagagaatcgggcagtgcaccggatgtcacctggaatgcattaacggcggggtccggctcatcacactgacctctgagcttaagagcgcgacagtgtgtgcctcccatttctgctctagcgctacctccggcaagaaaagcacggagattcaattccactctggatccctcgttggcaagacagccatccacgtgaaaggggctctggtcgacggaaccgaatttacattcgagggcagctgtatgtttcccgatgggtgcgacgccgtggattgcaccttctgtcgcgaatttcttaagaatcctcagtgctacccggcgaaaaagtggctgttcatcattatcgtcattctcctgggatatgccggccttatgctgctcaccaacgtgctgaaggctatcggggtttggggctcttgggtgattgcccccgtcaaactgatgtttgctatcatcaagaaactcattagatccgtgagctgtctgatgggaaagctgatggaccggggcagacaggttatccatgaggaaattggggagaatcgcgagggaaaccaagatgacgtgcggatcgaaatggccagacctcgccgggtcagacactggatgtactctcccgtgattctgacaatcctcgccattggcctggctgaggggtgcgatgaaatggtgcatgcggacagcaaacttgtttcctgtaagcagggaagcggcaatatgaaggagtgcgtcacgaccgggcgcgccctgctccctgctgtgaaccccggccaggaggcctgtctgcacttcacagccccgggatctcctgattccaaatgcctgaagatcaaagtgaagcggatcaatctcaaatgtaagaagtcctcctcttattttgtccccgacgctagaagccgctgcacctccgtgcggagatgtcgctgggccggcgattgccagtctgggtgccctagccatttcacatccaactcttttagcgacgactgggcgggaaaaatggatcgggctggcctggggttctccggatgtagcgacggctgcgggggcgccgcctgtggatgctttaatgctgccccctcttgtattttctggagaaagtgggttgaaaaccctcacggcatcatttggaaagtgtccccctgcgctgcctgggtcccgagcgcggtgatcgagcttaccatgccttctggggaagttcggacgttccaccccatgtccgggattcccacacaagtgtttaagggcgtcagcgtgacctacctggggtctgatatggaggtttccggactcaccgacctgtgtgaaatcgaggagctgaaaagcaagaaacttgccctcgctccttgcaaccaggccggcatgggcgtggtcgggaaggtgggagaaatccagtgttccagcgaggaatctgctcgcacaattaagaaagatggctgcatctggaatgccgacctggtggggattgagctgagagtcgatgacgcggtttgttatagcaagatcacctccgtggaagccgtggctaactactctgccattccgacaacgatcggaggcctccggttcgagagaagccatgattcccaggggaaaatctctggaagccccctggacattaccgctatccgcggctccttttctgtcaattatcggggccttagactgagcctctccgagattacagctacctgcacaggggaagtgaccaacgttagcggatgctactcttgtatgacgggcgccaagatctccattaaactgcacagctctaagaatagcaccgcccatgtgcgctgcaagggggatgagacagcgttcagcgtcctggaaggagtgcactcctacaccgtttctcttagctttgaccacgccgtggtcgatgagcaatgtcagctcaactgcggcgggcatgaatcccaggtgacactgaaaggaaatctgatcttcctcgacgttcctaagtttgtggacggcagctatatgcagacctaccactcttccgtccccacgggcgctaacatccctagccccacagattggctgaatgcccttttcgggaacggactgtctagatggattctcggcgtgatcggggtgctgctgggaggccttgccctctttttcctgattatgagcctgtttaaactcgggaccaatcaagtcttccggtcccgcacaaagctggcttga

SEQ ID NO: 14773 - RNA, 3222 nt, synthetic construct
  misc_feature 1..3222: note = derived and/or modified CDS sequence (opt5) from SFTSV(KAGNH4)__KU507551.1__GP
  source 1..3222: mol_type = other RNA
atgatgaaggtgatctggttcagctccctgatttgcctcgtcatccagtgttctggcgacaccgggcccattatctgcgccggacctattcacagcaacaagtccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttccttgagctgaagtctttttcccagagcgagttccccgatatctgcaaaattgacggaatcgtgtttaaccagtgtgagtctgaaagcctccctcaacccttcgatgtcgcctggatggacgtgggccactcccataagatcattatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggaggcctctgaagctaaatgtcggtgctccctggtgcataagcctggcgaggtggtcgtgagctatgggggaatgcgcatcagacccaaatgttacggcttttcccggatgatggccacgcttgaagttaatcctcccgagcagcgcattgggcaatgcaccggatgtcacctggaatgcatcaacggcggggtgagactcattacactgacctctgagcttaagagcgcgacagtctgtgcctcccatttctgctctagcgctacctccggcaagaaaagcacggagatccagttccactctggatccctcgtgggcaagacagccatccacgttaaaggggctctggtggacggaaccgaatttacattcgagggcagctgtatgtttcccgatgggtgcgacgccgtcgattgcaccttctgtcgggaatttcttaagaatcctcagtgctacccggcgaaaaagtggctgttcattatcattgtgatcctcctgggatatgccggccttatgctgctcaccaacgtcctgaaggctattggggtgtggggctcttgggttatcgcccccgtgaaactgatgtttgctatcattaagaaactcatgcgctccgtcagctgtctgatgggaaagctgatggacagaggccggcaagtgatccatgaggaaattggggagaatagagagggaaaccaggatgacgttcgcatcgaaatggcccggcctagacgcgtgcggcactggatgtactctcccgtcattctgacaatcctcgccattggcctggctgggggatgcgatgagatggtgcatgcggacagcaaacttgtgtcctgtagacagggcagcgggaatatgaaggaatgcgttacgaccggccgcgccctgctccctgctgtcaaccccggacaggaggcctgtctgcacttcacagccccgggctctcctgattccaagtgcctgaaaatccgggtgaagagaatcaatctcaaatgtaagaaaagctcctcttattttgtgcccgacgctcgcagccggtgcacctccgtcagacgctgtcggtgggccggggattgccaatctggatgccctagccatttcacatccaactcttttagcgacgactgggcgggcaagatggatagagctgggctgggattctccggctgtagcgacgggtgcggcggagccgcctgtggctgctttaatgctgccccctcttgtattttctggcggaagtgggtggagaaccctcacgggatcatttggaaagtttccccctgcgctgcctgggtgccgagcgcggtcatcgaacttaccatgccttctggagaggtgcgcacgttccaccccatgtccggcattcccacacaggtttttaagggggtgagcgtcacctacctgggatctgatatggaagtgtccggcctcaccgacctgtgtgagatcgaagaactgaaaagcagaaaacttgccctcgctccttgcaaccaggccggcatgggggttgtgggaaaggtcggcgagatccagtgttccagcgaagagtctgctcggacaattaagaaagatgggtgcatctggaatgccgacctggtgggaattgaactgagagtggatgacgcggtctgttatagcaagatcacctccgttgaggccgtggctaactactctgccattccgacaacgatcggcgggctccgcttcgaacggagccatgattcccaaggaaagatctctggcagccccctggacattaccgctatcagaggctccttttctgtgaattatcgcgggcttagactgagcctctccgagattacagctacctgcacaggagaggtcaccaacgtgagcggctgctactcttgtatgacgggggccaaagtttccatcaagctgcacagctctaaaaattccaccgcccatgtgcggtgcaagggagatgaaacagcgttcagcgtcctggagggcgtgcactcctacaccgtttctcttagctttgaccacgccgtggtcgatgaacagtgtcagctcaactgcgggggacatgagtcccaggtgacactgaaaggcaatctgattttcctcgacgttcctaagtttgtggacggcagctatatgcaaacctaccactcttccgtccccacgggggctaacatccctagccccacagattggctgaatgcccttttcggaaacggcctgtctcgctggatcctcggggtgattggagtgctgctgggcgggcttgccctctttctgctgatcatgagcctcttcaagctgggaaccaaacaggtctttagatcccggacaaaacttgcttga

SEQ ID NO: 14774 - RNA, 3222 nt, synthetic construct
  misc_feature 1..3222: note = derived and/or modified CDS sequence (opt5) from SFTSV(KAGWH2)__KU507564.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgggatcccgcatctgcttggatactccgagaagatctgtcaaattgatagactgatccacgtttctagctggctccggaatcattcccagtttcagggctatgtggggcagcgcggaggcagatctcaagtgagctactatcccgccgaaaactcctacagccggtggtctggcctgctttccccttgcgacgcggattggctggggatgctcgtcgtgaaaaaggctaaaggaagcgacatgattgttcccggcccttcttataaggggaaggtgttctttgagcgccccacattcgatggatacgtcggctgggggtgtggatccggcaaaagcagaacggaatctggcgagctgtgctccagcgactccgggacctctagcggactgctcccttccgatcgggtgctgtggatcggcgacgttgcctgtcagccgatgacacccattcctgaagagacctttcttgagcttaagagcttctctcagtccgaatttcccgatgtgtgcaaaatcgacgggattgtcttcaatcagtgtgagggagaaagcctccctcaaccctttgatgtggcctggatggacgtgggccactctcataagatcatcatgcgcgagcacaaaacaaagtgggtccaggagagctcctctaaggatttcgtttgctataaagaagggaccggaccgtgtagcgagtccgaagagaagacatgcaaaaccagcggctcttgcagaggcgacatgcagttttgtaaggtggctgggtgcgaacacggagaggaggcctccgaagctaaatgtcggtgcagcctggtgcataagcctggcgaggtcgtggtttcttacgggggaatgcgcgtgagacccaaatgttacggcttctcccggatgatggccacgcttgaagtcaaccctcccgagcagcgcattgggcaatgcaccggctgtcacctggaatgcatcaatggaggcgtgagactcattacactgaccagcgagctgaagtccgcgacagtttgtgcctctcatttttgcagctccgctacctctgggaagaaaagcacggagatccagttccactccggaagcctcgtgggcaagacagccattcacgtcaaaggggctctggtggacggaaccgagttcacatttgaaggctcttgtatgttccccgatgggtgcgacgccgtcgattgcaccttttgtcgggagttccttaagaaccctcagtgctatccggcgaaaaagtggctgtttatcatcattgtgatcctcctgggctacgccggacttatgctgctcaccaatgttctgaaggctattggcgtgtgggggtcctgggtcatcgcccccgtgaaactggttttcgctattatcaagaaactcatgcgcgccgtgagctgtctgatgggaaagctgatggacagaggccggcaagtcatccatgaagaaattggggagaacagagagggaaatcaggatgacgtgcgcatcgaaatggcccggcctagacgcgtgcggcactggatgtattctcccgttattctgacaatcctcgctattggcctggcggaggggtgcgatgaaatggtccatgccgactccaaacttgtgagctgtagacagggctctggaaacatgaaggagtgcgtgacgaccggccgcgctctgctccctgccgtcaatcccgggcaggaggcctgtctgcactttacagctccgggaagccctgattccaagtgcctgaaaatcaaggtgaaacggattaacctcaagtgtaaaaagagcagctcctacttcgttcccgacgccagaagccgctgcacctccgtgcggagatgtcgctgggcgggcgattgccaatctgggtgccctccccattttacaagcaattccttctctgacgactgggctggaaagatggatcgggccggcctggggtttagcggctgttccgacggatgcggcggggccgcttgtggatgcttcaacgccgctccttcttgtatcttttggagaaaatgggtcgaaaatccccacggcatcatttggaaggtgagcccgtgcgccgcgtgggttccttccgccgtgatcgagcttaccatgcccagcggggaagtccggacgttccaccccatgtctggcattcctacacaggtgttcaaaggagtttccgtgacctatctgggcagcgatatggaggtctctgggctcaccgacctgtgtgaaatcgaggagctgaagtccaaaaagctcgctcttgccccgtgcaaccaggctggaatgggcgtggtggggaaagtcggagaaattcagtgtagctctgaggaatccgcccgcacaatcaagaaggatggctgcatctggaacgcggacctggttgggattgagctgagagtggatgacgccgtgtgttacagcaaaatcacctccgtcgaagctgtggccaattatagcgctattcccacaacgatcggaggcctccggtttgagagatctcatgatagccaaggcaagatttccgggtctcctctggacatcaccgccatccgcggatctttctccgttaactaccggggccttagactgtctctcagcgagattacagctacctgcacaggggaagtgaccaatgtctccggatgctactcttgtatgacgggcgccaaagtgagcatcaagctgcactccagcaaaaactctaccgcgcatgttcgctgcaagggggatgagacagccttttccgtgctggaaggagtccacagctattctgtgtcccttagcttcgaccacgctgttgtggatgagcagtgtcagctcaattgcggcggccatgaatcccaggtcaccctgagagggaacctgatttttctcgacgtgcccaagttcgtggacggatcttacatgcaaacatatcacagcaccgtccctacgggcgccaatatcccctcccctacagattggctgaacgccctttttgggaatggactgagccggtggattctcggcgttatcggggtgctgctgggaggccttgctctcttctttctgatcatgtctctgttcaaactcggcaccaaacaggtgtttcgctccagaacaaagctggcctga

SEQ ID NO: 14775 - RNA, 3222 nt, synthetic construct
  misc_feature 1..3222: note = derived and/or modified CDS sequence (opt5) from SFTSV(KAGWH3)__KP663735.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcattgtcaaaaaggctaaaggctctgacatgatcgtgcccgggccttcctacaagggaaaggttttcttcgagcgccccacatttgatggctatgtggggtggggatgtggcagcgggaaatctagaacggaatccggagagctgtgcagctccgactctggcaccagctccggcctgctccctagcgatcgggtcctgtggattggggacgtggcctgtcagccgatgacacccatccctgaagagaccttccttgagctgaagtctttttcccagagcgaatttcccgatatttgcaaaatcgacggaatcgtttttaaccagtgtgagtctgaaagcctccctcaacccttcgatgtggcctggatggacgtcggccactcccataagattatcatgcgcgagcacaaaacaaagtgggtgcaggagtctagctccaaggattttgtgtgctacaaagaagggaccggaccgtgtagcgagtctgaagagaagacatgcaaaacctccggcagctgcagaggggacatgcagttctgtaaggtcgctggatgcgaacacggcgaggaggcctctgaagctaaatgtcggtgctccctggttcataagcctggcgaggtggtggtcagctatgggggaatgcgcgtgagacccaaatgttacggcttttcccggatgatggccacgcttgaagttaatcctcccgagcagcgcattgggcaatgcaccggatgtcacctggaatgcatcaacggcggggtgagactcattacactgacctctgagcttaagagcgcgacagtctgtgcctcccatttctgctctagcgctacctccggcaagaaaagcacggagatccagttccactctggatccctcgtgggcaagacagccatccacgttaaaggggctctggtggacggaaccgaatttacattcgagggcagctgtatgtttcccgatgggtgcgacgccgtcgattgcaccttctgtcgggaatttcttaagaatcctcagtgctacccggcgaaaaagtggctgttcattatcattgtgatcctcctgggatatgccggccttatgctgctcaccaacgtcctgaaggctattggggtgtggggctcttgggttatcgcccccgtgaaactgatgtttgctatcattaagaaactcatgcgctccgtcagctgtctgatgggaaagctgatggacagaggccggcaagtgatccatgaggaaattggggaggttagagagggaaatcaggatgacgtgcgcatcgaaatggcccggcctagacgcgtccggcactggatgtactctcccgtgattctgacaatcctcgccattggcctggctgaggggtgcgatgaaatggtgcatgcggacagcaaacttgtttcctgtaagcagggaagcggcaacatgaaggagtgcgtcacgaccgggagagccctgctccctgctgtgaatcccggccaggaggcctgtctgcacttcacagccccgggatctcctgattccaaatgcctgaagatcaaagtgaagcgcatcaacctcaaatgtaaaaagagctcctcttattttgtccccgacgctcggagcagatgcacctccgtgcgccggtgtagatgggccggcgattgccaatctgggtgccctagccatttcacatccaattcttttagcgacgactgggcgggaaagatggatcgcgctggcctggggttctccggatgtagcgacggctgcgggggcgccgcctgtggatgctttaacgctgccccctcttgtattttctggcggaagtgggttgaaaatcctcacggcatcatttggaaagtgtccccctgcgctgcctgggtcccgagcgcggtgatcgagcttaccatgccttctggggaagttagaacgttccaccccatgtccggcattcccacacaggtgtttaagggagtcagcgtgacctacctggggtctgatatggaggtttccggactcaccgacctgtgtgaaatcgaggagctgaaaagcaagaaacttgccctcgctccttgcaaccaggccggcatgggcgtggtcgggaaggtgggagaaatccagtgttccagcgaggaatctgctcggacaattaagaaagatggctgcatctggaacgccgacctggtggggattgagctgcgcgtcgatgacgcggtttgttatagcaagatcacctccgtggaagccgtggctaattactctgccattccgacaacgatcggaggcctcagattcgagcggagccatgattcccaagggaaaatctctggaagccccctggacattaccgctatcagaggctccttttctgtcaactatcgcggccttcggctgagcctctccgagattacagctacctgcacaggggaagtgaccaatgttagcggatgctactcttgtatgacgggcgccaaggtgtccatcaaactgcacagctctaagaactccaccgcccatgtcagatgcaagggggatgagacagcgttcagcgtgctggaaggagttcactcctacaccgtgtctcttagctttgaccacgccgtcgtggatgagcagtgtcagctcaattgcggcgggcatgaatcccaggttacactgaaaggaaacctgattttcctcgacgtgcctaagtttgtcgacggcagctatatgcaaacctaccactcttccgtgcccacgggcgctaatatccctagccccacagattggctgaacgcccttttcgggaatggactgtctcgctggatcctcggcgtgattggggtcctgctgggaggccttgccctctttttcctgatcatgagcctgtttagactcgggaccaaacaggttttccggtcccgcacaaagctggcttga

SEQ ID NO: 14776 - RNA, 3222 nt, synthetic construct
  misc_feature 1..3222: note = derived and/or modified CDS sequence (opt5) from SFTSV(KAICH)__KU507565.1__GP
  source 1..3222: mol_type = other RNA
atgatgaaggtgatctggttcagctccctgatttgcctcgtcatccagtgtggcggggacacctctcccattatctgcgccggacctattcacagcaacaaatccgctgatatcccgcatctgcttggctactctgagaagatctgtcaaattgacagactgatccacgttagctcctggctccggaatcattctcagtttcaggggtatgtgggacagcgcggcgggagaagccaagtgtcctactatcccgccgaaaacagctactctcggtggtccggactgcttagcccttgcgatgcggactggctgggcatgctcgtcgtgaaaaaggctaaaggctctgatatgattgttcccgggccttcctataagggaaaggtgttctttgagcgccccacattcgacggctacgtcgggtggggatgtggcagcgggaaatctagaacggaatccggagagctgtgcagctccgattctggcaccagctccggcctgctccctagcgaccgggtgctgtggatcggggatgttgcctgtcagccgatgacacccattcctgaagagacctttcttgagctgaagtctttctcccagagcgaatttcccgacatctgcaaaattgatggaatcgtgttcaatcagtgtgagggcgaatctctccctcaaccctttgacgtcgcctggatggatgtggggcacagccataagatcattatgcgcgagcacaaaacaaagtgggtgcaggagtcctctagcaaggacttcgtctgctataaagaaggaaccggcccgtgttccgagagcgaagagaagacatgcaaaacctctgggtcctgcagaggagacatgcagttttgtaaggttgctggctgcgaacacggcgaggaggccagcgaagctaaatgtcggtgctctctggtgcataagcctggggaggtggtcgtgtcctacggaggcatgcgcgttagacccaaatgttacgggttcagccggatgatggccacgcttgaagtgaaccagcctgagcaacgcatcggacagtgcaccggctgtcacctggaatgcatttccgggggcgtcagactcatcacactgacctctgagcttaagagcgcgacagtgtgtgcctcccatttttgctctagcgctacctccggaaagaaaagcacggagattcagttccactctggctccctcgttgggaagacagccatccacgtgaaaggagctctggtcgatggcaccgagttcacatttgaagggagctgtatgttccccgacggatgcgatgccgtggactgcaccttttgtcgggagttccttaagaatccccaatgctatcctgcgaaaaagtggctgtttatcattatcgtcattctcctgggctacgccgggcttatgctgctcaccaacgtgctgaaggctatcggcgtttggggatcttgggtgattgccccggtcaaactggtgttcgctatcatcaagaaactcatgcgcgccgtttcctgtctgatgggcaagctgatggatagagggagacaggtgattcatgaagaaatcggagagaatcgggagggcaaccaggacgatgtccgcattgaaatggcccggcccagacgcgtgcggcactggatgtatagccctgtgatcctgacaattctcgctatcgggctggcggagggatgcgacgaaatggttcatgccgattctaaacttgtcagctgtagacagggctccgggaatatgaaggagtgcgtgacgaccggccgcgctctgctccccgccgtgaaccctggacaagaggcctgtctgcactttacagctcccggcagcccggactctaagtgcctgaaaattaaggtcaaacggatcaatctcaagtgtaaaaagtccagctcctacttcgtgcctgatgccagatctcgctgcaccagcgttcggagatgtcgctgggcgggggactgccagtccggatgtccccctcattttacatctaacagcttctccgacgattgggctggcaagatggaccgggccgggctgggattttctggctgcagcgatgggtgcggcggagccgcttgtggctgcttcaatgccgctccctcctgtatcttttggagaaaatgggtggaaaaccctcacgggattatctggaaggtcagcccctgcgccgcgtgggtgccgtctgccgttattgagcttaccatgccttccggagaagtgcggacgttccaccccatgagcggcatccccacacaggtcttcaaaggggtgtctgttacctatctgggatccgacatggaggtgagcggcctcaccgatctgtgtgaaatggaggagctgaagtctaaaaagctcgctcttgccccttgcaatcaggctggcatgggggtcgtgggaaaagtgggcgaaattcaatgttccagcgaggaatccgcccgcacaatcaagaaggacgggtgcatctggaacgcggatctggtcggaattgagctgagagttgacgatgccgtgtgttacagcaaaatcacctctgtggaagctgtcacaaactatagcgccattccgacgaccatcggcgggctccggtttgagagatcccatgactctcagggaaagattagcggctctcccctggatatcacagctatccgcggctccttcagcgtgaattaccgggggcttagactgtccctctctgagattaccgccacatgcaccggagaagttacgaacgtgagcggctgctactcctgtatgaccggggccaaagtcagcatcaagctgcactcttccaaaaatagcacagctcatgtgcgctgcaagggagacgagaccgcgttttctgttctggaaggcgtgcactcctatagcgtctccctttctttcgatcacgccgtggttgacgagcagtgtcagctcaactgcgggggacatgaaagcaaggtgacactgagaggcaatctgatttttctcgacgtccctaaattcgtggatggctcctacatgcaaacctatcacagcacggtgcccacaggggctaacatcccttctcccaccgactggctgaatgccctttttggaaacggcctgtcccggtggttcctcggggtcattggagttctgctgggcgggcttgccctctttttcctgatcatgagcctgtttaagctcggaacaaaacaggtgttccgctctagaagcaagctggcttga

SEQ ID NO: 14777 - RNA, 3222 nt, synthetic construct
  misc_feature 1..3222: note = derived and/or modified CDS sequence (opt5) from SFTSV(KAJJH)__KU507566.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcaaccgggtgctgtggatcggggatgttgcctgtcagccgatgacacccattcctgaagagacctttcttgagctgaagtctttctcccagagcgaatttcccgacatctgcaaaattgatggaatcgtgttcaatcagtgtgagtctgaaagcctccctcaaccctttgacgtcgcctggatggatgtgggccactcccataagatcattatgcgcgagcacaaaacaaagtgggtgcaggagtctagctccaaggacttcgtctgctataaagaagggaccggaccgtgtagcgagtctgaagagagaacatgcaagacctccggcagctgccgcggggatatgcagttttgtaaagttgctggatgcgaacacggcgaggaggcctctgaagctaagtgtcggtgctccctggtgcataaacctggcgaggtggtcgtgagctacgggggaatgagagttcggcccaagtgttacggcttctcccgcatgatggccacgcttgaagtgaaccctcccgagcagagaatcgggcaatgcaccggatgtcacattgaatgcatcaatggcggggtccggctgattacactcacctctgagctgaaaagcgcgacagtgtgtgcctcccatttttgctctagcgctacctccggcaaaaagagcacggagatccagttccactctggatccctggttggcaaggccgctatccacgtgaagggggccctcgtcgacggaacagaatttacctttgagggcagctgtatgttccccgacgggtgcgatgcggtggactgcacattttgtcgcgagttcctgaaaaaccctcagtgctatccggccaagaaatggctttttattatcattgtcatcctgctcggatacgctggcctgatgcttctgaccaatgtgctcaaggccattggggtttggggctcttgggtgatcgctcccgtcaagctgatgttcgccatcattaaaaagctgatgagatccgtgagctgtctcatgggaaaactgatggatcggggcagacaagttatccatgaagaaattggggagaaccgcgagggaaatcaggacgatgtgcggatcgaaatggccagacctcgccgggtcagacactggatgtattctcccgtgattcttaccatcctggctattggcctcgcggaggggtgcgacgaaatggtgcatgccgatagcaagctggtttcctgtcgccagggaggcgggaacatgaaagagtgcgtcacaacgggccgggcccttctgcctgctgtgaatcccggacaggaggcctgtctccactttaccgctccgggcagccctgactctaagtgcctgaagatcaaagtgaagagaatcaacctgaaatgtaagaaatccagctcctacttcgtccccgatgcccgctctcggtgcacaagcgtgagacgctgtcggtgggcgggggactgccaatccggatgcccttctcattttaccagcaattccttctctgatgactgggctggcaagatggacagagccgggctcggatttagcggctgttccgatgggtgcggcggagccgcttgtggctgcttcaacgccgctcccagctgtattttctggcggaagtgggttgaaaaccctcacgggatcatttggaaagtgtctccctgcgccgcgtgggtcccgtccgccgtgatcgagctgacaatgcctagcggagaagttcgcaccttccaccccatgtctggcattcccacacaggtgttcaagggggtctccgtgacgtatcttggaagcgacatggaggtttctggcctgaccgatctctgtgaaatcgaggagctgaaatccaagaaactggctcttgccccttgcaatcaggctggcatgggggtggtcggaaaggtgggcgaaatccagtgtagctccgaggaaagcgccagaaccattaaaaaggacgggtgcatctggaacgcggatctcgtgggaattgagctgcgggtcgacgatgccgtttgttactctaagatcacaagcgtggaagctgtggccaattattccgctattccgaccacaatcggcgggctgagatttgagcgctctcatgacagccaaggaaaaatctccggctctcccctcgatattacggccatccggggcagcttctccgtcaactacagagggctgcgcctttctctgagcgagattaccgccacatgcaccggagaagtgacaaatgtttccggctgctacagctgtatgaccggggctaaggtgtctatcaaactccactccagcaagaactctacggcgcatgtcagatgcaaaggagacgagaccgccttttccgtgctggaaggcgttcacagctatacagtgtccctgtctttcgatcacgctgtcgtggacgagcagtgtcagcttaattgcgggggacatgaaagccaggttaccctcaagggcaacctgatttttctggatgtgcctaagttcgtcgacggctcctacatgcaaacatatcacagctctgtgcccaccggggccaatatcccttcccccacggactggctcaacgccctgtttggaaatggccttagccggtggatcctgggggtgattggagtcctcctgggcgggctggctcttttctttctcatcatgtctctgttcaaactgggaacaaagcaggtttttcgcagcagaaccaaactcgcctga

SEQ ID NO: 14778 - RNA, 3222 nt, synthetic construct
  misc_feature 1..3222: note = derived and/or modified CDS sequence (opt5) from SFTSV(KAJNH2)__KU507552.1__GP
  source 1..3222: mol_type = other RNA
atgatgaaggtgatctggttcagctccctgatttgcctcgtcatccagtgttctggcgacaccgggcccattatctgcgccggacctattcacagcaacaagtccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcctgaaaaaggctaaagagtctgacatgattgtgcccggcccttcctataaggggaaggttttctttgaacgccccacattcgatggatacgtgggctgggggtgtggaagcggcaaatctagaacggagtccggggaactgtgcagctccgactctggaaccagctccggcctcctgcctagcgatcgggtcctttggatcggcgacgtggcctgtcagccgatgacacccattcctgaggagacctttctggaactcaagtctttctcccagagcgagtttcccgatatctgcaaaattgacgggatcgttttcaaccagtgtgaatctgagagcctgcctcaaccctttgatgtggcctggatggacgtcggacactcccataagatcattatgcgcgagcacaaaacaaagtgggtgcaggaatctagctccaaggatttcgtgtgctataaagagggcaccgggccgtgtagcgaatctgaggaaaagacatgcaaaacctccggaagctgcagaggcgacatgcagttttgtaaggtcgctgggtgcgagcacggagaggaagcctctgaggctaaatgtcggtgctcccttgttcataagcctggcgaagtggtggtcagctacggcgggatgcgcgtgagacccaaatgttacggattctcccggatgatggccacgctggaggttaatcctcccgaacagcgcatcggccaatgcaccgggtgtcacctcgagtgcattaacggaggcgtgagactgatcacactgacctctgagctcaagagcgcgacagtctgtgcctcccatttttgctctagcgctacctccgggaagaaaagcacggaaattcagttccactctggctccctggtgggaaaggccgctatccacgttaaaggcgcccttgtggacgggacagagttcacctttgaaggaagctgtatgttccccgatggctgcgacgcggtcgattgcacattttgtcgggagttcctgaagaatcctcagtgctatccggccaaaaagtggctctttatcattatcgtgattctgcttgggtacgctggactgatgctcctgaccaacgtcctgaaggccatcggcgtgtgggggtcttgggttattgctcccgtgaaactcatgttcgccatcatcaagaaactgatgcgctccgtcagctgtcttatgggcaagctgatggacagaggacggcaagtgattcatgaagagatcggcgagaatagagaagggaaccgcgatgacgttcggattgagatggccagacctcgccgggtgagacactggatgtattctcccgtcatcctcaccattctggctatcggacttgcggaaggctgcgatgagatggtgcatgccgacagcaaactggtgtcctgtcgccaggggagcggaaatatgaaggagtgcgttacaacgggccgggctctcctgcctgccgtcaaccccgggcaggaagcctgtctgcactttaccgctccgggctctcctgattccaagtgcctcaaaattaaggtgaaaagaatcaatctgaagtgtaaaaagagctcctcttacttcgtgcccgacgcccgcagccggtgcacatccgtcagacgctgtcggtgggcgggagattgccagtctggctgccctagccattttacctccaactctttcagcgacgactgggctgggaagatggatagagccggacttggcttttccgggtgtagcgacggatgcggcggggccgcttgtggctgcttcaatgccgctccctcttgtatcttttggcggaaatgggtggagaaccctcacggaattatctggaaggtttccccctgcgccgcgtgggtgccgagcgccgtcattgaactgacaatgccttctggcgaggtgcgcaccttccaccccatgtccgggatccccacgcaagttttcaaaggagtgagcgtcacatatctcggctctgatatggaagtgtccgggctgaccgacctgtgtgagattgaggaacttaagagcaaaaagctcgctctggccccttgcaaccaggctggaatgggcgttgtgggcaaagtcggggagatccagtgttccagcgaagagtctgccagaaccatcaagaaggatggatgcatttggaatgcggacctggtgggcatcgaactccgggtggatgacgccgtctgttacagcaaaattacatccgttgaggctgtggccaactattctgctatcccgaccacaattgggggactgagatttgagcgcagccatgattcccagggcaagatctctgggagcccccttgacatcacggccattcggggatccttctctgtgaattacagaggcctgcgcctcagcctgtccgaaatcaccgccacatgcaccggcgaggtcacaaacgtgagcgggtgctactcttgtatgaccggagctaaagtttccattaagctgcacagctctaaaaattccacggcgcatgtgagatgcaagggcgatgaaaccgcctttagcgtccttgagggggtgcactcctatacagtttctctcagcttcgaccacgctgtggtcgatgaacaatgtcagctgaactgcggaggccatgagtcccaggtgaccctgaaggggaatctcatctttctggacgttcctaaattcgtggacggaagctacatgcagacatatcactcttccgtccccaccggcgccaacattcctagccccacggattggcttaatgccctgtttggcaacgggctctctcggtggatcctgggagtgatcggcgtgctgcttgggggactcgctctgttctttctgattatgagcctcttcaagctgggcacaaaacaagtctttcgctccagagccaaacttgcgtga

SEQ ID NO: 14779 - RNA, 3222 nt, synthetic construct
  misc_feature 1..3222: note = derived and/or modified CDS sequence (opt5) from SFTSV(ZL13-32)__KU361342.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgcgcaccgtctcctgtctcatgggcaagctgatggatagagggagacaggtgattcatgaggaaatcggagagaaccgggagggcaatcaggacgatgttcgcattgaaatggcccggcccagacgcgtgcggcactggatgtatagccctgtcatccttacaattctggccatcgggctcgctgagtcttgcgacgaaatggtgcatgcggatagcaaactggtgtcctgtagacagggaagcggcaacatgaaggagtgcgttacgaccgggcgcgcccttctgcccgctgtcaatcctggccaagaggcctgtctccacttcacagcccccggatctccggactccaagtgcctgaaaatcaaggtgaaacggattaacctgaagtgtaaaaagagctcctcttactttgtgcctgatgctagaagccgctgcacctccgtccggagatgtcgctgggccggcgactgccagtctgggtgtccccctcatttcacaagcaattccttttctgacgattgggcgggaaagatggaccgggctggcctcgggttcagcggatgctccgatggctgcgggggcgccgcctgtggatgctttaacgctgcccccagctgtatcttctggagaaaatgggtggaaaatcctcacggcattatctggaaggtttctccctgcgctgcctgggtgccgtccgcggtcattgagctgaccatgcctagcggggaagtgcggacgttccaccccatgtctggaatccccacacaggtttttaaaggcgtgtccgtcacctatcttgggagcgacatggaggtgtctggactgaccgatctctgtgaaatcgaggagctgaagtccaaaaagctggcccttgctccttgcaaccaggccggcatgggcgttgtggggaaagtcggagaaattcaatgtagctccgaggaaagcgctcgcacaatcaagaaggacggctgcatttggaacgccgatctcgtggggatcgagctgagagtggacgatgcggtctgttactctaaaattaccagcgttgaagccgtggctaattattccgccatcccgacaacgatcggaggcctgcggttcgagagatctcatgacagccaggggaagatttccggatctcccctcgatatcaccgctattcgcggcagcttttccgtgaactaccggggcctgagactttctctgagcgagatcacagctacctgcacaggggaagtcaccaatgtgtccggatgctacagctgtatgacgggcgccaaagtttctattaagctccactccagcaaaaactctaccgcccatgtgcgctgcaagggggacgagacagcgttctccgtcctggaaggagtgcacagctataccgtttccctgtcttttgatcacgccgtggtcgacgagcagtgtcagcttaattgcggcgggcatgaaagccaagtgacactcaagggaaacctgatcttcctggacgttcctaaatttgtggatggctcctacatgcagacctatcacagcacggtccccacaggcgctaatatcccttctcccaccgactggctcaacgccctgttcgggaatggactttccagatggattctgggcgtgatcggggtgctcctgggaggcctggccctgtttttcatgattatgagcctctttaagctggggacaaaacaggtcttccggtctcgcaccaagctggcttga

SEQ ID NO: 14780 - RNA, 3222 nt, synthetic construct
  misc_feature 1..3222: note = derived and/or modified CDS sequence (opt5) from SFTSV(AHL/China/2011)__JQ670930.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctgatatcccgcatctgcttggctactctgagaagatctgtcaaattgacagactgatccacgttagctcctggctccggaatcattctcagtttcaggggtatgtgggacagcgcggcgggagaagccaagtgtcctactatcccgccgaaaacagctactctcggtggtccggactgcttagcccttgcgatgcggactggctgggcatgctcgtcgtgaaaaaggctaaaggctctgatatgattgttcccgggccttcctataagggaaaggtgttctttgagcgccccacattcgacggctacgtcgggtggggatgtggcagcgggaaatctagaacggaatccggagagctgtgcagctccgattctggcaccagctccggcctgctccctagcgaccgggtgctgtggatcggggatgttgcctgtcagccgatgacacccattcctgaagagacctttcttgagctgaagtctttctcccagagcgaatttcccgacatctgcaaaattgatggaatcgtgttcaatcagtgtgagggcgaatctctccctcaaccctttgacgtcgcctggatggatgtggggcacagccataagatcattatgcgcgagcacaaaacaaagtgggtgcaggagtcctctagcaaggacttcgtctgctataaagaaggaaccggcccgtgttccgagagcgaagagaagacatgcaaaacctctgggtcctgcagaggagacatgcagttttgtaaggttgctggctgcgaacacggcgaggaggccagcgaagctaaatgtcggtgctctctggtgcataagcctggggaggtggtcgtgtcctacggaggcatgcgcatcagacccaaatgttacgggttcagccggatgatggccacgcttgaagttaaccctcccgagcagcgcattggacaatgcaccggctgtcacctggaatgcatcaatgggggcgtgagactcattacactgacctccgagctgaagtctgcgacagtctgtgccagccatttttgctcctctgctaccagcggaaagaaaaacacggagatccagttccactccggcagcctcgtggggaagacagccatccacgttaaaggagctctggtggatggcaccgacttcacatttgaagggtcttgtatgttccccgatggatgcgacgccgtcgattgcaccttttgtcgggagttccttaagaatcctcagtgctatccggcgaaaaagtggctgtttattatcattgtgatcctcctgggctacgccgggcttatgctgctcaccaacgtcctgaaggctattggcgtgtggggatcctgggttatcgcccccgtgaaactgatgttcgctatcatgaagaaactcatgcgcagcgtctcttgtctgatgggcaagctgatggacagagggcggcaagtgattcatgaagagatcggagaaaatagagagggcaaccaggatgacgttcgcattgagatggcccggcctagacgcgtgcggcactggatgtattcccccgtcatcctgacaattctcgccacggggctggctgaaggatgcgatgagatggtgcatgcggacagcaaacttgtgtcttgtagacagggcagcgggaatatgaaggaatgcgttaccacaggccgcgccctgctccctgctgtcaaccccggacaggaggcctgtctgcactttaccgccccgggctcccctgatagcaagtgcctgaaaatcaaggtgaaacggattaatctcaagtgtaaaaagtcttccagctacttcgtgcccgacgctagatcccgctgcacatctgtccggagatgtcgctgggccggggactgccaaagcggatgccctccccattttacctccaactctttcagcgatgactgggcgggcaagatggatcgggctgggctgggattttccggctgttctgacgggtgcggcggagccgcctgtggctgcttcaatgctgcccctagctgtatcttttggagaaaatgggtggagaacccccacgggatcatttggaaggtttccccgtgcgctgcctgggtgcctagcgcggtcatcgaacttacgatgccctctggagaggtgcggacattccaccccatgtccggcattcctacccaggttttcaaaggggtgagcgtcacctatctgggatctgatatggaagtgtccggcctcacagacctgtgtgagatcgaggaacttaagagcaaaaagctcgcccttgctccgtgcaaccaggccggcatgggggttgtgggaaaagtcggcgagattcagtgttcttccgaagagagcgctcgcaccatcaagaaggatgggtgcatctggaatgccgacctggtgggaattgaactgagagtggatgacgcggtctgttactccaaaatcacaagcgttgaggccgtggctaactattctgccattcccacgaccatcggcgggctccggtttgaaagaagccatgattcccaaggaaagatttctggcagccctctggacatcacagctatccgcggctccttctctgtgaattaccgggggcttagactgagcctctccgagattaccgccacatgcaccggagaggtcacgaacgtgtctggctgctacagctgtatgaccggggccaaagtttccgtgaagctgcacagctctaaaaattccacagctcatgtccgctgcaagggagatgaaaccgcgtttagcgtgctggagggcgttcactcttatacagtgtcccttagcttcgaccacgccgtcgtggacgaacagtgtcagctcaactgcgggggacatgagtcccaggttaccctgaagggcaatctgatctttctcgatgtgcccaaattcgtcgacggctcttacatgcaaacgtatcacagcacagtgcctaccggggctaacattccctcccctacagattggctgaatgccctttttggaaacggcctgagcagatggatcctcggggtgattggagtcctgctgggcgggcttgccctcttctttctgatcatgtctctgttcaagctcggaaccaaacaggtttttcggtcccgcaccaagctggcttga

SEQ ID NO: 14781 - RNA, 3222 nt, synthetic construct
  misc_feature 1..3222: note = derived and/or modified CDS sequence (opt5) from SFTSV(AH-YTY/China/05/2012)__KR017849.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgaatttcccgacatctgcaaaattgatggaatcgtgtttaatcagtgtgagggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgcgcgccgtctcctgtctcatgggcaagctgatggatagagggagacaggtgattcatgaggaaatcggagagaaccgggagggcaatcaggacgatgttcgcattgaaatggcccggcccagacgcgtgcggcactggatgtatagccctgtcatccttaccattctggctatcgggctcgcggagtcttgcgacgaaatggtgcatgccgatagcaaactggtgtcctgtagacagggaagcggcaacatgaaggagtgcgttacaacggggcgcgctctgctgcccgccgtcaatcctggccaagaggcctgtctccacttcaccgctcccggatctccggactccaagtgcctgaaaatcaaggtgaaacggattaacctgaagtgtaaaaagagctcctcttactttgtgcctgatgccagaagccgctgcacatccgtccggagatgtcgctgggcgggcgactgccagtctgggtgtccccctcatttcaccagcaattccttttctgacgattgggctggaaagatggaccgggccggcctcgggttcagcggatgctccgatggctgcgggggcgccgcttgtggatgctttaacgccgctcccagctgtatcttctggagaaaatgggtggaaaatcctcacggcattatctggaaggtttctccctgcgccgcgtgggtgccgtccgccgtcattgagctgacaatgcctagcggggaagtgcggaccttccaccccatgtctggaatccccacgcaggtttttaaaggcgtgtccgtcacatatcttgggagcgacatggaggtgtctggactgaccgatctctgtgaaatcgaggagctgaagtccaaaaagctggctcttgccccttgcaaccaggctggcatgggcgttgtggggaaagtcggagaaattcaatgtagctccgaggaaagcgcccgcaccatcaagaaggacggctgcatttggaacgcggatctcgtggggatcgagctgagagtggacgatgccgtctgttactctaaaattacaagcgttgaagctgtggccaattattccgctatcccgaccacaatcggaggcctgcggttcgagagatctcatgacagccaggggaagatttccggatctcccctcgatatcacggccattcgcggcagcttttccgtgaactaccggggcctgagactttctctgagcgagatcaccgccacatgcaccggggaagtcacaaatgtgtccggatgctacagctgtatgaccggcgctaaagtttctattaagctccactccagcaaaaactctacggcgcatgtgcgctgcaagggggacgagaccgccttctccgtcctggaaggagtgcacagctatacagtttccctgtcttttgatcacgctgtggtcgacgagcagtgtcagcttaattgcggcgggcatgaaagccaagtgaccctcaagggaaacctgatcttcctggacgttcctaaatttgtggatggctcctacatgcagacatatcacagcaccgtccccacgggcgccaatatcccttctcccacagactggctcaacgccctgttcgggaatggactttccagatggattctgggcgtgatcggggtgctcctgggaggcctggctcttttcttcatgattatgagcctctttaagctggggaccaaacaggtcttccggtctcgcacaaagctggcctga

SEQ ID NO: 14782 - RNA, 3222 nt, synthetic construct
  misc_feature 1..3222: note = derived and/or modified CDS sequence (opt5) from SFTSV(AHZ/China/2011)__JQ670931.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcattctggtcgtgaaaaaggctaaaggctccgatatgatcgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggattggggatgttgcctgtcagccgatgacccccatccctgaagagacattcctggagcttaagtcctttagccagtctgagttccccgacatttgcaaaatcgatggaatcgtgtttaatcagtgtgaaggcgaaagcctgcctcaacccttcgacgtcgcctggatggatgtggggcactcccataagattatcatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaagattgctggctgcgaacacggcgaggaggcctctgaagctaaatgtcggtgctccctcgttcataagcctggggaggtggtggtcagctacggaggcatgcgcgtgagacccaaatgttacgggttttcccggatgatggccaccctggaagttaaccagcctgagcaacgcatcggacagtgcacgggctgtcaccttgaatgcattaatgggggcgtgagactgatcaccctcacatctgagctgaagtccgcgaccgtctgtgcctcccatttctgctctagcgctacatccggaaagaaaagcaccgagatccagttccactctggctccctggtggggaagacggccattcacgttaaaggagctctcgtggatggcacagaatttaccttcgaggggagctgtatgtttcccgacggatgcgatgccgtcgactgcacattctgtcgggaatttctgaagaacccccaatgctatcctgcgaaaaagtggcttttcatcattatcgtgattctgctcggctacgccgggctgatgcttctgaccaatgtcctcaaggctatcggcatctggggatcttgggtgattgccccggttaaactgatctttgctattatcaagaaactgatgcgcaccgtgtcctgtctcatgggcaagctgatggatagagggcggcaggtcattcatgaggaaatcggagagaacagagagggcaatcaggacgatgtgcgcattgaaatggcccggcccagacgcgttcggcactggatgtatagccctgtgatccttacaatcctggccattgggctcgctgagtcttgcgacgaaatggtccatgcggatagcaaactggtgtcctgtagacagggaagcggcaacatgaaggagtgcgtgacgaccgggcgcgcccttctgcccgctgttaatcctggccaagaggcctgtctccacttcacagcccccggatctccggactccaagtgcctgaaaatcaaggtcaaatggattaacctgaagtgtaaaaagagctcctcttactttgtgcctgatgctcggagcagatgcacctccgtgcgccggtgtagatgggccggcgactgccagtctgggtgtccccctcatttcacaagcaattccttttctgacgattgggcgggaaagatggaccgcgctggcctcgggttcagcggatgctccgatggctgcgggggcgccgcctgtggatgctttaacgctgcccccagctgtatcttctggcggaaatgggtcgaaaatcctcacggcattatctggaaggtgtctccctgcgctgcctgggttccgtccgcggtgatcgagctgagcatgccttctggggaagtcagaaccttccaccccatgtccggcattcccacacaggtgtttaaaggagttagcgtgacgtatcttgggtctgacatggaggtctccggactgaccggcctctgtgaaatcgaggagcttaagagcaaaaagctggccctggctccttgcaaccaggccggcatgggggtggttggaaaagtgggcgaaattcaatgttccagcgaggaatctgctcggaccatcaagaaggatgggtgcatttggaacgccgacctcgtcggaatcgagctgcgcgtggatgacgcggtgtgttacagcaaaatcacatccgtcgaatctgttgccaattatagcgctattccgaccacaatcggcgggctgagattcgagcggtcccatgattctcagggaaagattagcggcagccccctcgacatcacggccattagaggctcttttagcgtgaactaccgcgggctgcggctttccctgagcgagatcaccgctacatgcaccggagaagtgacaaatgtctctggctgctactcctgtatgaccggggccaaagtgagcatcaagctccactcttccaaaaacagcacggcccatgttagatgcaagggagatgagaccgctttctccgtgctggaaggcgtccactcttatacagtgagcctgtcctttgaccacgcggttgtggatgagcagtgtcagcttaattgcgggggacatgaaagccaagtcaccctcaagggcaacctgattttcctggacgtgcctaaatttgttgacggctcttacatgcagacatatcactccaccgtgcccacgggggccaatatccctagccccacagattggctcaacgctctgttcggaaatggcctttctcgctggattctggggctcatcggagtcctgctgggcgggcttgccctctttttcatgattatgagcctgtttaagctgggaaccaaacaggtgttcagatcccggacaaagctcgcctga

SEQ ID NO: 14783 - RNA, 3222 nt, synthetic construct
  misc_feature 1..3222: note = derived and/or modified CDS sequence (opt5) from SFTSV(DS02/CHN/2013)__KR698332.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctccctcaaccctttgatgtcgcctggatggacgtgggccactcccataagatcattatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatgcagttttgtaaggttgctggatgcgaacacggcgaggaggcctctgaagctaaatgtcggtgctccctggtgcataagcctggcgaggtggtcgtgagctacgggggaatgcgcgttagacccaaatgttacggcttctcccggatgatggccacgcttgaagtgaatcctcccgagcagcgcatcgggcaatgcaccggatgtcacctggaatgcattaacggcggggtcagactcgtgacactgacctctgagcttaagagcgcgacagtttgtgcctcccatttttgctctagcgctacctccggcaagaaaagcacggagatccagttccactctggatccctcgtgggcaaggccgctattcacgtcaaaggggccctggtggacggaacagagttcacctttgaaggcagctgtatgttccccgatgggtgcgacgcggtcgattgcacattttgtcgggagttccttaagaatctgcagtgctatcctgccaaaaagtggctctttatcatcattgtgatcctgcttggatacgctggcctgatgctcctgaccaacgttctgaaggccattggggtgtggggctcttgggtcatcgctccggtgaaactcatgttcgccattatcaagaaactgatgcgctccgttagctgtcttatgggaaagctgatggacagaggccggcaagtgatccatgaagaaattggggagaatagagagggaaaccaggatgacgtccgcatcgaaatggtgcggcccagacgcgtgcggcactggatgtattctcctgttattctcaccatcctggccattggccttacagaggggtgcgatgaaatggtccatgctgacagcaaactggtgtcctgtagacagggaagcggcaatatgaaggagtgcgtgacgaccgggcgcgcgctcctgcccgccgtcaaccctggccaggaggcttgtctgcactttacagcccccggatctccggattccaagtgcctcaaaatcaaggtgaaacggattaatctgaagtgtaaaaagagctcctcttacttcgttcctgacgccagaagccgctgcacctccgtgcggagatgtcgctgggctggcgattgccaatctgggtgccccagccattttacatccaactctttcagcgacgactgggccggaaagatggatcgggcgggccttgggttttccggatgtagcgacggctgcgggggcgctgcctgtggatgcttcaatgccgctccttcttgtatcttttggagaaaatgggtcgaaaacccccacggcatcatttggaaggtgtccccttgcgccgcttgggttcccagcgccgtgatcgagctgaccatgccgtctggggaagtccggacgttccaccctatgtccggcattcccacacaggtgttcaaaggagttagcgtgacctatctcgggtctgatatggaggtctccggactgaccgacctgtgtgaaatcgaggagcttaagagcaaaaagctcgcgctggccccctgcaaccaggctggcatgggcgtggtggggaaagtcggagaaattcagtgttccagcgaggaatctgcccgcacaatcaagaaggatggctgcatctggaatgctgacctggttgggattgagctcagagtggatgacgccgtgtgttacagcaaaatcacctccgtcgaagcggtggccaactattctgctattcctacaacgatcggaggcctgcggtttgagagaagccatgattcccaagggaagatttctggaagcccgcttgacatcaccgccatccgcggctccttctctgttaattaccggggcctgagactcagcctgtccgagattacagctacctgcacaggggaagtgaccaacgtcagcggatgctactcttgtatgacgggcgccaaagtgtccatcaagctgcacagctctaaaaattccaccgcccatgttcgctgcaagggggatgagacagcttttagcgtgcttgaaggagtccactcctataccgtgtctctcagcttcgaccacgcggttgtggatgagcagtgtcagctgaactgcggcgggcatgaatcccaggtcacactgaagggaaatctcatttttctggacgtgcccaaattcgtggacggcagctacatgcaaacctatcactcttccgtccctacgggcgccaacatccccagccctacagattggcttaatgctctgtttgggaacggactctctagatggattctgggcgttatcggggtgctgcttggaggcctcgccctgttctttctgatcatgagcctcttcaagctggggaccaaacaggtgtttcggtcccgcacaaagctggcctga

SEQ ID NO: 14784 - RNA, 3222 nt, synthetic construct
  misc_feature 1..3222: note = derived and/or modified CDS sequence (opt5) from SFTSV(DS03/CHN/2013)__KR698333.1__GP
  source 1..3222: mol_type = other RNA
atgatgaaggtgatctggttcagctccctgatttacctcgtcatccagtgctctggcgacagcgggcccattatctgtgccggacctattcactccaacaaatctgctaatatcccgcatctgcttggctatagcgagaagatctgccaaattgatagactgatccacgtttcctcttggctccggaaccatagccagtttcaggggtacgtgggacagcgcggcgggagatcccaagtgagctattaccccgccgaaaattcttattcccggtggagcggactgctttctccttgtgacgcggattggctgggcatgctcgtcgtgaaaaaggctaaaggctccgacatgattgttcccgggcctagctacaagggaaaggtgttctttgagcgccccaccttcgatggctatgtcgggtggggatgcggctctgggaaatccagaacagaaagcggagagctgtgttcctctgacagcggcacgtccagcggcctgctcccttctgatcgggtgctgtggatcggggacgttgcctgccagccgatgacccccattcctgaagagacatttcttgagctgaagtccttcagccagtctgaatttcccgatatctgtaaaattgacggaatcgtgttcaaccagtgcgagcgcgaaagcctccctcaaccctttgatgtcgcctggatggacgtgggccactcccataagatcattatgagagagcacaaaaccaagtgggtgcaggagtctagctccaaggatttcgtctgttacaaagaagggacaggaccgtgcagcgagtctgaagagaagacctgtaaaacatccggcagctgccgcggggacatgcagttttgcaaggttgctggatgtgaacacggcgaggaggcctctgaagctaaatgccggtgttccctggtgcataagcctggcgaggtggtcgtgagctacgggggaatgagagttcggcccaaatgctatggcttctcccgcatgatggccacccttgaagtgaatcctcccgagcagagaatcgggcaatgtacgggatgccacctggaatgtattaacggcggggtccggctcatcaccctgacatctgagcttaagagcgcgaccgtgtgcgcctcccatttttgttctagcgctacatccggcaagaaaagcaccgagattcagttccactctggatccctcgttggccgcacggccatccacgtgaagggggctctggtcgacggaacagagttcacctttgaaggcagctgcatgttccccgatgggtgtgacgccgtggattgcacattttgcagagagttccttaaaaatcctcagtgttacccggcgaagaaatggctgtttatcattatcgtcattctcctgggatatgccggccttatgctgctcaccaacgtgctgaaggctatcggggtttggggctcttgggtgattgcccccgtcaagctgatgttcgctatcatcaaaaagctcatgcggtccgtgagctgcctgatgggaaaacttatggacagaggccgccaagttattcatgaagaaatcggggagaatcgggagggaaaccaggatgacattagaatcgaaatggcccgccctcggagagtgcgccactggatgtactctcccgtcattctgaccatcctcgccgtgggcctggctgaggggtgtgatgaaatggtgcatgcggacagcaagctggtttcctgcaaacagggaagcggcaatatgaaggagtgtgtcacaacggggcgggccctgctccctgctgtgaaccccggccaggaggcctgcctgcactttaccgccccgggatctcctgattccaagtgtctgaaaattaaggtgaaaagaatcaatctcaagtgcaaaaagagctcctcttatttcgtccccgacgctcgcagccggtgtacatccgtgagacgctgccggtgggccggcgattgtcaatctgggtgccctagccattttacctccaactctttcagcgacgactgggcgggaaagatggatagagctggcctggggttttccggatgcagcgacggctgtgggggcgccgcctgcggatgtttcaatgctgccccctcttgcatcttttggcggaaatgggttgaaaaccctcacggcattatctggaaggtgtccccctgtgctgcctgggtcccgagcgcggtgattgagcttacaatgccttctggggaagttcgcaccttccaccccatgtccggaatccccacacaggtgttcaaaggcgtcagcgtgacgtacctggggtctgatatggaggtttccggactcaccgacctgtgcgaaattgaggagcttaagagcaaaaagctggccctcgctccttgtaaccaggccggcatgggcgtggtcgggaaagtgggagaaatccagtgctccagcgaggaatctgctagaaccatcaagaaggatggctgtatttggaatgccgacctggtggggatcgagctgcgggtcgatgacgcggtttgctatagcaaaattacatccgtggaagccgtggctaactactctgccatcccgaccacaattggaggcctcagatttgagcgcagccatgattcccaagggaagatctctggaagccccctggacatcacggctattcggggctccttctctgtcaattacagaggccttcgcctgagcctctccgagatcaccgccacatgtaccggggaagtgacaaacgttagcggatgctattcttgcatgaccggcgccaaagtgtccattaagctgcacagctctaaaaattccacggctcatgtcagatgtaagggggatgagaccgcgtttagcgtgctggaaggagttcactcctacacagtgtctcttagcttcgaccacgccgtcgtggatgagcagtgccagctcaactgtggcgggcatgaatcccaggttaccctgaagggaaatctgatctttctcgacgtgcctaaattcgtcgacggcagctatatgcaaacataccactcttccgtgcccaccggcgctaacattcctagccccacggattggctgaatgccctttttgggaacggactgtctcggtggatcctcggcgtgatcggggtcctgctgggaggccttgccctcttctttctgattatgagcctgttcaagctcgggacaaaacaggtttttcgctccagaaccaagctggcttga

SEQ ID NO: 14785 - RNA, 3222 nt, synthetic construct
  misc_feature 1..3222: note = derived and/or modified CDS sequence (opt5) from SFTSV(DS04/CHN/2013)__KR698334.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctccctcaaccctttgatgtcgcctggatggacgtgggccactcccataagatcattatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatgcagttttgtaaggttgctggatgcgaacacggcgaggaggcctctgaagctaaatgtcggtgctccctggtgcataagcctggcgaggtggtcgtgagctacgggggaatgcgcgttagacccaaatgttacggcttctcccggatgatggccacgcttgaagtgaatcctcccgagcagcgcatcgggcaatgcaccggatgtcacctggaatgcattaacggcggggtcagactcatcacactgacctctgagcttaagagcgcgacagtgtgtgcctcccatttttgctctagcgctacctccggcaagaaaagcacggagattcagttccactctggatccctcgttggcaaggccgctatccacgtgaaaggggccctggtcgacggaacagagttcacctttgaaggcagctgtatgttccccgatgggtgcgacgcggtggattgcacattttgtcgggagttccttaagaatcctcagtgctatccggccaaaaagtggctgtttatcattatcgtcattctcctgggatacgctggccttatgctgctcaccaacgtgctgaaggccatcggggtttggggctcttgggtgattgctcccgtcaaactgatgttcgccatcatcaagaaactcatgcgctccgtgagctgtctgatgggaaagctgatggacagaggccggcaagttattcatgaagaaatcggggagaatagagagggaaaccaggatgacgtgcgcattgaaatggtccggcctagacgcgtgcggcactggatgtattctcccgtgatcctgaccattctcgccatcggcctgacagaggggtgcgatgaaatggttcatgctgacagcaaacttgtctcctgtagacagggaagcggcaatatgaaggagtgcgtgacgaccgggcgcgcgctgctccctgccgtgaaccccggccaggaggcttgtctgcactttacagccccgggatctcctgattccaagtgcctgaaaattaaggtcaaacggatcaatctcaagtgtaaaaagagctcctcttacttcgtgcccgacgccagaagccgctgcacctccgttcggagatgtcgctgggctggcgattgccaatctgggtgccctagccattttacatccaactctttcagcgacgactgggccggaaagatggatcgggcgggcctggggttttccggatgtagcgacggctgcgggggcgctgcctgtggatgcttcaatgccgctccctcttgtatcttttggagaaaatgggtggaaaaccctcacggcattatctggaaggtctccccctgcgccgcttgggtgccgagcgccgttattgagcttaccatgccttctggggaagtgcggacgttccgccccatgtccggaatccccacacaggtcttcaaaggcgtgagcgttacctatctggggtctgatatggaggtgtccggactcaccgacctgtgtgaaattgaggagcttaagagcaaaaagctggcgctcgccccttgcaaccaggctggcatgggcgtcgtggggaaagtgggagaaatccagtgttccagcgaggaatctgccagaacaatcaagaaggatggctgcatttggaatgctgacctggtcgggatcgagctgcgggttgatgacgccgtgtgttacagcaaaattacctccgtggaagcggtcgtgaactattctgccatcccgacaacgattggaggcctcagatttgagcgcagccacgattcccaagggaagatctctggaagccccctggacatcaccgctattcggggctccttctctgttaattacagaggccttcgcctgagcctctccgagatcacagctacctgcacaggggaagtgaccaacgtcagcggatgctactcttgtatgacgggcgccaaagtgtccattaagctgcatagctctaaaaattccaccgcccacgttagatgcaagggggatgagacagcctttagcgtgctggaaggagtccattcctataccgtgtctcttagcttcgaccacgctgttgtggatgagcagtgtcagctcaactgcggcgggcacgaatcccaggtcacactgaagggaaatctgatctttctcgacgtgcctaaattcgtggacggcagctacatgcaaacctatcattcttccgtccccacgggcgcgaacattcctagccccacagattggctgaatgccctttttgggaacggactgtctcggtggatcctcggcgttatcggggtgctgctgggaggccttgctctcttctttctgattatgagcctgttcaagctcgggaccaaacaggtgtttcgctccagaacaaagctggcctga

SEQ ID NO: 14786 - RNA, 3222 nt, synthetic construct
  misc_feature 1..3222: note = derived and/or modified CDS sequence (opt5) from SFTSV(DS05/CHN/2013)__KR698335.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctccctcaaccctttgatgtcgcctggatggacgtgggccactcccataagatcattatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatgcagttttgtaaggttgctggatgcgaacacggcgaggaggcctctgaagctaaatgtcggtgctccctggtgcataagcctggcgaggtggtcgtgagctacgggggaatgcgcgttagacccaaatgtcacggcttctcccggatgatggccacgcttgaagtgaatcctcccgagcagcgcatcgggcaatgcaccggatgtcatctggaatgcattaacggcggggtcagactcatcacactgacctctgagcttaagagcgcgacagtgtgtgcctcccacttttgctctagcgctacctccggcaagaaaagcacggagattcagttccactctggatccctcgttggcaaggccgctatccatgtgaaaggggccctggtcgacggaacagagttcacctttgaaggcagctgtatgttccccgatgggtgcgacgcggtggattgcacattttgtcgggagttccttaagaatcctcagtgctacccggccaaaaagtggctgtttatcattatcgtcattctcctgggatatgctggccttatgctgctcaccaacgtgctgaaggccatcggggtttggggctcttgggtgattgctcccgtcaaactgatgttcgccatcatcaagaaactcatgcgctccgtgagctgtctgatgggaaagctgatggacagaggccggcaagttattcacgaagaaatcggggagaatagagagggaaaccaggatgacgtgcgcattgaaatggtccggcctagacgcgtgcggcattggatgtactctcccgtgatcctgaccattctcgccatcggcctgacagaggggtgcgatgaaatggttcacgctgacagcaaacttgtctcctgtagacagggaagcggcaatatgaaggagtgcgtgacgaccgggcgcgcgctgctccctgccgtgaaccccggccaggaggcttgtctgcattttacagccccgggatctcctgattccaagtgcctgaaaattaaggtcaaacggatcaatctcaagtgtaaaaagagctcctcttatttcgtgcccgacgccagaagccgctgcacctccgttcggagatgtcgctgggctggcgattgccaatctgggtgccctagccactttacatccaactctttcagcgacgactgggccggaaagatggatcgggcgggcctggggttttccggatgtagcgacggctgcgggggcgctgcctgtggatgcttcaatgccgctccctcttgtatcttttggagaaaatgggtggaaaaccctcacggcattatctggaaggtctccccctgcgccgcttgggtgccgagcgccgttattgagcttaccatgccttctggggaagtgcggacgttccatcccatgtccggaatccccacacaggtcttcaaaggcgtgagcgttacctacctggggtctgatatggaggtgtccggactcaccgacctgtgtgaaattgaggagcttaagagcaaaaagctggcgctcgccccttgcaaccaggctggcatgggcgtcgtggggaaagtgggagaaatccagtgttccagcgaggaatctgcccgcacaatcaagaaggatggctgcatttggaatgctgacctggtcgggatcgagctgagagttgatgacgccgtgtgttatagcaaaattacctccgtggaagcggtcgccaactactctgctatcccgacaacgattggaggcctccggtttgagagaagccacgattcccaagggaagatctctggaagccccctggacatcaccgccattcgcggctccttctctgtgaattatcggggccttagactgagcctctccgagatcacagctacctgcacaggggaagttaccaacgtgagcggatgctactcttgtatgacgggcgccaaagtctccattaagctgcatagctctaaaaattccaccgcccacgtgcgctgcaagggggatgagacagcttttagcgttctggaaggagtgcactcctacaccgtctctcttagcttcgaccatgcggtggttgatgagcagtgtcagctcaactgcggcgggcacgaatcccaggtgacactgaagggaaatctgatctttctcgacgtccctaaattcgtggacggcagctatatgcaaacctaccattcttccgtgcccacgggcgccaacattcctagccccacagattggctgaatgctctttttgggaacggactgtctagatggatcctcggcgtcatcggggttctgctgggaggccttgccctcttctttctgattatgagcctgttcaagctcgggaccaaacaggtgtttcggtcccgcacaaagctggcctga

SEQ ID NO: 14787 - RNA, 3222 nt, synthetic construct
  misc_feature 1..3222: note = derived and/or modified CDS sequence (opt5) from SFTSV(HB154/China/2011)__JQ733560.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatgtcgcctggatggacgtggggcactcccataagatcattatgcgcgagcacaaaaccaagtgggtgcaggaatctagctccaaggatttcgtctgctataaagagggaacaggcccgtgtagcgaatctgaggaaaaggcttgcaaaacctccgggagctgcagaggagacatgcagttttgtaaggttgccggctgcgagcacggcgaggaagctagcgaggccaaatgtcggtgctccctggtgcataagcctggggaagtggtcgtgagctacggaggcatgcgcgttagacccaaatgttacgggttctcccggatgatggcgacacttgaggtgaaccctcccgaacagcgcatcggacaatgcaccggctgtcacctggagtgcattaatgggggcgtcagactcatcacgctgacctctgagctgcggagcgccacagtgtgtgcttcccatttttgctctagcgccacctccggaaagaagtctacagaaattcacttccactctggctccctcgttgggaaaaccgctatccatgtgaagggagccctggtcgacggcacggagttcacatttgaagggagctgtatgttccccgatggatgcgacgcggtggattgcaccttttgtcgcgagttccttaaaaaccctcagtgctatccggccaagaaatggctgtttatcattatcgtcattctcctgggctacgctgggcttatgctgctcacaaatgtgctgaaggccatcggcgtttggggatcttgggtgattgctcccgtcaagctgatgttcgccatcatcaaaaagctcatgagaaccgtgtcctgtctggttggcaaacttatggaccgggggagacaggtgattaacgaagagatcggagagaatggcgaagggaaccaagatgacgtccgcattgagatggcccggcctagacgcgtgcggcactggatgtatagccccgtgatcctgaccattctcgctatcggactggcggaaggctgcgatgagatggttcatgccgactctaagctggtcagctgtagacaggggtccggcaatatgaaagagtgcattacaacgggacgcgctctgctccctgccgtgaaccccggccaggaagcctgtctgcactttaccgctccggggagccctgattctaagtgcctgaagatcaaagtgaagcggatcaatctcaaatgtaagaaatccagctcctacttcgtccccgacgccagatctcgctgcacaagcgtgcggagatgtcgctgggcgggagattgccagtccggctgccctccccattttacctctaacagcttctccgacgactgggctgggaagatggatcgggccggactgggcttttctgggtgtagcgacggctgcggaggcgccgcttgtgggtgcttcaatgccgctccttcctgtatcttttggagaaagtgggttgagaacccccacggaattatttggaaagtgagcccgtgcgccgcgtgggtcccttctgccgtgatcgaacttacaatgccctccggcgaggttcggaccttccaccccatgagcgggattcctacgcaagtgttcaagggagtctctgtgacatatctgggctccgatatggaagttagcggcctcaccgacctgtgtgagatcgaggaactgaaatctaagaaacttgctctcgccccgtgcaaccaggctgggatgggagtggtcggcaaggtgggggagatccagtgttccagcgaagagtccgcccgcaccattaaaaaggatggatgcatctggaatgcggacctggtgggcattgaactgagagtcgatgacgccgtttgttacagcaagatcacatctgtggaggctgtggccaactatagcgctattcccaccacaatcgggggactccggtttgagagatcccatgattctcagggcaaaatcagcggctcccctctggacattacggccatccgcgggtctttcagcgtcaattaccggggacttagactgtccctctctgaaattaccgccacatgcaccggcgaggtgacaaacgttagcgggtgctactcctgtatgaccggagctaaggtgagcatcaaactgcactcttccaagaatagcacggcgcatgtccgctgcaaaggcgatgaaaccgccttttctgtgctggagggggttcactcctatattgtgagcctttccttcgaccacgctgtcgtggatgaacaatgtcagctcaactgcggaggccatgagtctcaggttacactgaagggcaatctgatctttctcgacgtgcccaagttcgtcgacgggagctacatgcagacctatcactccacagtgcctaccggagccaacatccccagccctacggattggctgaatgccctttttggcaacgggctgtctagatggattctcggagtgatcggcgtcctgcttgggggacttgctctcttctccctgattatgtttctgctcaaactgggcacaaagcaagttttccggagccgcaccaaacttgcctga

SEQ ID NO: 14788 - RNA, 3222 nt, synthetic construct
  misc_feature 1..3222: note = derived and/or modified CDS sequence (opt5) from SFTSV(HB155/China/2011)__JQ733563.1__GP
  source 1..3222: mol_type = other RNA
atgatgaaggtgatctggttcagctccctgatttgcctcgtcatccagtgttctggcgacagcgggcccattatctgcgccggacctattcactccaacaagtctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatgtcgcctggatggacgtggggcactcccataagatcattatgcgcgagcacaaaaccaagtgggtgcaggaatctagctccaaggatttcgtctgctataaagagggaacaggcccgtgtagcgaatctgaggaaaaggcttgcaaaacctccgggagctgcagaggagacatgcagttttgtaaggttgccggctgcgagcacggcgaggaagctagcgaggccaaatgtcggtgctccctggtgcataagcctggggaagtggtcgtgagctacggaggcatgcgcgttagacccaaatgttacgggttctcccggatgatggcgacacttgaggtgaaccctcccgaacagcgcatcggacaatgcaccggctgtcacctggagtgcattaatgggggcgtcagactcatcacgctgacctctgagctgcggagcgccacagtgtgtgcttcccatttttgctctagcgccacctccggaaagaagtctacagaaattcacttccactctggctccctcgttgggaaaaccgctatccatgtgaagggagccctggtcgacggcacggagttcacatttgaagggagctgtatgttccccgatggatgcgacgcggtggattgcaccttttgtcgcgagttccttaaaaaccctcagtgctatccggccaagaaatggctgtttatcattatcgtcattctcctgggctacgctgggcttatgctgctcacaaatgtgctgaaggccatcggcgtttggggatcttgggtgattgctcccgtcaagctgatgttcgccatcatcaaaaagctcatgagaaccgtgtcctgtctggttggcaaacttatggaccgggggagacaggtgattcacgaagagatcggagagaacggcgaagggaatcaagatgacgtccgcattgagatggcccggcctagacgcgtgcggcattggatgtatagccccgtgatcctgaccattctcgctatcggactggcggaaggctgcgatgagatggttcacgccgactctaagctggtcagctgtagacaggggtccggcaacatgaaagagtgcattacaacgggacgcgctctgctccctgccgtgaatcccggccaggaagcctgtctgcattttaccgctccggggagccctgattctaagtgcctgaagatcaaagtgaagcggatcaacctcaaatgtaagaaatccagctcctacttcgtccccgacgccagatctcgctgcacaagcgtgcggagatgtcgctgggcgggagattgccagtccggctgccctccccactttacctctaatagcttctccgacgactgggctgggaagatggatcgggccggactgggcttttctgggtgtagcgacggctgcggaggcgccgcttgtgggtgcttcaacgccgctccttcctgtatcttttggagaaagtgggttgagaatccccacggaattatttggaaagtgagcccgtgcgccgcgtgggtcccttctgccgtgatcgaacttacaatgccctccggcgaggttcggaccttccatcccatgagcgggattcctacgcaagtgttcaagggagtctctgtgacatatctgggctccgatatggaagttagcggcctcaccgacctgtgtgagatcgaggaactgaaatctaagaaacttgctctcgccccgtgcaaccaggctgggatgggagtggtcggcaaggtgggggagatccagtgttccagcgaagagtccgcccgcaccattaaaaaggatggatgcatctggaacgcggacctggtgggcattgaactgagagtcgatgacgccgtttgttacagcaagatcacatctgtggaggctgtggccaattatagcgctattcccaccacaatcgggggactccggtttgagagatcccacgattctcagggcaaaatcagcggctcccctctggacattacggccatccgcgggtctttcagcgtcaactaccggggacttagactgtccctctctgaaattaccgccacatgcaccggcgaggtgacaaatgttagcgggtgctactcctgtatgaccggagctaaggtgagcatcaaactgcattcttccaagaacagcacggcgcacgtccgctgcaaaggcgatgaaaccgccttttctgtgctggagggggttcactcctatattgtgagcctttccttcgaccatgctgtcgtggatgaacaatgtcagctcaattgcggaggccacgagtctcaggttacactgaagggcaacctgatctttctcgacgtgcccagattcgtcgacgggagctacatgcagacctatcattccacagtgcctaccggagccaatatccccagccctacggattggctgaacgccctttttggcaatgggctgtctcggtggattctcggagtgatcggcgtcctgcttgggggacttgctctcttctttctgattatgttcctgctcaagctgggcacaaaacaagtttttcgctccagaaccaaacttgcctga

SEQ ID NO: 14789 - RNA, 3222 nt, synthetic construct
  misc_feature 1..3222: note = derived and/or modified CDS sequence (opt5) from SFTSV(HB156/China/2011)__JQ733566.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatgtcgcctggatggacgtggggcactcccataagatcattatgcgcgagcacaaaaccaagtgggtgcaggaatctagctccaaggatttcgtctgctataaagagggaacaggcccgtgtagcgaatctgaggaaaaggcttgcaaaacctccgggagctgcagaggagacatgcagttttgtaaggttgccggctgcgagcacggcgaggaagctagcgaggccaaatgtcggtgctccctggtgcataagcctggggaagtggtcgtgagctacggaggcatgcgcgttagacccaaatgttacgggttctcccggatgatggcgacacttgaggtgaaccctcccgaacagcgcatcggacaatgcaccggctgtcacctggagtgcattaatgggggcgtcagactcatcacgctgacctctgagctgcggagcgccacagtgtgtgcttcccatttttgctctagcgccacctccggaaagaagtctacagaaattcacttccactctggctccctcgttgggaaaaccgctatccatgtgaagggagccctggtcgacggcacggagttcacatttgaagggagctgtatgttccccgatggatgcgacgcggtggattgcaccttttgtcgcgagttccttaaaaaccctcagtgctatccggccaagaaatggctgtttatcattatcgtcattctcctgggctacgctgggcttatgctgctcacaaatgtgctgaaggccatcggcgtttggggatcttgggtgattgctcccgtcaagctgatgttcgccatcatcaaaaagctcatgagaaccgtgtcctgtctggttggcaaacttatggaccgggggagacaggtgattcacgaagagatcggagagaacggcgaagggaatcaagatgacgtccgcattgagatggcccggcctagacgcgtgcggcattggatgtatagccccgtgatcctgaccattctcgctatcggactggcggaaggctgcgatgagatggttcacgccgactctaagctggtcagctgtagacaggggtccggcaacatgaaagagtgcattacaacgggacgcgctctgctccctgccgtgaatcccggccaggaagcctgtctgcattttaccgctccggggagccctgattctaagtgcctgaagatcaaagtgaagcggatcaacctcaaatgtaagaaatccagctcctacttcgtccccgacgccagatctcgctgcacaagcgtgcggagatgtcgctgggcgggagattgccagtccggctgccctccccactttacctctaatagcttctccgacgactgggctgggaagatggatcgggccggactgggcttttctgggtgtagcgacggctgcggaggcgccgcttgtgggtgcttcaacgccgctccttcctgtatcttttggagaaagtgggttgagaatccccacggaattatttggaaagtgagcccgtgcgccgcgtgggtcccttctgccgtgatcgaacttacaatgccctccggcgaggttcggaccttccatcccatgagcgggattcctacgcaagtgttcaagggagtctctgtgacatatctgggctccgatatggaagttagcggcctcaccgacctgtgtgagatcgaggaactgaaatctaagaaacttgctctcgccccgtgcaaccaggctgggatgggagtggtcggcaaggtgggggagatccagtgttccagcgaagagtccgcccgcaccattaaaaaggatggatgcatctggaacgcggacctggtgggcattgaactgagagtcgatgacgccgtttgttacagcaagatcacatctgtggaggctgtggccaattatagcgctattcccaccacaatcgggggactccggtttgagagaatccacgattcccagggcaaaatttctggcagccctctggacatcacggccattcgcgggtccttctctgtcaactaccggggacttagactgagcctctccgaaatcaccgccacatgcaccggcgaggtgacaaatgtttctgggtgctacagctgtatgaccggagctaaggtgtccattaaactgcatagctctaagaactccacggcgcacgtccgctgcaaaggcgatgaaaccgcctttagcgtgctggagggggttcactcttatatcgtgtcccttagcttcgaccatgctgtcgtggatgaacaatgtcagctcaattgcggaggccacgagtcccaggttacactgaagggcaacctgatctttctcgacgtgcccaagttcgtcgacgggtcttacatgcagacctatcatagcacagtgcctaccggagccaatattccctcccctacggattggctgaacgccctttttggcaatgggctgagcagatggatcctcggagtgattggcgtcctgcttgggggacttgctctcttctttctgatcatgttcctgctcaaactgggcacaaagcaagtttttcggtctcgcaccaaacttgcctga

SEQ ID NO: 14790 - RNA, 3222 nt, synthetic construct
  misc_feature 1..3222: note = derived and/or modified CDS sequence (opt5) from SFTSV(HB2014-04)__KR080475.1__GP
  source 1..3222: mol_type = other RNA
atgatgaaggtgatctggttccccagcctgatttgctttgtcatccagtgttccggcgactctgggcctattatctgcgccggaccgattcacagcaacaaatccgctgatatcccccatctcctgggctactctgagaagatctgtcaaattgacagacttatccacgttagctcctggctgcggaatcattctcagttccaggggtatgtgggacagcgcggcgggagaagccacgtgtcctactatcctgccgaaaacagctactctcggtggtccggactcctgagcccctgcgatgcggactggcttggcatgctggtcgtgaaaaaggctaaaggctctgatatgattgttcctgggccctcctataagggaaaggtgtttttcgagcgccctacctttgacggctacgtcgggtggggatgtggcagcgggaaatctagaacagaatccggagagctctgcagctccgattctggcacgagctccggcctgctgccgagcgaccgggtgctctggatcggggatgttgcctgtcaacccatgacccctattcccgaagagacattcctggagcttaagtctttttcccagagcgaatttcctgacatctgcaaaattgatggaatcgtgtttaatcagtgtgagggcgaatctctgccccagccgttcgacgtcgcctggatggatgtggggcatagccacaagatcattatgcgcgagcacaaaaccaagtgggtgcaagagtcctctagcaaggactttgtctgctataaagaaggaacaggcccttgttccgagagcgaagagaagacctgcaaaacatctgggtcctgcagaggagacatgcagttctgtaaggttgctggctgcgaacatggcgaggaggccagcgaagctaaatgtcggtgctctctcgtgcacaagcccggggaggtggtcgtgtcctacggaggcatgcgcgttagacctaaatgttacgggtttagccggatgatggccaccctggaagtgaaccagcccgagcagcgcatcggacaatgcacgggctgtcatcttgaatgcattaatgggggcgtcagactgatcaccctcacatccgagctgaagtctgcgaccgtgtgtgccagccacttctgctcctctgctacaagcggaaagaaatccaccgagattcagttccacagcggctctctggttgggaagacggccatccatgtgaaaggagctctcgtcgatggcacagaatttaccttcgaggggtcctgtatgtttcccgacggatgcgatgccgtggactgcacattctgtcgggaatttctgaagaaccctcagtgctatccggcgaaaaagtggcttttcatcattatcgtcattctgctcggctacgccgggctgatgcttctgaccaatgtgctcaaggctatcggcatttggggaagctgggttatcgcccccgtgaaactgatctttgctattatcaagaaactgatgcgcaccgtctcttgtctcatgggcaagctgatggatagagggcggcaagtgattcacgaggaaatcggagagaacagagagggcaatcaggacgatgttcgcattgaaatggcccggcctagacgcgtgcggcattggatgtattcccccgtcatccttacaattctggccatcgggctcgctgagagctgcgacgaaatggtgcacgcggattctaaactggtgagctgtagacagggatccggcaacatgaaggagtgcgttacgaccgggcgcgcccttctgcctgctgtcaatcccggccaggaggcctgtctccatttcacagccccgggaagccctgactctaagtgcctgaaaatcaaggtgaaacggattaacctgaagtgtaaaaagtccagctcctactttgtgcccgatgctagatctcgctgcaccagcgtccggagatgtcgctgggccggcgactgccaatccgggtgccctccccacttcacatctaatagcttttccgacgattgggcgggaaagatggaccgggctggcctcgggttctctggatgtagcgatggctgcgggggcgccgcctgtggatgctttaacgctgccccttcctgtatcttctggagaaaatgggtggaaaatccccacggcattatctggaaggttagcccgtgcgctgcctgggtgccttctgcggtcattgagctgaccatgccctccggggaagtgcggacgttccatcccatgagcggaatccctacacaggtttttaaaggcgtgtctgtcacctatcttgggtccgacatggaggtgagcggactgaccgatctctgtgaaatcgaggagctgaagtctaaaaagctggcccttgctccgtgcaaccaggccggcatgggcgttgtggggaaagtcggagaaattcagtgttccagcgaggaatccgctcgcacaatcaagaaggacggctgcatttggaacgccgatctcgtggggatcgagctgagagtggacgatgcggtctgttacagcaaaattacctctgttgaagccgtggctaattatagcgccatccccacaacgatcggaggcctgcggttcgagagatcccacgactctcaagggaagattagcggatcccctctcgatatcaccgctattcgcggctcttttagcgtgaactaccggggcctgagactttccctgtctgagatcacagctacctgcacaggggaagtcaccaatgtgagcggatgctactcctgtatgacgggcgccaaagttagcattaagctccattcttccaaaaacagcaccgcccacgtgcgctgcaagggggacgagacagcgttctctgtcctggaaggagtgcactcctataccgttagcctgtcctttgatcatgccgtggtcgacgagcagtgtcagcttaattgcggcgggcacgaatctcaggtgacactcaagggaaacctgatcttcctggacgttcccaaatttgtggatggcagctacatgcaaacctatcattccacggtccctacaggcgctaatatccccagccctaccgactggctcaacgccctgttcgggaatggactttctagatggattctgggcgtgatcggggtgctcctgggaggcctggcccttttcttcatgattatgtccctctttaagctggggacaaaacaggtcttccggagccgctctaagctggcttga

SEQ ID NO: 14791 - RNA, 3222 nt, synthetic construct
  misc_feature 1..3222: note = derived and/or modified CDS sequence (opt5) from SFTSV(HNXH)__KT254590.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagctcaagagcttctctcagtccgaatttcccgacatctgcaaaattgatggcatcgtgttcaatcagtgtgagggggaaagcctgcctcaaccctttgacgtcgcctggatggatgtgggacactctcataagatcattatgcgcgagcacaaaacaaagtgggtgcaggagagctcctctaaggacttcgtctgctataaagaaggcaccgggccgtgtagcgagtccgaagagaagacatgcaaaaccagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacgcttgaagtgagccagcctgagcaacgcatcggccagtgcaccgggtgtcacctggaatgcattaacggcggagtcagactcatcacactgacctccgagctgaagtctgcgacagtgtgtgccagccatttttgctcctctgctaccagcggcaagaaatccacggagattcagttccacagcgggtctctcgttggaaagacagccatccacgtgaaaggcgctctggtcgatgggaccgagttcacatttgaaggatcctgtatgttccccgacggctgcgatgccgtggactgcaccttttgtcgggagttccttaagaatccccaatgctatcctgcgaaaaagtggctgtttatcattatcgtcattctcctggggtacgccggccttatgctgctcaccaacgtgctgaaggctatcggagtttggggcagctgggtgattgccccggtcaaactggtgttcgctctcatcaagaaactgatgcgcgccgtttcttgtcttatggggaagctgatggatagaggaagacaggtgatccatgaagaaattggcgagaatcgggaggggaaccaggacgatgtccgcatcgaaatggcccggcccagacgcgtgcggcactggatgtattcccctgtgattctcacaatcctggctattggacttgcggagggctgcgacgaaatggttcatgccgatagcaaactggtctcttgtagacaggggagcggcaatatgaaggagtgcgtgacgaccggacgcgctctcctgcccgccgtgaaccctggccaagaggcctgtctgcactttacagctcccgggtccccggacagcaagtgcctcaaaatcaaggtcaaacggattaatctgaagtgtaaaaagtcttccagctacttcgtgcctgatgccagatcccgctgcacctctgttcggagatgtcgctgggcgggagactgccagagcggctgtccccctcattttacatccaactctttcagcgacgattgggctgggaagatggaccgggccggacttggcttttccgggtgctctgatggctgcggaggcgccgcttgtgggtgcttcaatgccgctcccagctgtatcttttggagaaaatgggtggaaaaccctcacggaatcatttggaaggtctccccctgcgccgcgtgggtgccgagcgccgttatcgagctgaccatgccttctggcgaagtgcggacgttccaccccatgtccgggattcccacacaggtcttcaaaggagtgagcgttacctatctcggctctgacatggaggtgtccggcctgaccgatctgtgtgaaatcgaggagcttaagagcaaaaagctcgctctggccccttgcaatcaggctgggatgggagtcgtgggcaaagtgggggaaattcaatgttcttccgaggaaagcgcccgcacaatcaagaaggacggatgcatctggaacgcggatctggtcggcattgagctcagagttgacgatgccgtgtgttactccaaaatcaccagcgtggaagctgtcgccaactattctgctattccgacaacgatcgggggactgcggtttgagagaagccatgactcccagggcaagatttctggcagcccccttgatatcaccgccatccgcgggtccttctctgtgaattaccggggactgagactcagcctgtccgagattacagctacctgcacaggcgaagttaccaacgtgtctgggtgctacagctgtatgacgggagccaaagtctccatcaagctgcacagctctaaaaattccaccgcgcatgtgcgctgcaagggcgacgagacagcctttagcgttcttgaaggggtgcactcttattccgtcagcctctccttcgatcacgctgtggttgacgagcagtgtcagctgaactgcggaggccatgaatctcaagtgaccctgagaggcaatctcatttttctggacgtccctaagttcgtggatgggagctacatgcagacatatcactccaccgtgcccacgggagccaacatccctagccccacagactggcttaatgccctgtttggcaacgggctctctcggtggattctgggagtcaccggcgttctgcttgggggactcgctctgttctttctgatcatgtccctcttcaaactgggcacaaagcagatctttcgcagcagaaccaaacttgcctga

SEQ ID NO: 14792 - RNA, 3222 nt, synthetic construct
  misc_feature 1..3222: note = derived and/or modified CDS sequence (opt5) from SFTSV(JS2012-goat01)__KC473538.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcatcagacccaaatgttacgggttttcccggatgatggccaccctggaagttaaccagcctgagcaacgccttggacagtgcacgggctgtcacctggaatgcattaatgggggcgtgagactcatcaccctgacatctgagcttaagagcgcgaccgtctgtgcctcccatttctgctctagcgctacatccggaaagaaaagcaccgagattcagttccactctggctccctcgtggggaagacggccatccacgttaaaggagctctggtggatggcacagaatttaccttcgaggggagctgtatgtttcccgacggatgcgatgccgtcgactgcacattctgtcgggaatttcttaagaacccccaatgctatcctgcgaaaaagtggctgttcatcattatcgtgattctcctgggctacgccgggcttatgctgctcaccaatgtcctgaaggctatcggcatttggggatcttgggtgatcgccccggttaaactgatgtttgctatcattaagaaactcatgcgcaccgtgtcctgtctgatgagaaagctgatggatcggggcagacaggtcatccatgaggaaattggggagaaccgcgagggaaatcaggacgatgtgcggatcgaaatggccagaccccgccgggttagacactggatgtatagccctgtgattctgacaatcctcgccattggcctggctgagtcttgcgacgaaatggtccatgcggatagcaaacttgtgtcctgtcgccaggggagcggaaacatgaaggagtgcgtgacgaccggccgggccctgctccccgctgttaatcctgggcaagaggcctgtctgcacttcacagcccccggctctccggactccaagtgcctgaaaatcaaggtcaaaagaatcaacctcaagtgtaaaaagagctcctcttactttgtgcctgatgctcgcagccggtgcacctccgtgagacgctgtcggtgggccggagactgccagtctggctgtccccctcatttcacaagcaattccttttctgacgattgggcggggaagatggacagagctggactgggcttcagcgggtgctccgatggatgcggcggggccgcctgtggctgctttaacgctgcccccagctgtattttctggcggaaatgggtcgaaaatcctcacggaatcatttggaaggtgtctccctgcgctgcctgggttccgtccgcggtgatcgagcttaccatgcctagcggcgaagtccgcacgttccaccccatgtctgggattcccacacaggtgtttaaaggagtttccgtgacctatctgggcagcgacatggaggtctctgggctcaccgatctgtgtgaaatcgaggagctgaagtccaaaaagctcgcccttgctccttgcaaccaggccggaatgggcgtggttggcaaagtgggggaaatccaatgtagctccgaggaaagcgctagaacaattaagaaggacggatgcatctggaacgccgatctggtcggcattgagctgcgggtggacgatgcggtgtgttactctaaaatcaccagcgtcgaagccgttgctaattattccgccattccgacaacgatcgggggactcagattcgagcgctctctggacagccagggcaagatctccgggtctccccttgatattaccgctatccggggcagcttttccgtgaactacagaggactgcgcctctctctgagcgagattacagctacctgcacaggcgaagtgaccaatgtctccgggtgctacagctgtatgacgggagccaaagtgtctatcaagctgcattccagcaaaaactctaccgcccacgttagatgcaagggcgacgagacagcgttctccgtgcttgaaggggtccatagctataccgtgtccctctcttttgatcacgccgttgtggacgagcagtgtcagctgaattgcggaggccacgaaagccaagtcacactgaaggggaacctcattttcctggacgtgcctaaatttgttgatggatcctacatgcagacctatcatagcacggtgcccacaggcgctaatatcccttctcccaccgactggcttaacgccctgttcggcaatgggctctcccggtggatcctgggagtcattggcgtgctgcttgggggactcgccctgtttttcatgatcatgagcctgtttaagctcggcacaaaacaggtgttccgctctagaaccaagctggcttga

SEQ ID NO: 14793 - RNA, 3222 nt, synthetic construct
  misc_feature 1..3222: note = derived and/or modified CDS sequence (opt5) from SFTSV(JS2012-tick01)__KC473541.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgccttggacagtgcacgggctgtcacctggaatgcatcaatgggggcgtcagactcattaccctgacatctgagcttaagagcgcgaccgtgtgtgcctcccatttctgctctagcgctacatccggaaagaaaagcaccgagatccagttccactctggctccctcgttgggaagacggccattcacgtgaaaggagctctggtcgatggcacagaatttaccttcgaggggagctgtatgtttcccgacggatgcgatgccgtggactgcacattctgtcgggaatttcttaagaacccccaatgctatcctgcgaaaaagtggctgttcatcatcattgtcatcctcctgggctacgccgggcttatgctgctcaccaatgtgctgaaggctattggcatctggggatcttgggttattgccccggtgaaactgatgtttgctatcatcaagaaactcatgcgcaccgtctcctgtctgatgagaaagctgatggatcggggcagacaggtgattcatgaggaaatcggggagaaccgcgagggaaatcaggacgatgttcggattgaaatggccagaccccgccgggtgagacactggatgtatagccctgtcatcctgacaattctcgccatcggcctggctgagtcttgcgacgaaatggtgcatgcggatagcaaacttgtgtcctgtcgccaggggagcggaaacatgaaggagtgcgttacgaccggccgggccctgctccccgctgtcaatcctgggcaagaggcctgtctgcacttcacagcccccggctctccggactccaagtgcctgaaaattaaggtgaaaagaatcaacctcaagtgtaaaaagagctcctcttactttgtgcctgatgctcgcagccggtgcacctccgtcagacgctgtcggtgggccggagactgccagtctggctgtccccctcatttcacaagcaattccttttctgacgattgggcggggaagatggacagagctggactgggcttcagcgggtgctccgatggatgcggcggggccgcctgtggctgctttaacgctgcccccagctgtatcttctggcggaaatgggtggaaaatcctcacggaattatctggaaggtttctccctgcgctgcctgggtgccgtccgcggtcattgagcttaccatgcctagcggcgaagtgcgcacgttccaccccatgtctgggatccccacacaggtttttaaaggagtgtccgtcacctatctgggcagcgacatggaggtgtctgggctcaccgatctgtgtgaaattgaggagctgaagtccaaaaagctggccctcgctccttgcaaccaggccggaatgggcgttgtgggcaaagtcggggaaatccaatgtagctccgaggaaagcgctagaacaatcaagaaggacggatgcatttggaacgccgatctggtgggcatcgagctgcgggtggacgatgcggtctgttactctaaaattaccagcgttgaagccgtggctaattattccgccatcccgacaacgattgggggactcagattcgagcgctctcatgacagccagggcaagatctccgggtctcccctggatatcaccgctattcggggcagcttttccgtgaactacagaggacttcgcctgtctctcagcgagatcacagctacctgcacaggcgaagtcaccaatgtgtccgggtgctacagctgtatgacgggagccaaagtttctattaagctgcactccagcaaaaactctaccgcccatgtgagatgcaagggcgacgagacagcgttctccgtcctggaaggggtgcacagctataccgtttccctttcttttgatcacgccgtggtcgacgagcagtgtcagctcaattgcggaggccatgaaagccaagtgacactgaaggggaacctgatcttcctcgacgttcctaaatttgtggatggatcctacatgcagacctatcacagcacggtccccacaggcgctaatattccttctcccaccgactggctgaacgcccttttcggcaatgggctgtcccggtggatcctcggagtgatcggcgtgctgcttgggggacttgccctctttttcatgattatgagcctgtttaagctgggcacaaaacaggtcttccgctctagaaccaagctcgcttga

SEQ ID NO: 14794 - RNA, 3222 nt, synthetic construct
  misc_feature 1..3222: note = derived and/or modified CDS sequence (opt5) from SFTSV(LN2012-14)__KF887436.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgcgcaccgtctcctgtctcatgggcaagctgatggatagagggagacaggtgattcatgaggaaatcggagagaaccgggagggcaatcaggacgatgtttggattgaaatggcccgcccccggagagtgcgctattggatgtacagccctgtcatccttacaattctggccgtggggctcgctgagtcttgcgacgaaatggtgcacgcggatagcaaactggtttcctgtcggcagggaagcggcaacatgaaggagtgcgtcacgaccgggagagcccttctgcccgctgtgaatcctggccaagaggcctgtctccatttcacagcccccggatctccggactccaagtgcctgaaaatccgcgtgaagcggatcaacctgaaatgtaagaaaagctcctcttattttgtccctgatgctagaagccgctgcacctccgtgcggagatgtcgctgggccggcgactgccagtctgggtgtccccctcacttcacaagcaattccttttctgacgattgggttggaaagatggaccgggcgggcctcgggttcagcggatgctccgatggctgcgggggcgctgcctgtggatgctttaacgccgctcccagctgtattttctggagaaagtgggtggaaaatcctcatggcatcatttggaaagtctctccctgcgccgcttgggtgccgtccgccgttatcgagctgaccatgcctagcggggaagtgcggacgttccaccccatgtctggcattcccacacaggtctttaagggagtgtccgttacctaccttgggagcgacatggaggtgtctggactgaccgatctctgtgaaatcgaggagctgaaatccaagaaactggcgcttgccccttgcaaccaggctggcatgggcgtcgtggggaaggtgggagaaatccaatgtagctccgaggaaagcgcccgcacaattaaaaaggacggctgcatctggaacgctgatctcgtcgggattgagctgagagttgacgatgccgtgtgttattctaagatcaccagcgtggaagcggtcgccaattactccgctattccgacaacgatcggaggcctgcggttcgagagatctcacgacagccaggggaaaatctccggatctcccctcgatattaccgccatccgcggcagcttttccgtgaactaccggggcctgagactttctctgagcgagattacagctacctgcacaggggaagttaccaatgtgtccggatgctatagctgtatgacgggcgccaaggtctctatcaaactccattccaacaagaatagcaccgcccacgtgcgctgcaaaggggacgagacagctttctctgttctggaaggagtgcattcctacaccgtcagcctgtcctttgatcacgcggtggttgacgagcagtgtcagcttaactgcggcgggcacgaatctcaagtgacactcaagggaaatctgattttcctggacgtccctaagtttgtggatggcagctatatgcagacctaccattccacggtgcccacaggcgccaacatccctagccccaccgactggctcaatgctctgttcgggaacggactttctagatggatcctgggcgtcattggggttctcctgggaggcctggccctgtttttcatgatcatgtccctctttaaactggggacaaaacaggtgttccggagccgcaccaagctggcctga

SEQ ID NO: 14795 - RNA, 3222 nt, synthetic construct
  misc_feature 1..3222: note = derived and/or modified CDS sequence (opt5) from SFTSV(LN2012-34)__KF887437.1__GP
  source 1..3222: mol_type = other RNA
atgatgaaggtgatctggttctttagcctgatttgcttcgtcatccagtgttccggcgactctgggcccattatctgcgccggacctattcacagcaacaaatccgctgatatcccgcatctcctgggctactctgagaagatctgtcaaattgacagacttatccacgttagctcctggctgcggaatcattctcagtttcaggggtatgtgggacagcgcggcgggagaagccaagtgtcctactatcccgccgaaaacagctactctcggtggtccggactcctgagcccttgcgatgcggactggcttggcatgctggtcgtgaaaaaggctaaaggctctgatatgattgttcccgggccttcctataagggaaaggtgttctttgagcgccccaccttcgacggctacgtcgggtggggatgtggcagcgggaaatctagaacagaatccggagagctctgcagctccgattctggcacgagctccggcctgctgcctagcgaccgggtgctctggatcggggatgttgcctgtcagccgatgacccccattcctgaagagacatttctggagcttaagtctttctcccagagcgaatttcccgacatctgcaaaattgatggaatcgtgttcaatcagtgtgagggcgaatctctgcctcaaccctttgacgtcgcctggatggatgtggggcacagccataagatcattatgcgcgagcacaaaaccaagtgggtgcaggagtcctctagcaaggacttcgtctgctataaagaaggaacaggcccgtgttccgagagcgaagagaagacctgcaaaacatctgggtcctgcagaggagacatgcagttttgtaaggttgctggctgcgaacacggcgaggaggccagcgaagctaaatgtcggtgctctctcgtgcataagcctggggaggtggtcgtgtcctacggaggcatgcgcatcagacccaaatgttacgggttcagccggatgatggccaccctggaagttaaccagcctgagcaacgcattggacagtgcacgggctgtcaccttgaatgcatcaatgggggcgtgagactgattaccctcacatccgagctgaagtctgcgaccgtctgtgccagccatttctgctcctctgctacaagcggaaagaaatccaccgagatccagtttcacagcggctctctggtggggaagacggccatccacgttaaaggagctctcgtggatggcacagagttcacctttgaagggtcctgtatgttccccgacggatgcgatgccgtcgactgcacattttgtcgggagttcctgaagaacccccaatgctatcctgcgaaaaagtggctttttattatcattgtgatcctgctcggctacgccgggctgatgcttctgaccaatgtcctcaaggctattggcatctggggaagctgggtgatcgccccggttaaactgattttcgctatcattaagaaactgatgcgcaccgtgtcttgtctcatgggcaagctgatggatagagggcggcaggtcatccatgaagaaattggagagaacagagagggcaatcaggacgatgtgcgcatcgaaatggcccggcccagacgcgttcggcactggatgtattcccctgtgattcttacaatcctggccatcgggctcgctgagagctgcgacgaaatggtccatgcggattctaaactggtgagctgtagacagggatccggcaacgtgaaggagtgcgttacgaccgggcgcgcccttctgcccgctgtcaatcctggccaagaggcctgtctccactttacagcccccggaagcccggactctaagtgcctgaaaattcgggtgaagagaatcaacctgaaatgtaagaaatccagctcctacttcgtgcctgatgctcgctctcggtgcaccagcgtcagacgctgtcggtgggccggcgactgccagtccgggtgtccccctcattttacatctaatagcttctccgacgattgggcgggaaagatggacagagctggcctcgggttttctggatgcagcgatggctgcgggggcgccgcctgtggatgcttcaacgctgccccctcctgtattttctggcggaagtgggtggaaaatcctcacggcatcatttggaaagttagcccctgcgctgcctgggtgccgtctgcggtcatcgagctgaccatgccttccggggaagtgcgcacgtttcaccccatgagcggaatccccacacaggttttcaagggcgtgtctattacctatcttgggtccgacatggaggtcagcggactgaccgatctctgtgaaatcgaggagctgaaatctaagaaactggcccttgctccttgcaaccaggccggcatgggcgtggttgggaaggtgggagaaattcaatgttccagcgaggaatccgctagaacaatcaaaaaggacggctgcatttggaacgccgatctcgtcgggatcgagctgcgggtggacgatgcggtgtgttacagcaagatcacctctgtcgaagccgttgctaattatagcgccattccgacaacgatcggaggcctgagatttgagcgctcccatgactctcaggggaaaattagcggatctcccctcgatatcaccgctattcggggctccttcagcgtgaactacagaggcctgcgcctttccctgtctgagatcacagctacctgcacaggggaagtgaccaatgtcagcggatgctactcctgtatgacgggcgccaaggtgagcatcaaactccactctaacaaaaattccaccgcccatgttagatgcaagggggacgagacagcgtttagcgtgctggaaggagtccactcttataccgtgtccctgagcttcgatcacgccgttgtggacgagcagtgtcagcttaactgcggcgggcatgaatcccaagtcacactcaagggaaatctgatttttctggacgtgcctaagttcgttgatggctcttacatgcagacctatcacagcacggtgcccacaggcgctaacatcccttcccccaccgactggctcaatgccctgtttgggaacggacttagccggtggattctgggcgtcatcggggtgctcctgggaggcctggcccttttctttatgattatgtctctcttcaaactggggacaaaacaggtgtttcgctccagaaccaagctggcttga

SEQ ID NO: 14796 - RNA, 3222 nt, synthetic construct
  misc_feature 1..3222: note = derived and/or modified CDS sequence (opt5) from SFTSV(LN2012-41)__KF887438.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgcgcaccgtctcctgtctcatgggcaagctgatggatagagggagacaggtgattcatgaggaaatcggagagaaccgggagggcaatcaggacgatgttcgcattgaaatggcccggcccagacgcgtgcggcactggatgtatagccctgtcatccttacaattctggccatcgggctcgctgagtcttgcgacgaaatggtgcatgcggatagcaaactggtgtcctgtagacagggaagcggcaacgttaaggagtgcgtcacgaccgggcgcgcccttctgcccgctgtgaatcctggccaagaggcctgtctccacttcacagcccccggatctccggactccaagtgcctgaaaatccgggtgaagagaattaacctgaaatgtaagaaaagctcctcttactttgtccctgatgctcgcagccggtgcacctccgtgagacgctgtcggtgggccggcgactgccagtctgggtgtccccctcatttcacaagcaattccttttctgacgattgggcgggaaagatggacagagctggcctcgggttcagcggatgctccgatggctgcgggggcgccgcctgtggatgctttaacgctgcccccagctgtatcttctggcggaagtgggttgaaaatcctcacggcattatctggaaagtgtctccctgcgctgcctgggtcccgtccgcggtgattgagctgaccatgcctagcggggaagttcgcacgttccaccccatgtctggaatccccacacaggtgtttaagggcgtctccgtgacctatcttgggagcgacatggaggtttctggactgaccgatctctgtgaaatcgaggagctgaaatccaagaaactggcccttgctccttgcaaccaggccggcatgggcgtggtcgggaaggtgggagaaattcaatgtagctccgaggaaagcgctagaacaatcaaaaaggacggctgcatttggaacgccgatctcgtggggatcgagctgcgggtcgacgatgcggtttgttactctaagattaccagcgtggaagccgtggtcaattattccgctatcccgacaacgatcggaggcctgagattcgagcgctctcatgacagccaggggaaaatttccggatctcccctcgatatcaccgccattcggggcagcttttccgtgaactacagaggcctgcgcctttctctgagcgagatcacagctacctgcacaggggaagttaccaatgtgtccggatgctacagctgtatgacgggcgccaaggtctctattaaactccactccaacaagaatagcaccgcccatgtgagatgcaaaggggacgagacagctttctctgttctggaaggagtgcactcctataccgtcagcctgtcctttgatcacgcggtggttgacgagcagtgtcagcttaactgcggcgggcatgaatctcaagtgacactcaagggaaatctgatcttcctggacgtccctaagtttgtggatggcagctacatgcagacctatcactccacggtgcccacaggcgccaacatccctagccccaccgactggctcaatgctctgttcgggaacggactttctcggtggattctgggcgtcatcggggttctcctgggaggcctggccctgtttttcatgattatgtccctctttaaactggggacaaaacaggtgttccgcagcagaaccaagctggcctga

SEQ ID NO: 14797 - RNA, 3222 nt, synthetic construct
  misc_feature 1..3222: note = derived and/or modified CDS sequence (opt5) from SFTSV(LN2012-58)__KF887440.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgagggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgtccaacgcatcggacagtgcacgggctgtcaccttgagtgcattaatgggggcgtgagactgatcaccctcacatctgaacttaagagcgcgaccgtttgtgcctcccatttctgctctagcgctacatccggaaagaaaagcaccgagattcagttccactctggctccctggtggggaagacggccatccacgtcaaaggagctctcgtggatggcacagagtttaccttcgaagggagctgtatgtttcccgacggatgcgatgccgtcgactgcacattctgtcgggagtttctgaagaacccccaatgctatcctgcgaaaaagtggcttttcatcattatcgtgattctgctcggctacgccgggctgatgcttctgaccaatgttctcaaggctatcggcatttggggatcttgggtgatcgccccggtcaaactgatctttgctattatcaagaaactgatgcgcaccgtgtcctgtctcatgggcaagctgatggatagagggcggcaggttattcatgaagagatcggagaaaacagagagggcaatcaggacgatgtgcgcattgagatggcccggcccagacgcgtccggcactggatgtatagccctgtgatccttacaattctggtgatggggctcgccgaatcttgcgacgagatggttcatgctgatagcaaactggtctcctgtagacagggaagcggcaacatgaaggaatgcgtgacgaccgggcgcgcgcttctgcccgccgtgaatcctggccaagaggcttgtctccacttcacagcccccggatctccggactccaagtgcctgaaaatcaaggtcaaacggatcaacctgaagtgtaaaaagagctcctcttactttgtgcctgatgccagaagccgctgcacctccgttcggagatgtcgctgggctggcgactgccagtctgggtgtccccctcatttcacaagcaattccttttctgacgattgggccggaaagatggaccgggcgggcctcgggttcagcggatgctccgatggctgcgggggcgctgcctgtggatgctttaacgccgctcccagctgtattttctggagaaaatgggtggagaatcctcacggcatcatttggaaggtctctccctgcgccgcttgggtgccgtccgccgttatcgaactgaccatgcctagcggggaggtgcggacgttccaccccatgtctggcattcccacacaggtctttaaaggagtgtccgttacctatcttgggagcgacatggaagtgtctggactgaccgatctctgtgagatcgaagaactgaagtccaaaaagctggcgcttgccccttgcaaccaggctggcatgggcgtcgtggggaaagtgggagagatccaatgtagctccgaagagagcgcccgcacaattaagaaggacggctgcatctggaacgctgatctcgtcgggattgaactgagagttgacgatgccgtgtgttactctaaaatcaccagcgtggaggcggtcgccaattattccgctattccgacaacgatcggaggcctgcggttcgaaagatctcatgacagccaggggaagatctccggatctcccctcgatattaccgccatccgcggcagcttttccgtgaactaccggggcctgagactttctctgagcgagattacagctacctgcacaggggaggttaccaatgtgtccggatgctacagctgtatgacgggcgccaaagtctctatcaagctccactccagcaaaaactctaccgcccatgtgcgctgcaagggggacgaaacagctttctccgttctggagggagtgcacagctataccgtctccctgtcttttgatcacgcggtggttgacgaacagtgtcagcttaattgcggcgggcatgagagccaagtgacactcaagggaaacctgattttcctggacgtccctaaatttgtggatggctcctacatgcagacctatcacagcacggtgcccacaggcgccaatatcccttctcccaccgactggctcaacgctctgttcgggaatggactttccagatggatcctgggcgtcattggggttctcctgggaggcctggccctgtttttcatgatcatgagcctctttaagctggggacaaaacaggtgttccggtctcgcaccaagctggcctga

SEQ ID NO: 14798 - RNA, 3222 nt, synthetic construct
  misc_feature 1..3222: note = derived and/or modified CDS sequence (opt5) from SFTSV(NB24/CHN/2013)__KR698337.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctgatatcccgcatctgcttggctactctgagaagatctgtcaaattgacagactgatccacgttagctcctggctccggaatcattctcagtttcaggggtatgtgggacagcgcggcgggagaagccaagtgtcctactatcccgccgaaaacagctactctcggtggtccggactgcttagcccttgcgatgcggactggctgggcatgctcgtcgtgaaaaaggctaaaggctctgatatgattgttcccgggccttcctataagggaaaggtgttctttgagcgccccacattcgacggctacgtcgggtggggatgtggcagcgggaaatctagaacggaatccggagagctgtgcagctccgattctggcaccagctccggcctgctccctagcgaccgggtgctgtggatcggggatgttgcctgtcagccgatgacacccattcctgaagagacctttcttgagctgaagtctttctcccagagcgaatttcccgacatctgcaaaattgatggaatcgtgttcaatcagtgtgagtctgaaagcctccctcaaccctttgacgtcgcctggatggatgtgggccactcccataagatcattatgcgcgagcacaaaacaaagtgggtgcaggagtctagctccaaggacttcgtctgctataaagaagggaccggaccgtgtagcgagtctgaagagaagacatgcaaaacctccggcagctgcagaggggacatgcagttttgtaaggttgctggatgcgaacacggcgaggaggcctctgaagctaaatgtcggtgctccctggtgcataagcctggcgaggtggtcgtgagctacgggggaatgcgcgttagacccaaatgttacggcttctcccggatgatggccacgcttgaagtgaaccctcccgagcagcgcatcgggcaatgcaccggatgtcacctggaatgcgtcaatggcggggtgagactcattacactgacctctgagcttaagagcgcgacagtttgtgcctcccatttttgctctagcgctacctccggcaagaaaagcacggagatccagttccactctggatccctcgtgggcaagacagccattcacgtcaaaggggctctggtggatggaaccgagttcacatttgaaggcagctgtatgttccccgacgggtgcgatgccgtcgactgcaccttttgtcgggagttccttaagaaccctcagtgctatccggcgaaaaagtggctgtttatcaatatcgtgattctcctgggatacgccggccttatgctgctcaccaacgttctgaaggctatcggggtgtggggctcttgggtcattgcccccgtgaaactgatgttcgctatcattaagaaactcatgcgctccgttagctgtctgatgggaaagctgatggatagaggccggcaagtgatccatgaagaaatcggggagaatagagagggaaaccaggacgatgtccgcattgaaatggcccggcctagacgcgtgcggcactggatgtattctcccgtgatcctgacaattctcgccgttggcctggctgaggggtgcgacgaaatggtccatgcggatagcaaacttgtgtcctgtaagcagggaagcggcaatatgaaggagtgcgtgacgaccgggagagccctgctccctgctgtcaaccccggccaggaggcctgtctgcactttacagccccgggatctcctgactccaaatgcctgaagatcaaagtgaagaaaattaatctcaagtgtaagaaaagctcctcttacttcgttcccgatgctcgcagccggtgcacctccgtgagacgctgtcggtgggccggcgactgccaatctgggtgccctagccattttacatccaactctttcagcgacgattgggcgggaaagatggacagagctggcctggggttttccggatgtagcgatggctgcgggggcgccgcctgtggatgcttcaatgctgccccctcttgtatcttttggcgcaaatgggtcgaaaaccctcacggcattatctggaaggtgtccccctgcgctgcctgggttccgagcgcggtgatcgagcttaccatgccttctggggaagtccggacgttccaccccatgtccggcattcccacacaggtgttcaaaggagttagcgtgacctatctggggtctgacatggaggtctccggactcaccgatctgtgtgaaatcgaggagcttaagagcaaaaagctggccctcgctccttgcaaccaggccggcatgggcgtggtggggaaggtcggagaaattcagtgttccagcgaggaatctgctagaacaatcaaaaaggacggctgcatttggaatgccgatctggttgggatcgagctgcgggtggacgatgcggtgtgttacagcaaaatcacctccgtcgaagccgtggctaactattctgccattccgacaacgatcggaggcctccgctttgagagaagccatgactcccaagggaagatttctggaagccccctggatatcaccgctattcggggctccttctctgttaattacagaggccttcgcctgagcctctccgagatcacagctacctgcacaggggaagtgaccaacgtcagcggatgctactcttgtatgacgggcgccaaagtgtccatcaagctgcacagcaataagaactctaccgcccatgttcggtgcaaaggggacgagacagcgttttccgtgctggaaggagtccacagctataccgtgtccctttctttcgatcacgccgttgtggacgagcagtgtcagctcaattgcggcgggcatgaaagccaggtcacactgaagggaaacctgatttttctcgacgtgcctaaattcgtggatggctcctacatgcaaacctatcacagctctgtccccacgggcgctaatatcccttcccccacagactggctgaacgccctttttgggaatggactgagcagatggattctcggcgttatcggggtgctgctgggaggccttgccctcttctttctgattatgtctctgttcaagctcgggaccaaacaggtgtttcgcagcagatccaagctggcttga

SEQ ID NO: 14799 - RNA, 3222 nt, synthetic construct
  misc_feature 1..3222: note = derived and/or modified CDS sequence (opt5) from SFTSV(NB31/CHN/2013)__KR698338.1__GP
  source 1..3222: mol_type = other RNA
atgatgaaggtgatctggttcagctccctgatttgctttgtcatccagtgttctggcgacaccgggcccattatctgcgccggacctattcacagcaacaaatccgctaatatcccgcatctcctgggctactctgagaagatctgtcaaattgatagacttatccacgttagctcctggctgcggaaccattctcagttccaggggtatgtgggacagcgcggcgggagaagccaagtgtcctactatcccagcgaaaattctaactcccggtggagcggactcctgtctccttgcgacgccgattggcttggcatgctggtcgtgaaaaaggcgaaaggctccgacatgattgttcccgggcctagctacaagggaaaggtgtttttcgagcgccccacatttgatggctatgtcgggtggggatgtggctctgggaaatccagaacggaaagcggagagctctgctcctctgacagcggcacctccagcggcctgctgccttctgatcgggtgctctggatcggggacgttgcttgtcagccgatgacacccattcctgaagagaccttcctggagcttaagtcctttagccagtctgaatttcccgatatctgcaaaattgacggaatcgtgtttaatcagtgtgagagcgaatccctgcctcaacccttcgatgtcgcctggatggacgtgggccactctcataagatcattatgcgcgagcacaaaacaaagtgggtgcaggagagctccagcaaggattttgtctgctacaaagaagggaccggaccgtgttctgagtccgaagagaagacatgcaaaaccagcggctcttgcagaggggacatgcagttctgtaaggttgccggatgcgaacacggcgaggaggcttccgaagccaaatgtcggtgcagcctcgtgcataagcctggcgaggtggtcgtgtcctatgggggaatgcgcgttagacccaaatgttacggcttttctcggatgatggctacgctggaagtgaaccctcccgagcagcgcatcgggcaatgcaccggatgtcaccttgaatgcattaatggcggggtcagactgatcacactcaccagcgagctgaagtccgccacagtgtgtgcgtctcatttctgcagctccgccaccagcggcaagaaaaacacggagattcagttccactctggatccctggttggcaagacagtgatccacgtcaaaggggctctcgtggacggaaccgaatttacattcgagggcagctgtatgtttcccgatgggtgcgaagccgtcgactgcaccttctgtcgggagtttctgaagaatcctcagtgctacccggctaaaaagtggcttttcatcattatcgtgattctgctcggatatgccggcctgatgcttctgaccaacgttctcaaggcgatcggggtgtggggctcttgggtcattgcccccgtgaaactgatgtttgctatcatcaagaaactgatgcgctccgttagctgtctcatgggaaagctgatggatagaggccggcaagtgattcatgaagagatcggggagaatagagaaggaaaccgcgacgatgtccggattgagatggccagacctcgccgggtgagacactggatgtactctcccgtgatccttacaattctggctatcggcctcgccgaagggtgcgacgagatggttcatgccgatagcaaactggtctcctgtaagcagggaagcggcaatatgaaggagtgcgtgacgaccgggcgcgtgcttctgcctgctgtcaaccccggccaggaagcgtgtctccacttcacagccccgggatctcctgactccaaatgcctgaagattaaagtgaagcggatcaatctgaaatgtaagaagtcctcctcttattttgttcccgatgctagaagccgctgcacctccgtgcggagatgtcgctgggccggcgactgccagtctgggtgccctagccatttcacatccaactcttttagcgatgactgggccggaaaaatggaccgggctggcctcgggttctccggatgtagcgatggctgcgggggcgccgcgtgtggatgctttaacgctgccccctcttgtatcttctggagaaagtgggtcgagaatcctcacggcattatctggaaagtgtccccctgcgccgcttgggttccgagcgccgtgattgaactgaccatgccttctggggaggtccggacgttccaccccatgtccggaatccccacacaagtgtttaagggcgttagcgtgacctaccttgggtctgacatggaagtctccggactgaccgatctctgtgagattgaggaactgaaaagcaagaaactggctcttgccccttgcaaccaggcgggcatgggcgtggtggggaaggtcggagagatccagtgttccagcgaagagtctgcccgcacaatcaagaaagacggctgcatttggaatgctgatctcgttgggatcgaactgagagtggacgatgccgtgtgttatagcaagattacctccgtcgaggctgtggccaactactctgcgatcccgacaacgattggaggcctgcggttcgagagaagccatgactcccaggggaaaatctctggaagccccctcgatatcaccgccattcgcggctccttttctgttaattatcggggcctgagacttagcctgtccgaaatcacagctacctgcacaggggaggtgaccaacgtcagcggatgctactcttgtatgacgggcgccaaggtgtccattaaactccacagctctaagaatagcaccgctcatgttcgctgcaagggggacgaaacagccttcagcgtgctggagggagtccactcctacaccgtgtctctgagctttgatcacgccgttgtggacgaacaatgtcagcttaactgcggcgggcatgagtcccaggtcacactcaaaggaaatctgatcttcctggatgtgcctaagtttgtggacggcagctatatgcagacctaccactcttccgtccccacgggcgctaacattcctagccccacagactggctcaatgcgctgttcgggaacggactttctagatggatcctgggcgttgtgggggtgctcctgggaggcctggtccttttcttcctcatcatgagcctgtttaaactggggaccaagcaagtgttccggtcccgcacaaaactcgcctga

SEQ ID NO: 14800 - RNA, 3222 nt, synthetic construct
  misc_feature 1..3222: note = derived and/or modified CDS sequence (opt5) from SFTSV(NB38/CHN/2013)__KR698341.1__GP
  source 1..3222: mol_type = other RNA
atgatgaaggtgatctggttcagctccctgatttgcctcgtcatccagtgtggcggggacacctctcccattatctgcgccggacctattcacagcaacaaatccgctgatatcccgcatctgcttggctactctgagaagatctgtcaaattgacagactgatccacgttagctcctggctccggaatcattctcagtttcaggggtatgtgggacagcgcggcgggagaagccaagtgtcctactatcccgccgaaaacagctactctcggtggtccggactgcttagcccttgcgatgcggactggctgggcatgctcgtcgtgaaaaaggctaaaggctctgatatgattgttcccgggccttcctataagggaaaggtgttctttgagcgccccacattcgacggctacgtcgggtggggatgtggcagcgggaaatctagaacggaatccggagagctgtgcagctccgattctggcaccagctccggcctgctccctagcgaccgggtgctgtggatcggggatgttgcctgtcagccgatgacacccattcctgaagagacctttcttgagctgaagtctttctcccagagcgaatttcccgacatctgcaaaattgatggaatcgtgttcaatcagtgtgagggcgaatctctccctcaaccctttgacgtcgcctggatggatgtggggcacagccataagatcattatgcgcgagcacaaaacaaagtgggtgcaggagtcctctagcaaggacttcgtctgctataaagaaggaaccggcccgtgttccgagagcgaagagaagacatgcaaaacctctgggtcctgcagaggagacatgcagttttgtaaggttgctggctgcgaacacgaggaggaagccagcgaggctaaatgtcggtgctctctggtgcataagcctggcgaagtggtcgtgtcctacgggggaatgcgcgttagacccaaatgttacggcttcagccggatgatggccacgcttgaggtgaaccagcctgaacaacgcatcgggcagtgcaccggatgtcacctggagtgcatttccggcggggtcagactcatcacactgacctctgagcttaagagcgcgacagtgtgtgcctcccatttttgctctagcgctacctccggcaagaaaagcacggaaattcagttccactctggatccctcgttggcaagacagccatccacgtgaaaggggctctggtcgatggaaccgagttcacatttgaaggcagctgtatgttccccgacgggtgcgatgccgtggactgcaccttttgtcgggagttccttaagaatccccaatgctatcctgcgaaaaagtggctgtttatcattatcgtcattctcctgggatacgccggccttatgctgctcaccaacgtgctgaaggctatcggggtttggggctcttgggtgattgccccggtcaaactggtgttcgctatcatcaagaaactcatgcgcgccgtttcctgtctgatgggaaagctgatggatagaggcagacaggtgattcatgaagagatcggggagaatcgggaaggaaaccaggacgatgtccgcattgagatggcccggcccagacgcgtgcggcactggatgtatagccctgtgatcctgacaattctcgctatcggcctggcggaagggtgcgacgagatggttcatgccgattctaaacttgtcagctgtagacagggatccggcaatatgaaggagtgcgtgacgaccgggcgcgctctgctccccgccgtgaaccctggccaagaagcctgtctgcactttacagctcccggaagcccggactctaagtgcctgaaaattaaggtcaaacggatcaatctcaagtgtaaaaagtccagctcctacttcgtgcctgatgccagatctcgctgcaccagcgttcggagatgtcgctgggcgggcgactgccagtccgggtgtccccctcattttacatctaacagcttctccgacgattgggctggaaagatggaccgggccggcctggggttttctggatgcagcgatggctgcgggggcgccgcttgtggatgcttcaatgccgctccctcctgtatcttttggagaaaatgggtggagaaccctcacggcattatctggaaggtcagcccctgcgccgcgtgggtgccgtctgccgttattgaacttaccatgccttccggggaggtgcggacgttccaccccatgagcggaatccccacacaggtcttcaaaggcgtgtctgttacctatctggggtccgacatggaagtgagcggactcaccgatctgtgtgagatggaggaactgaagtctaaaaagctcgctcttgccccttgcaatcaggctggcatgggcgtcgtggggaaagtgggagagattcaatgttccagcgaagagtccgcccgcacaatcaagaaggacggctgcatctggaacgcggatctggtcgggattgaactgagagttgacgatgccgtgtgttacagcaaaatcacctctgtggaggctgtcgccaaccatagcgctattccgacaacgatcggaggcctccggtttgagagatcccacgactctcaggggaagattagcggatctcccctggatatcaccgccatccgcggctccttcagcgtgaattatcggggccttagactgtccctctctgaaattacagctacctgcacaggggaggttaccaacgtgagcggatgctactcctgtatgacgggcgccaaagtcagcatcaagctgcattcttccaaaaatagcaccgcgcacgtgcgctgcaagggggacgaaacagccttttctgttctggagggagtgcactcctacagcgtctccctttctttcgatcatgctgtggttgacgaacagtgtcagctcaactgcggcgggcacgagagcaaggtgaccctgagaggaaatctgatttttctcgacgtccctaaattcgtggatggctcctatatgcaaacataccatagcaccgtgcccacgggcgccaacatcccttctcccacagactggctgaatgccctttttgggaacggactgtcccggtggttcctcggcgtcattggggttctgctgggaggccttgctctctttttcctgatcatgagcctgtttaagctcgggaccaaacaggtgttccgctctagaagcaagctggcctga

SEQ ID NO: 14801 - RNA, 3222 nt, synthetic construct
  misc_feature 1..3222: note = derived and/or modified CDS sequence (opt5) from SFTSV(NB39/CHN/2014)__KR698342.1__GP
  source 1..3222: mol_type = other RNA
atgatgaaggtgatctggttcagctccctgatttgcctcgtcatccagtgttctggcgacaccgggcccattatctgcgccggacctattcacagcaacaagtccgctgatatcccgcatctgcttggctactctgagaagatctgtcaaattgacagactgatccacgttagctcctggctccggaatcattctcagtttcaggggtatgtgggacgcagaggcgggcggagccaggtgtcctactatcccgccgaaaacagctactctcgctggtccggactgcttagcccttgcgatgcggactggctgggcatgctcgtcgtgaaaaaggctaaaggctctgatatgattgttcccgggccttcctataagggaaaggtgttctttgagagacccacattcgacggctacgtcgggtggggatgtggcagcgggaaatctcggacggaatccggagagctgtgcagctccgattctggcaccagctccggcctgctccctagcgaccgcgtgctgtggatcggggatgttgcctgtcaaccgatgacacccattcctgaagagacctttcttgagctgaagtctttctcccagagcgaatttcccgacatctgcaaaattgatggaatcgtgttcaatcagtgtgagtctgaaagcctccctcagccctttgacgtcgcctggatggatgtgggccactcccataagatcattatgagagagcacaaaacaaagtgggtgcaagagtctagctccaaggacttcgtctgctataaagaagggaccggaccgtgtagcgagtctgaagagaagacatgcaaaacctccggcagctgccgcggggacatgcagttttgtaaggttgctggatgcgaacacggcgaggaggcctctgaagctaaatgtcggtgctccctggtgcataagcctggcgaggtggtcgtgagctacgggggaatgagagttcggcccaaatgttacggcttctcccgcatgatggccacgcttgaagtgaaccctcccgagcagagaatcgggcagtgcaccggatgtcacctggaatgcgtcaatggcggggtgcggctcattacactgacctctgagcttaagagcgcgacagtttgtgcctcccatttttgctctagcgctacctccggcaagaaaagcacggagatccaattccactctggatccctcgtgggcaagacagccattcacgtcaaaggggctctggtggatggaaccgaatttacatttgagggcagctgtatgttccccgacgggtgcgatgccgtcgactgcaccttttgtcgcgagttccttaagaaccctcagtgctatccggcgaaaaagtggctgtttatcatcattgtgatcctcctgggatacgccggccttatgctgctcaccaatgttctgaaggctattggggtgtggggctcttgggtcatcgcccccgtgaaactgatgttcgctattatcaagaaactcatgagatccgttagctgtctgatgggaaagctgatggatcggggcagacaggtgatccatgaagaaattggggagaaccgcgagggaaatcaagacgatgtccggatcgaaatggccagacctcgccgggtgagacactggatgtattctcccgtgattctgacaatcctcgccgttggcctggctgaggggtgcgacgaaatggtccatgcggatagcaaacttgtgtcctgtaagcagggaagcggcaacatgaaggagtgcgtgacgaccgggcgcgccctgctccctgctgtcaatcccggccaggaggcctgtctgcactttacagccccgggatctcctgacctgaaatgcctcaagattaaagtgaagaaaatcaacctgaagtgtaagaaatccagctcctacttcgttcccgatgctcggtctagatgcaccagcgtgcgccggtgtagatgggccggcgactgccagtccgggtgcccttctcattttacaagcaattccttctctgacgattgggcgggaaagatggaccgcgctggccttgggtttagcggatgttccgatggctgcgggggcgccgcctgtggatgcttcaacgctgcccccagctgtattttctggcggaaatgggtcgaaaatcctcacggcatcatctggaaggtgtctccctgcgctgcctgggttccgtccgcggtgattgagctgaccatgcctagcggggaagtcagaacgttccaccccatgtctggaatccccacacaagtgttcaaaggcgtttccgtgacctatctcgggagcgacatggaggtctctggactgaccgatctgtgtgaaattgaggagcttaagtccaaaaagctcgccctggctccttgcaaccaggccggcatgggcgtggtggggaaggtcggagaaatccagtgtagctccgaggaaagcgctcggacaattaaaaaggacggctgcatctggaacgccgatctggttgggatcgagctccgcgtggacgatgcggtgtgttactctaaaattaccagcgtcgaagccgtggctaattattccgccatcccgacaacgattggaggcctgagatttgagcggtctcatgacagccaggggaagatctccggatctccccttgatattaccgctatcagaggcagcttctccgttaactaccgcggcctgcggctctctctgagcgagatcacagctacctgcacaggggaagtgaccaatgtctccggatgctacagctgtatgacgggcgccaaagtgtctattaagctgcactccaacaagaatagcaccgcccatgttagatgcaaaggggacgagacagcgttttctgtgcttgaaggagtccactcctataccgtgagcctctccttcgatcacgccgttgtggacgagcaatgtcagctgaactgcggcgggcatgaatctcaggtcacactgaagggaaatctcatctttctggacgtgcctaaattcgtggatggcagctacatgcagacctatcactccagcgtccccacgggcgctaacattccttctcccacagactggcttaatgccctgtttgggaacggactctcccgctggatcctgggcgttattggggtgctgcttggaggcctcgccctgttctttctgatcatgagcctcttcaagctggggaccaaacaagtgtttagatctcggacaaaacttgcttga

SEQ ID NO: 14802 - RNA, 3222 nt, synthetic construct
  misc_feature 1..3222: note = derived and/or modified CDS sequence (opt5) from SFTSV(QD7)__KR706566.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcatcagacccaaatgttacgggttttcccggatgatggccaccctggaagttaaccagcctgagcaacgcattggacagtgcacgggctgtcaccttgaatgcatcaatgggggcgtgagactgattaccctcacatctgagctcaagagcgcgaccgtctgtgcctcccatttctgctctagcgctacatccggaaagaaaagcaccgagatccagttccactctggctccctggtggggaagacggccatccacgttaaaggagctctggtggatggcacagaatttaccttcgaggggagctgtatgtttcccgacggatgcgatgccgtcgactgcacattctgtcgggaatttctgaagaacccccaatgctatcctgcgaaaaagtggcttttcattatcattgtgatcctgctcggctacgccgggctgatgcttctgaccaatgtcctcaaggctattggcatctggggatcttgggtgatcgccccggttaaactgatgtttgctattatcaagaaactgatgcgcaccatgtcctgtctcatgggcaagctgatggatagagggagacaggtgattcatgaggaaatcggagagaaccgggagggcaatcaggacgatgtccgcattgaaatggcccggcccagacgcgtgcggcactggatgtatagccctgttatccttacattcctggccattgggctcgctgagtcttgcgacgaaatggtgcatgcggatagcaaactggcctcctgtagacagggaagcggcaacatgaaggagtgcgtcacgaccgggcgcgcccttcaccccgccgtgaatcctggccaagaggcctgtctgcattttacagctcccggatctccggactccaagtgcctcaaaatcaaggtgaaacggatcaacctgaagtgtaaaaagagctcctcttacttcgttcctgatgccagaagccgctgcacctccgtccggagatgtcgctgggcgggcgactgccagtctgggtgtccccctcactttacaagcaattccttctctgacgattgggctggaaagatggaccgggccggcctggggtttagcggatgctccgatggctgcgggggcgccgcttgtggatgcttcaacgccgctcccagctgtattttctggagaaaatgggtggaaaatcctcacggcatcatttggaaggtgtctccctgcgccgcgtgggtcccgtccgccgtgatcgagctcaccatgcctagcggggaagttcggacgtttcatcccatgtctggcattcccacacaggtgttcaaaggagtctccgtgacctatctggggagcgacatggaggtttctggacttaccgatctgtgtgaaatcgaggagctcaagtccaaaaagctggctctggccccttgcaaccaggctggcatgggcgtggtcgggaaagtgggagaaatccaatgtagctccgaggaaagcgcccgcacaattaagaaggacggctgcatctggaacgcggatcttgttgggattgagctcagagtggacgatgccgtctgttactctaaaatcaccagcgtggaagctgtggccaattattccgctattccgacaacgatcggaggcctgcggtttgagagatctcacgacagccaggggaagatctccggatctcccctggatattaccgccatccgcggcagcttctccgtcaactaccggggcctcagactgtctcttagcgagattacagctacctgcacaggggaagttaccaatgtgtccggatgctacagctgtatgacgggcgctaaagtgtctatcaagctgcattccagcaaaaactctaccgcgcacgtccgctgcaagggggacgagacagccttttccgtgctcgaaggagttcacagctataccgtgtccctgtctttcgatcatgctgtcgtggacgagcagtgtcagctgaattgcggcgggcacgaaagccaagttacacttaagggaaacctcatttttctggacgtgcctaaattcgtcgatggctcctacatgcagacctatcatagcacggtgcccacaggcgccaatatcccttctcccaccgactggctgaacgccctctttgggaatggactgtccagatggatccttggcgttattggggtgctgctcggaggcctggctctgttctttatgatcatgagccttttcaagctcgggacaaaacaggtctttcggtctcgcaccaagctggcctga

SEQ ID NO: 14803 - RNA, 3222 nt, synthetic construct
  misc_feature 1..3222: note = derived and/or modified CDS sequence (opt5) from SFTSV(Rodent01/NB/CHN/2014)__KR698343.1__GP
  source 1..3222: mol_type = other RNA
atgatgaaggtgatctggttcagctccctgatttgcctcgtcatccagtgttctggcgacaccgggcccattatctgcgccggacctattcacagcaacaagtccgctgatatcccgcatctgcttggctactctgagaagatctgtcaaattgacagactgatccacgttagctcctggctccggaatcattctcagtttcaggggtatgtgggacgcagaggcgggcggagccaggtgtcctactatcccgccgaaaacagctactctcgctggtccggactgcttagcccttgcgatgcggactggctgggcatgctcgtcgtgaaaaaggctaaaggctctgatatgattgttcccgggccttcctataagggaaaggtgttctttgagagacccacattcgacggctacgtcgggtggggatgtggcagcgggaaatctcggacggaatccggagagctgtgcagctccgattctggcaccagctccggcctgctccctagcgaccgcgtgctgtggatcggggatgttgcctgtcaaccgatgacacccattcctgaagagacctttcttgagctgaagtctttctcccagagcgaatttcccgacatctgcaaaattgatggaatcgtgttcaatcagtgtgagtctgaaagcctccctcagccctttgacgtcgcctggatggatgtgggccactcccataagatcattatgagagagcacaaaacaaagtgggtgcaagagtctagctccaaggacttcgtctgctataaagaagggaccggaccgtgtagcgagtctgaagagaagacatgcaaaacctccggcagctgccgcggggacatgcagttttgtaaggttgctggatgcgaacacggcgaggaggcctctgaagctaaatgtcggtgctccctggtgcataagcctggcgaggtggtcgtgagctacgggggaatgagagttcggcccaaatgttacggcttctcccgcatgatggccacgcttgaagtgaaccctcccgagcagagaatcgggcagtgcaccggatgtcacctggaatgcgtcaatggcggggtgcggctcattacactgacctctgagcttaagagcgcgacagtttgtgcctcccatttttgctctagcgctacctccggcaagaaaagcacggagatccaattccactctggatccctcgtgggcaagacagccattcacgtcaaaggggctctggtggatggaaccgaatttacatttgagggcagctgtatgttccccgacgggtgcgatgccgtcgactgcaccttttgtcgcgagttccttaagaaccctcagtgctatccggcgaaaaagtggctgtttatcatcattgtgatcctcctgggatacgccggccttatgctgctcaccaatgttctgaaggctattggggtgtggggctcttgggtcatcgcccccgtgaaactgatgttcgctattatcaagaaactcatgagatccgttagctgtctgatgggaaagctgatggatcggggcagacaggtgatccatgaagaaattggggagaaccgcgagggaaatcaagacgatgtccggatcgaaatggccagacctcgccgggtgagacactggatgtattctcccgtgattctgacaatcctcgccgttggcctggctgaggggtgcgacgaaatggtccatgcggatagcaaacttgtgtcctgtaagcagggaagcggcaacatgaaggagtgcgtgacgaccgggcgcgccctgctccctgctgtcaatcccggccaggaggcctgtctgcactttacagccccgggatctcctgacctgaaatgcctcaagattaaagtgaagaaaatcaacctgaagtgtaagaaatccagctcctacttcgttcccgatgctcggtctagatgcaccagcgtgcgccggtgtagatgggccggcgactgccagtccgggtgcccttctcattttacaagcaattccttctctgacgattgggcgggaaagatggaccgcgctggccttgggtttagcggatgttccgatggctgcgggggcgccgcctgtggatgcttcaacgctgcccccagctgtattttctggcggaaatgggtcgaaaatcctcacggcatcatctggaaggtgtctccctgcgctgcctgggttccgtccgcggtgattgagctgaccatgcctagcggggaagtcagaacgttccaccccatgtctggaatccccacacaagtgttcaaaggcgtttccgtgacctatctcgggagcgacatggaggtctctggactgaccgatctgtgtgaaattgaggagcttaagtccaaaaagctcgccctggctccttgcaaccaggccggcatgggcgtggtggggaaggtcggagaaatccagtgtagctccgaggaaagcgctcggacaattaaaaaggacggctgcatctggaacgccgatctggttgggatcgagctccgcgtggacgatgcggtgtgttactctaaaattaccagcgtcgaagccgtggctaattattccgccatcccgacaacgattggaggcctgagatttgagcggtctcatgacagccaggggaagatctccggatctccccttgatattaccgctatcagaggcagcttctccgttaactaccgcggcctgcggctctctctgagcgagatcacagctacctgcacaggggaagtgaccaatgtctccggatgctacagctgtatgattggcgccaaagtgtctatcaagctgcactccaacaagaatagcacggcccatgttagatgcaaaggggacgagaccgcgttttctgtgcttgaaggagtccactcctatacagtgagcctctccttcgatcacgccgttgtggacgagcaatgtcagctgaactgcggcgggcatgaatctcaggtcaccctgaagggaaatctcatttttctggacgtgcctaaattcgtggatggcagctacatgcagacatatcactccagcgtccccaccggcgctaacatcccttctcccacggactggcttaatgccctgtttgggaacggactctcccgctggattctgggcgttatcggggtgctgcttggaggcctcgccctgttctttctgatcatgagcctcttcaagctggggacaaaacaagtgtttagatctcggaccaaacttgcttga

SEQ ID NO: 14804 - RNA, 3222 nt, synthetic construct
  misc_feature 1..3222: note = derived and/or modified CDS sequence (opt5) from SFTSV(SDLZtick12/2010)__JQ684872.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcatcagacccaaatgttacgggttttcccggatgatggccaccctggaagttaaccagcctgagcaacgcattggacagtgcacgggctgtcaccttgaatgcatcaatgggggcgtgagactgattaccctcacatctgagctcaagagcgcgaccgtctgtgcctcccatttctgctctagcgctacatccggaaagaaaagcaccgagatccagttccactctggctccctggtggggaagacggccatccacgttaaaggagctctggtggatggcacagaatttaccttcgaggggagctgtatgtttcccgacggatgcgatgccgtcgactgcacattctgtcgggaatttctgaagaacccccaatgctatcctgcgaaaaagtggcttttcattatcattgtgatcctgctcggctacgccgggctgatgcttctgaccaatgtcctcaaggctattggcatctggggatcttgggtgatcgccccggttaaactgatgtttgctattatcaagaaactgatgcgcaccgtgtcctgtctcatgggcaagctgatggatagagggcggcaggtcattcatgaggaaatcggagagaacagagagggcaatcaggacgatgtgcgcattgaaatggcccggcccagacgcgttcggcactggatgtatagccctgtgatccttacattcctggccattgggctcgctgagtcttgcgacgaaatggtccatgcggatagcaaactggtgtcctgtagacagggaagcggcaacatgaaggagtgcgtgacgaccgggcgcgcccttctgcccgctgttaatcctggccaagaggcctgtctccactttacagcccccggatctccggactccaagtgcctgaaaatcaaggtcaaacggatcaacctgaagtgtaaaaagagctcctcttacttcgtgcctgatgctagaagccgctgcacctccgtgcggagatgtcgctgggccggcgactgccagtctgggtgtccccctcattttacaagcaattccttctctgacgattgggcgggaaagatggaccgggctggcctcgggtttagcggatgctccgatggctgcgggggcgccgcctgtggatgcttcaacgctgcccccagctgtattttctggagaaaatgggtcgaaaatcctcacggcatcatttggaaggtgtctccctgcgctgcctgggttccgtccgcggtgatcgagctgaccatgcctagcggggaagtccggacgtttcaccccatgtctggcattcccacacaggtgttcaaaggagtttccgtgacctatcttgggagcgacatggaggtctctggactgaccgatctctgtgaaatcgaggagctgaagtccaaaaagctggcccttgctccttgcaaccaggccggcatgggcgtggttgggaaagtgggagaaatccaatgtagctccgaggaaagcgctcgcacaattaagaaggacggctgcatctggaacgccgatctcgtcgggattgagctgagagtggacgatgcggtgtgttactctaaaatcaccagcgtcgaagccgttgctaattattccgccattccgacaacgatcggaggcctgcggtttgagagatctcatgacagccaggggaagatctccggatctcccctcgatattaccgctatccgcggcagcttctccgtgaactaccggggcctgagactttctctgagcgagattacagctacctgcacaggggaagtgaccaatgtctccggatgctacagctgtatgacgggcgccaaagtgtctatcaagctccactccagcaaaaactctaccgcccatgttcgctgcaagggggacgagacagcgttttccgtgctggaaggagtccacagctataccgtgtccctgtctttcgatcacgccgttgtggacgagcagtgtcagcttaattgcggcgggcatgaaagccaagtcacactcaagggaaacctgatttttctggacgtgcctaaattcgttgatggctcctacatgcagacctatcacagcacggtgcccacaggcgctaatatcccttctcccaccgactggctcaacgccctgtttgggaatggactttccagatggatcctgggcgtcattggggtgctcctgggaggcctggcccttttctttatgatcatgagcctcttcaagctggggacaaaacaggtgtttcggtctcgcaccaagctggcttga

SEQ ID NO: 14805 - RNA, 3222 nt, synthetic construct
  misc_feature 1..3222: note = derived and/or modified CDS sequence (opt5) from SFTSV(Zhao)__KF374684.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctccctcaaccctttgatgtcgcctggatggacgtgggccactcccataagatcattatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatgcagttttgtaaggttgctggatgcgaacacggcgaggaggcctctgaagctaaatgtcggtgctccctggtgcataagcctggcgaggtggtcgtgagctacgggggaatgcgcgttagacccaaatgttacggcttctcccggatgatggccacgcttgaagtgaatcctcccgagcagcgcatcgggcaatgcaccggatgtcacctggaatgcattaacggcggggtcagactcgtgacactgacctctgagcttaagagcgcgacagtttgtgcctcccatttttgctctagcgctacctccggcaagaaaagcacggagatccagttccactctggatccctcgtgggcaaggccgctattcacgtcaaaggggccctggtggacggaacagagttcacctttgaaggcagctgtatgttccccgatgggtgcgacgcggtcgattgcacattttgtcgggagttccttaagaatcctcagtgctatccggccaaaaagtggctgtttatcatcattgtgatcctcctgggatacgctggccttatgctgctcaccaacgttctgaaggccattggggtgtggggctcttgggtcatcgctcccgtgaaactgatgttcgccattatcaagaaactcatgcgctccgttagctgtctgatgggaaagctgatggacagaggccggcaagtgatccatgaagaaattggggagaatagagagggaaaccaggatgacgtccgcatcgaaatggtgcggcctagacgcgtgcggcactggatgtattctcccgttattctgaccatcctcgccattggcctgacagaggggtgcgatgaaatggtccatgctgacagcaaacttgtgtcctgtagacagggaagcggcaatatgaaggagtgcgtgacgaccgggcgcgcgctgctccctgccgtcaaccccggccaggaggcttgtctgcactttacagccccgggatctcctgattccaagtgcctgaaaatcaaggtgaaacggattaatctcaagtgtaaaaagagctcctcttacttcgttcccgacgccagaagccgctgcacctccgtgcggagatgtcgctgggctggcgattgccaatctgggtgccctagccattttacatccaactctttcagcgacgactgggccggaaagatggatcgggcgggcctggggttttccggatgtagcgacggctgcgggggcgctgcctgtggatgcttcaatgccgctccctcttgtatcttttggagaaaatgggtcgaaaaccctcacggcatcatttggaaggtgtccccctgcgccgcttgggttccgagcgccgtgatcgagcttaccatgccttctggggaagtccggacgttccaccccatgtccggcattcccacacaggtgttcaaaggagttagcgtgacctatctggggtctgatatggaggtctccggactcaccgacctgtgtgaaatcgaggagcttaagagcaaaaagctggcgctcgccccttgcaaccaggctggcatgggcgtggtggggaaagtcggagaaattcagtgttccagcgaggaatctgcccgcacaatcaagaaggatggctgcatctggaatgctgacctggttgggattgagctgagagtggatgacgccgtgtgttacagcaaaatcacctccgtcgaagcggtggccaactattctgctattccgacaacgatcggaggcctccggtttgagagaagccatgattcccaagggaaggtttctggaagccccctggacattaccgccatccgcggctccttctctgtgaattaccggggccttagactgagcctctccgagatcacagctacctgcacaggggaagtcaccaacgtgagcggatgctactcttgtatgacgggcgccaaagtttccattaagctgcacagctctaaaaattccaccgcccatgtgcgctgcaagggggatgagacagcttttagcgtcctggaaggagtgcactcctataccgtttctcttagcttcgaccacgcggtggtcgatgagcagtgtcagctcaactgcggcgggcatgaatcccaggtgacactgaagggaaatctgatctttctcgacgtgcctaaattcgtcgacggcagctacatgcaaacctatcactcttccgttcccacgggcgccaacattcctagccccacagattggctgaatgctctttttgggaacggactgtctagatggatcctcggcgtgattggggtgctgctgggaggccttgccctcttctttctgatcatgagcctgttcaagctcgggaccaaacaggtctttcggtcccgcacaaagctggcctga

SEQ ID NO: 14806 - RNA, 3222 nt, synthetic construct
  misc_feature 1..3222: note = derived and/or modified CDS sequence (opt5) from SFTSV(Zhejiang/01/2011)__KJ597824.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctccctcaaccctttgatgtcgcctggatggacgtgggccactcccataagatcattatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatgcagttttgtaaggttgctggatgcgaacacggcgaggaggcctctgaagctaaatgtcggtgctccctggtgcataagcctggcgaggtggtcgtgagctacgggggaatgcgcgttagacccaaatgttacggcttctcccggatgatggccacgcttgaagtgaatcctcccgagcagcgcatcgggcaatgcaccggatgtcacctggaatgcattaacggcggggtcagactcgtgacactgacctctgagcttaagagcgcgacagtttgtgcctcccatttttgctctagcgctacctccggcaagaaaagcacggagatccagttccactctggatccctcgtgggcaaggccgctattcacgtcaaaggggccctggtggacggaacagagttcacctttgaaggcagctgtatgttccccgatgggtgcgacgcggtcgattgcacattttgtcgggagttccttaagaatcctcagtgctatccggccaaaaagtggctgtttatcatcattgtgatcctcctgggatacgctggccttatgctgctcaccaacgttctgaaggccattggggtgtggggctcttgggtcatcgctcccgtgaaactgatgttcgccattatcaagaaactcatgcgctccgttagctgtctgatgggaaagctgatggacagaggccggcaagtgatccatgaagaaattggggagaatagagagggaaaccaggatgacgtccgcatcgaaatggtgcggcctagacgcgtgcggcactggatgtattctcccgttattctgaccatcctcgccattggcctgacagaggggtgcgatgaaatggtccatgctgacagcaaacttgtgtcctgtagacagggaagcggcaatatgaaggagtgcgtgacgaccgggcgcgcgctgctccctgccgtcaaccccggccaggaggcttgtctgcactttacagccccgggatctcctgattccaagtgcctgaaaatcaaggtgaaacggattaatctcaagtgtaaaaagagctcctcttacttcgttcccgacgccagaagccgctgcacctccgtgcggagatgtcgctgggctggcgattgccaatctgggtgccctagccattttacatccaactctttcagcgacgactgggccggaaagatggatcgggcgggcctggggttttccggatgtagcgacggctgcgggggcgctgcctgtggatgcttcaatgccgctccctcttgtatcttttggagaaaatgggtcgaaaaccctcacggcatcatttggaaggtgtccccctgcgccgcttgggttccgagcgccgtgatcgagcttaccatgccttctggggaagtccggacgttccaccccatgtccggcattcccacacaggtgttcaaaggagttagcgtgacctatctggggtctgatatggaggtctccggactcaccgacctgtgtgaaatcgaggagcttaagagcaaaaagctggcgctcgccccttgcaaccaggctggcatgggcgtggtggggaaagtcggagaaattcagtgttccagcgaggaatctgcccgcacaatcaagaaggatggctgcatctggaatgctgacctggttgggattgagctgagagtggatgacgccgtgtgttacagcaaaatcacctccgtcgaagcggtggccaactattctgctattccgacaacgatcggaggcctccggtttgagagaagccatgattcccaagggaagatttctggaagccccctggacatcaccgccatccgcggctccttctctgttaattaccggggccttagactgagcctctccgagattacagctacctgcacaggggaagtgaccaacgtcagcggatgctactcttgtatgacgggcgccaaagtgtccatcaagctgcacagctctaaaaattccaccgcccatgttcgctgcaagggggatgagacagcttttagcgtgctggaaggagtccactcctataccgtgtctcttagcttcgaccacgcggttgtggatgagcagtgtcagctcaactgcggcgggcatgaatcccaggtcacactgaagggaaatctgatttttctcgacgtgcctaaattcgtggacggcagctacatgcaaacctatcactcttccgtccccacgggcgccaacatccctagccccacagattggctgaatgctctttttgggaacggactgtctagatggattctcggcgttatcggggtgctgctgggaggccttgccctcttctttctgatcatgagcctgttcaagctcgggaccaaacaggtgtttcggtcccgcacaaagctggcctga

SEQ ID NO: 14807 - RNA, 3222 nt, synthetic construct
  misc_feature 1..3222: note = derived and/or modified CDS sequence (opt5) from SFTSV(ZJ2013-06)__KP280204.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctgatatcccgcatctgcttggctactctgagaagatctgtcaaattgacagactgatccacgttagctcctggctccggaatcattctcagtttcaggggtatgtgggacagcgcggcgggagaagccaagtgtcctactatcccgccgaaaacagctactctcggtggtccggactgcttagcccttgcgatgcggactggctgggcatgctcgtcgtgaaaaaggctaaaggctctgatatgattgttcccgggccttcctataagggaaaggtgttctttgagcgccccacattcgacggctacgtcgggtggggatgtggcagcgggaaatctagaacggaatccggagagctgtgcagctccgattctggcaccagctccggcctgctccctagcgaccgggtgctgtggatcggggatgttgcctgtcagccgatgacacccattcctgaagagacctttcttgagctgaagtctttctcccagagcgaatttcccgacatctgcaaaattgatggaatcgtgttcaatcagtgtgagtctgaaagcctccctcaaccctttgacgtcgcctggatggatgtgggccactcccataagatcattatgcgcgagcacaaaacaaagtgggtgcaggagtctagctccaaggacttcgtctgctataaagaagggaccggaccgtgtagcgagtctgaagagaagacatgcaaaacctccggcagctgcagaggggacatgcagttttgtaaggttgctggatgcgaacacggcgaggaggcctctgaagctaaatgtcggtgctccctggtgcataagcctggcgaggtggtcgtgagctacgggggaatgcgcgttagacccaaatgttacggcttctcccggatgatggccacgcttgaagtgaaccctcccgagcagcgcatcgggcaatgcaccggatgtcacctggaatgcgtcaatggcggggtgagactcattacactgacctctgagcttaagagcgcgacagtttgtgcctcccatttttgctctagcgctacctccggcaagaaaagcacggagatccagttccactctggatccctcgtgggcaagacagccattcacgtcaaaggggctctggtggatggaaccgagttcacatttgaaggcagctgtatgttccccgacgggtgcgatgccgtcgactgcaccttttgtcgggagttccttaagaaccctcagtgctatccggcgaaaaagtggctgtttatcaatatcgtgattctcctgggatacgccggccttatgctgctcaccaacgttctgaaggctatcggggtgtggggctcttgggtcattgcccccgtgaaactgatgttcgctatcattaagaaactcatgcgctccgttagctgtctgatgggaaagctgatggatagaggccggcaagtgatccatgaagaaatcggggagaatagagagggaaaccaggacgatgtccgcattgaaatggcccggcctagacgcgtgcggcactggatgtattctcccgtgatcctgacaattctcgccgttggcctggctgaggggtgcgacgaaatggtccatgcggatagcaaacttgtgtcctgtaagcagggaagcggcaatatgaaggagtgcgtgacgaccgggagagccctgctccctgctgtcaaccccggccaggaggcctgtctgcactttacagccccgggatctcctgactccaaatgcctgaagatcaaagtgaagaaaattaatctcaagtgtaagaaaagctcctcttacttcgttcccgatgctcgcagccggtgcacctccgtgagacgctgtcggtgggccggcgactgccaatctgggtgccctagccattttacatccaactctttcagcgacgattgggcgggaaagatggacagagctggcctggggttttccggatgtagcgatggctgcgggggcgccgcctgtggatgcttcaatgctgccccctcttgtatcttttggcgcaaatgggtcgaaaaccctcacggcattatctggaaggtgtccccctgcgctgcctgggttccgagcgcggtgatcgagcttaccatgccttctggggaagtccggacgttccaccccatgtccggcattcccacacaggtgttcaaaggagttagcgtgacctatctggggtctgacatggaggtctccggactcaccgatctgtgtgaaatcgaggagcttaagagcaaaaagctggccctcgctccttgcaaccaggccggcatgggcgtggtggggaaggtcggagaaattcagtgttccagcgaggaatctgctagaacaatcaaaaaggacggctgcatttggaatgccgatctggttgggatcgagctgcgggtggacgatgcggtgtgttacagcaaaatcacctccgtcgaagccgtggctaactattctgccattccgacaacgatcggaggcctccgctttgagagaagccatgactcccaagggaagatttctggaagccccctggatatcaccgctattcggggctccttctctgttaattacagaggccttcgcctgagcctctccgagatcacagctacctgcacaggggaagtgaccaacgtcagcggatgctactcttgtatgacgggcgccaaagtgtccatcaagctgcacagcaataagaactctaccgcccatgttcggtgcaaaggggacgagacagcgttttccgtgctggaaggagtccacagctataccgtgtccctttctttcgatcacgccgttgtggacgagcagtgtcagctcaattgcggcgggcatgaaagccaggtcacactgaagggaaacctgatttttctcgacgtgcctaaattcgtggatggctcctacatgcaaacctatcacagctctgtccccacgggcgctaatatcccttcccccacagactggctgaacgccctttttgggaatggactgagcagatggattctcggcgttatcggggtgctgctgggaggccttgccctcttctttctgattatgtctctgttcaagctcgggaccaaacaggtgtttcgcagcagaacaaagctggcttga

SEQ ID NO: 14808 - RNA, 3222 nt, synthetic construct
  misc_feature 1..3222: note = derived and/or modified CDS sequence (opt5) from SFTSV(ZJZHSH-AM/China/05/2012)__KR017846.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctccctcaaccctttgatgtcgcctggatggacgtgggccactcccataagatcattatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatccagttttgtaaggttgctggatgcgaacacggcgaggaggcctctgaagctaaatgtcggtgctccctggtgcataagcctggcgaggtggtcgtgagctacgggggaatgcgcgttagacccaaatgttacggcttctcccggatgatggccacgcttgaagtgaatcctcccgagcagcgcattgggcaatgcaccggatgtcacctggaatgcatcaacggcggggtcagactcattacactgacctctgagcttaagagcgcgacagtgtgtgcctcccatttttgctctagcgctacctccggcaagaaaagcacggagatccagttccactctggatccctcgttggcaaggccgctatccacgtgaaaggggccctggtcgacggaacagaatttacctttgagggcagctgtatgttccccgatgggtgcgacgcggtggattgcacattttgtcgggagttccttaagaatcctcagtgctatccggccaaaaagtggctgtttattatcattgtcatcctcctgggatacgctggccttatgctgctcaccaacgtgctgaaggccattggggtttggggctcttgggtgatcgctcccgtcaaactgatgttcgccatcattaagaaactcatgcgctccgtgagctgtctgatgggaaagctgatggacagaggccggcaagttatccatgaagaaattggggagaatagagagggaaaccaggatgacgtgcgcatcgaaatggtccggcctagacgcgtgcggcactggatgtattctcccgtgattctgaccatcctcgccattggcctgacagaggggtgcgatgaaatggttcatgctgacagcaaacttgtctcctgtagacagggaagcggcaatatgaaggagtgcgtgacgaccgggcgcgcgctgctccctgccgtgaaccccggccaggaggcttgtctgcactttacagccccgggatctcctgattccaagtgcctgaaaatcaaggtcaaacggatcaatctcaagtgtaaaaagagctcctcttacttcgtgcccgacgccagaagccgctgcacctccgttcggagatgtcgctgggctggcgattgccaatctgggtgccctagccattttacatccaactctttcagcgacgactgggccggaaagatggatcgggcgggcctggggttttccggatgtagcgacggctgcgggggcgctgcctgtggatgcttcaatgccgctccctcttgtattttctggagaaaatgggtggaaaaccctcacggcatcatttggaaggtctccccctgcgccgcttgggtgccgagcgccgttatcgagcttaccatgccttctggggaagtgcggacgttccaccccatgtccggcattcccacacaggtcttcaaaggagtgagcgttacctatctggggtctgatatggaggtgtccggactcaccgacctgtgtgaaatcgaggagcttaagagcaaaaagctggcgctcgccccttgcaaccaggctggcatgggcgtcgtggggaaagtgggagaaatccagtgttccagcgaggaatctgcccgcacaattaagaaggatggctgcatctggaatgctgacctggtcgggattgagctgagagttgatgacgccgtgtgttacagcaaaatcacctccgtggaagcggtcgccaactattctgctattccgacaacgatcggaggcctccggtttgagagaagccatgattcccaagggaagatctctggaagccccctggacattaccgccatccgcggctccttctctgtgaattaccggggccttagactgagcctctccgagattacagctacctgcacaggggaagttaccaacgtgagcggatgctactcttgtatgacgggcgccaaagtctccatcaagctgcacagctctaaaaattccaccgcccatgtgcgctgcaagggggatgagacagcttttagcgttctggaaggagtgcactcctataccgtctctcttagcttcgaccacgcggtggttgatgagcagtgtcagctcaactgcggcgggcatgaatcccaggtgacactgaagggaaatctgatttttctcgacgtccctaaattcgtggacggcagctacatgcaaacctatcactcttccgtgcccacgggcgccaacatccctagccccacagattggctgaatgctctttttgggaacggactgtctagatggatcctcggcgtcattggggttctgctgggaggccttgccctcttctttctgatcatgagcctgttcaagctcgggaccaaacaggtgtttcggtcccgcacaaagctggcctga

SEQ ID NO: 14809 - RNA, 3222 nt, synthetic construct
  misc_feature 1..3222: note = derived and/or modified CDS sequence (opt5) from SFTSV(ZJZHSH-CXD/China/05/2012)__KR017858.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgggatcccgcatctgcttggatactccgagaagatctgtcaaattgatagactgatccacgtttctagctggctccggaatcattcccagtttcagggctatgtggggcagcgcggaggcagatctcaagtgagctactatcccgccgaaaactcctacagccggtggtctggcctgctttccccttgcgacgcggattggctggggatgctcgtcgtgaaaaaggctaaaggaagcgacatgattgttcccggcccttcttataaggggaaggtgttctttgagcgccccacattcgatggatacgtcggctgggggtgtggatccggcaaaagcagaacggaatctggcgagctgtgctccagcgactccgggacctctagcggactgctcccttccgatcgggtgctgtggatcggcgacgttgcctgtcagccgatgacacccattcctgaagagacctttcttgagcttaagagcttctctcagtccgaatttcccgatgtgtgcaaaatcgacgggattgtcttcaatcagtgtgagggagaaagcctccctcaaccctttgatgtggcctggatggacgtgggccactctcataagatcatcatgcgcgagcacaaaacaaagtgggtccaggagagctcctctaaggatttcgtttgctataaagaagggaccggaccgtgtagcgagtccgaagagaagacatgcaaaaccagcggctcttgcagaggcgacatgcagttttgtaaggtggctgggtgcgaacacggagaggaggcctccgaagctaaatgtcggtgcagcctggtgcataagcctggcgaggtcgtggtttcttacgggggaatgcgcgtgagacccaaatgttacggcttctcccggatgatggccacgcttgaagtcaaccctcccgagcagcgcattgggcaatgcaccggctgtcacctggaatgcatcaatggaggcgtgagactcattacactgaccagcgagctgaagtccgcgacagtttgtgcctctcatttttgcagctccgctacctctgggaagaaaagcacggagatccagttccactccggaagcctcgtgggcaagacagccattcacgtcaaaggggctctggtggacggaaccgagttcacatttgaaggctcttgtatgttccccgatgggtgcgacgccgtcgattgcaccttttgtcgggagttccttaagaaccctcagtgctatccggcgaaaaagtggctgtttatcatcattgtgatcctcctgggctacgccggacttatgctgctcaccaatgttctgaaggctattggcgtgtgggggtcctgggtcatcgcccccgtgaaactggttttcgctattatcaagaaactcatgcgcgccgtgagctgtctgatgggaaagctgatggacagaggccggcaagtcatccatgaagaaattggggagaacagagagggaaatcagaacgatgtgcgcatcgaaatggcccggcctagacgcgtgcggcactggatgtattctcccgttattctgacaatcctcgctattggctttgcggaggggtgcgacgaaatggtccatgccgattccaaactggtgagctgtagacagggctctgagaatatgaaggagtgcgtgacgaccggacgcgcccttctgcctgccgtcaaccccggccaggaagcctgtctccacttcacagctccggggagccctgactccaagtgcctgaaaatcaaggtgaaacggattaatctgaagtgtaaaaagtctagctcctactttgttcccgatgccagaagccgctgcacctccgtgcggagatgtcgctgggcgggagactgccaatctggctgccctccccatttcacaagcaactccttttctgatgactgggctgggaagatggaccgggccggactcggcttcagcgggtgttccgatggctgcggaggcgccgcttgtgggtgctttaatgccgctccttcttgtatcttctggagaaaatgggtcgagaacccccacggaatcatttggaaggtgagcccgtgcgccgcgtgggttccttccgccgtgatcgaactgaccatgcccagcggcgaggtccggacgttccaccccatgtctgggattcctacacaggtgtttaaaggagtttccgtgacctatcttggcagcgacatggaagtctctggcctgaccgatctctgtgagatcgaggaactgaagtccaaaaagctggctcttgccccgtgcaaccaggctgggatgggagtggtgggcaaagtcggggagattcagtgtagctctgaagagtccgcccgcacaatcaagaaggacggatgcatctggaatgcggatctcgttggcattgaactgagagtggacgatgccgtgtgttacagcaaaatcacctccgtcgaggctgtggccaactatagcgctattcccacaacgatcgggggactgcggttcgagagatctcatgacagccaaggcaagatttccggctctcctctcgatatcaccgccatccgcgggagcttttccgttaattaccggggactgagactttctctgagcgaaattacagctacctgcacaggcgaggtgaccaacgtctccgggtgctactcttgtatgacgggagctaaagtgagcatcaagctccactccagcaaaaattctaccgcgcatgttcgctgcaagggcgacgaaacagccttctccgtgctggagggggtccacagctattctgtgtccctgagctttgatcacgctgttgtggacgaacagtgtcagcttaactgcggaggccatgagtcccaggtcaccctcagaggcaatctgattttcctggatgtgcccaagtttgtggacgggtcttacatgcaaacatatcacagcaccgtccctacgggagccaacatcccctcccctacagactggctcaatgccctgttcggcaacgggcttagccggtggattctgggagttatcggcgtgctccttgggggactggctctgtttttcctcatcatgtctctgtttaaactgggcaccaaacaggtgttccgctccagaacaaagctcgcctga

SEQ ID NO: 14810 - RNA, 3222 nt, synthetic construct
  misc_feature 1..3222: note = derived and/or modified CDS sequence (opt5) from SFTSV(ZJZHSH-FDE/China/06/2012)__KR017859.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctccctcaaccctttgatgtcgcctggatggacgtgggccactcccataagatcattatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatgcagttttgtaaggttgctggatgcgaacacggcgaggaggcctctgaagctaaatgtcggtgctccctggtgcataagcctggcgaggtggtcgtgagctacgggggaatgcgcgttagacccaaatgttacggcttctcccggatgatggccacgcttgaagtgaatcctcccgagcagcgcatcgggcaatgcaccggatgtcacctggaatgcattaacggcggggtcagactcatcacactgacctctgagcttaagagcgcgacagtgtgtgcctcccatttttgctctagcgctacctccggcaagaaaagcacggagattcagttccactctggatccctcgttggcaaggccgctatccacgtgaaaggggccctggtcgacggaacagagttcacctttgaaggcagctgtatgttccccgatgggtgcgacgcggtggattgcacattttgtcgggagttccttaagaatcctcagtgctatccggccaaaaagtggctgtttatcattatcgtcattctcctgggatacgctggccttatgctgctcaccaacgtgctgaaggccatcggggtttggggctcttgggtgattgctcccgtcaaactgatgttcgccatcatcaagaaactcatgcgctccgtgagctgtctgatgggaaagctgatggacagaggccggcaagttattcatgaagaaatcggggagaatagagagggaaaccaggatgacgtgcgcattgaaatggtccggcctagacgcgtgcggcactggatgtattctcccgtgatcctgaccattctcgccatcggcctgacagaggggtgcgatgaaatggttcatgctgacagcaaacttgtctcctgtagacagggaagcggcaatatgaaggagtgcgtgacgaccgggcgcgcgctgctccctgccgtgaaccccggccaggaggcttgtctgcactttacagccccgggatctcctgattccaagtgcctgaaaattaaggtcaaacggatcaatctcaagtgtaaaaagagctcctcttacttcgtgcccgacgccagaagccgctgcacctccgttcggagatgtcgctgggctggcgattgccaatctgggtgccctagccattttacatccaactctttcagcgacgactgggccggaaagatggatcgggcgggcctggggttttccggatgtagcgacggctgcgggggcgctgcctgtggatgcttcaatgccgctccctcttgtatcttttggagaaaatgggtggaaaaccctcacggcattatctggaaggtctccccctgcgccgcttgggtgccgagcgccgttattgagcttaccatgccttctggggaagtgcggacgttccaccccatgtccggaatccccacacaggtcttcaaaggcgtgagcgttacctatctggggtctgatatggaggtgtccggactcaccgacctgtgtgaaattgaggagcttaagagcaaaaagctggcgctcgccccttgcaaccaggctggcatgggcgtcgtggggaaagtgggagaaatccagtgttccagcgaggaatctgcccgcacaatcaagaaggatggctgcatttggaatgctgacctggtcgggatcgagctgagagttgatgacgccgtgtgttacagcaaaattacctccgtggaagcggtcgccaactattctgctatcccgacaacgattggaggcctccggtttgagagaagccatgattcccaagggaagatctctggaagccccctggacatcaccgccattcgcggctccttctctgtgaattaccggggccttagactgagcctctccgagatcacagctacctgcacaggggaagttaccaacgtgagcggatgctactcttgtatgacgggcgccaaagtctccattaagctgcacagctctaaaaattccaccgcccatgtgcgctgcaagggggatgagacagcttttagcgttctggaaggagtgcactcctataccgtctctcttagcttcgaccacgcggtggttgatgagcagtgtcagctcaactgcggcgggcatgaatcccaggtgacactgaagggaaatctgatctttctcgacgtccctaaattcgtggacggcagctacatgcaaacctatcactcttccgtgcccacgggcgccaacattcctagccccacagattggctgaatgctctttttgggaacggactgtctagatggatcctcggcgtcatcggggttctgctgggaggccttgccctcttctttctgattatgagcctgttcaagctcgggaccaaacaggtgtttcggtcccgcacaaagctggcctga

SEQ ID NO: 14811 - RNA, 3222 nt, synthetic construct
  misc_feature 1..3222: note = derived and/or modified CDS sequence (opt5) from SFTSV(ZJZHSH-FZHR/China/07/2013)__KR017862.1__GP
  source 1..3222: mol_type = other RNA
atgatgaaggtgatctggttcagctccctgatttgcctcgtcatccagtgtggcggggacaccggacccattatctgcgccggccctattcactctaacaaaagagctgggatcccgcatctgcttggatacagcgagaagatctgtcaaattgatcggctgatccacgtttcctcttggctccgcaatcatagccagtttcagggctatgtggggcagagaggaggccggtcccaagtgtcttactatcccgccgaaaacagctactcccgctggagcggcctgctttctccttgcgacgcggattggctggggatgctcgtcgtgaaaaaggctaaaggatccgacatgattgttcccggccctagctataaggggaaggtgttctttgagagacccacattcgatggatacgtcggctgggggtgtggatctggcaaatcccggacggaaagcggcgagctgtgttcttccgacagcgggacctcctctggactgctccctagcgatcgcgtgctgtggatcggcgacgttgcctgccagccgatgacacccattcctgaagagacctttcttgagctgaagtccttcagccagtctgaatttcccgatgtgtgcaaaatcgacgggattgtcttcaatcagtgtgagggagaatccctccctcaaccctttgatgtggcctggatggacgtgggccacagccataagatcatcatgagagagcacaaaacaaagtgggtccaggagtctagctccaaggatttcgtttgctataaagaagggaccggaccgtgttctgagagcgaagagaagacatgcaaaacctccggcagctgccggggcgacatgcagttttgtaaggtggctgggtgcgaacacggagaggaggcctctgaagctaaatgtcgctgctccctggtgcataagcctggcgaggtcgtggttagctacgggggaatgagagtgcggcccaaatgttacggcttctctcgcatgatggccacgcttgaagtcaaccctcccgagcagagaattgggcaatgcaccggctgtcacctggaatgcatcaatggaggcgtgcggctcattacactgacctccgagcttaagagcgcgacagtttgtgcctcccatttttgctctagcgctacctccgggaagaaatctacggagatccagttccacagcggatccctcgtgggcaagacagccattcacgtcaaaggggctctggtggacggaaccgagttcacatttgaaggcagctgtatgttccccgatgggtgcgacgccgtcgattgcaccttttgtcgcgagttccttaagaaccctcagtgctatccggcgaaaaagtggctgtttatcatcattgtgatcctcctgggctacgccggacttatgctgctcaccaatgttctgaaggctattggcgtgtgggggtcttgggtcatcgcccccgtgaaactggttttcgctattatcaagaaactcatgagagccgtgtcctgtctgatgggaaagctgatggaccggggcagacaagtcatccatgaagaaattggggagaaccgcgagggaaatcaggatgacgtgcggatcgaaatggccagacctcgccgggtgagacactggatgtatagccccgttattctgacaatcctcgctattggcctggcggaggggtgcgatgaaatggtccatgccgactctaaacttgtgtcctgtcgccagggcagcggaaacatgaaggagtgcgtgacgaccggccgggctctgctccctgccgtcaatcccgggcaggaggcctgtctgcactttacagctccgggatctcctgatagcaagtgcctgaaaatcaaggtgaaaagaattaacctcaagtgtaaaaagtccagctcttacttcgttcccgacgcccgctcccggtgcaccagcgtgagacgctgtcggtgggcgggcgattgccaatccgggtgccctccccattttacatctaatagcttctccgacgactgggctggaaagatggatagagccggcctggggttttctggctgtagcgacggatgcggcggggccgcttgtggatgcttcaacgccgctccttcctgtatcttttggcggaaatgggtcgaaaatccccacggcatcatttggaaggtgtctccgtgcgccgcgtgggttcctagcgccgtgatcgagcttaccatgccctccggggaagtccgcacgttccaccccatgagcggcattcctacacaggtgttcaaaggagtttctgtgacctatctgggctccgatatggaggtcagcgggctcaccgacctgtgtgaaatcgaggagctgaagtctaaaaagctcgctcttgccccgtgcaaccaggctggaatgggcgtggtggggaaagtcggagaaattcagtgttccagcgaggaatctgccagaacaatcaagaaggatggctgcatctggaacgcggacctggttgggattgagctgcgggtggatgacgccgtgtgttactccaaaatcaccagcgtcgaagctgtggccaattattccgctattcccacaacgatcggaggcctcagatttgagcgcagccatgattctcaaggcaagattagcgggtcccctctggacatcaccgccatccggggatctttcagcgttaactacagaggccttcgcctgtccctctctgagattacagctacctgcacaggggaagtgaccaatgtcagcggatgctactcctgtatgacgggcgccaaagtgtctatcaagctgcacagctccaaaaacagcaccgcgcatgttagatgcaagggggatgagacagccttttctgtgctggaaggagtccactcctatagcgtgtctctttccttcgaccacgctgttgtggatgagcagtgtcagctcaattgcggcggccatgaaagccaggtcaccctgcgggggaacctgatttttctcgacgtgcccaagttcgtggacggatcctacatgcaaacatatcactctaccgtccctacgggcgccaatatccccagccctacagattggctgaacgccctttttgggaatggactgtcccgctggattctcggcgttatcggggtgctgctgggaggccttgctctcttctttctgatcatgagcctgttcaaactcggcaccaaacaggtgtttagatctcggacaaagctggcctga

SEQ ID NO: 14812 - RNA, 3222 nt, synthetic construct
  misc_feature 1..3222: note = derived and/or modified CDS sequence (opt5) from SFTSV(ZJZHSH-HCY/China/06/2012)__KR017855.1__GP
  source 1..3222: mol_type = other RNA
atgatgaaggtgatctggttccccagcctgatttgcctcgtcatccagtgttccggcgacaccgggcctattatctgcgccggaccgattcactctaacaaaagcgctaatatcccccatctgcttggctactccgagaagatctgtcaaattgatagactgatccacgtttctagctggctccggaaccattcccagtttcaggggtatgtgggacagcgcggcgggagatctcaagtgagctactatcctgccgaaaattcctacagccggtggtctggactgctttccccctgcgacgcggattggctgggcatgctcgtcgtgaaaaaggctaaaggcagcgacatgattgttcctgggccctcttataagggaaaggtgttctttgagcgccctacattcgatggctacgtcgggtggggatgtggctccgggaaaagcagaacggaatctggagagctgtgctccagcgactccggcacctctagcggcctgctcccgtccgatcgggtgctgtggatcggggacgttgcctgtcagcccatgacacctattcccgaagagacctttcttgagcttaagagcttctctcagtccgaatttcctgatatctgcaaaattgacggaatcgtgttcaaccagtgtgagagcgaatctctcccccaaccgtttgatgtcgcctggatggacgtgggccacagccataagatcattatgcgcgagcacaaaacaaagtgggtgcaggagtcctctagcaaggatttcgtctgctataaagaagggaccggaccttgttccgagagcgaagagaagacatgcaaaacctctggctcctgcagaggggacatgcagttttgtaaggttgctggatgcgaacacggcgaggaggccagcgaagctaaatgtcggtgctctctggtgcataagcccggcgaggtggtcgtgtcctacgggggaatgcgcgttagacctaaatgttacggcttcagccggatgatggccacgcttgaagtgaatcctcccgagcagcgcatcgggcaatgcaccggatgtcacctggaatgcattaacggcggggtcagactcgtgacactgacctccgagctgaagtctgcgacagtttgtgccagccatttttgctcctctgctaccagcggcaagaaatccacggagatccagttccacagcggatctctcgtgggcaaggccgctattcacgtcaaaggggccctggtggacggaacagagttcacctttgaaggctcctgtatgttccccgatgggtgcgacgcggtcgattgcacattttgtcgggagttccttaagaatccgcagtgctatcccgccaaaaagtggctgtttatcatcattgtgatcctcctgggatacgctggccttatgctgctcaccaacgttctgaaggccattggggtgtggggcagctgggtcatcgctcctgtgaaactgatgttcgccattatcaagaaactcatgcgctctgtttcctgtctgatgggaaagctgatggacagaggccggcaagtgatccatgaagaaattggggagaatagagagggaaaccaggatgacgtccgcatcgaaatggtgcggcccagacgcgtgcggcactggatgtatagccctgttattctgaccatcctcgccattggcctgacagaggggtgcgatgaaatggtccatgctgactctaaacttgtgagctgtagacagggatccggcaatatgaaggagtgcgtgacgaccgggcgcgcgctgctccccgccgtcaacccgggccaggaggcttgtctgcactttacagcccctggaagccccgattctaagtgcctgaaaatcaaggtgaaacggattaatctcaagtgtaaaaagtccagctcctacttcgttcctgacgccagatctcgctgcaccagcgtgcggagatgtcgctgggctggcgattgccaatccgggtgcccctctcattttacaagcaactccttctctgacgactgggccggaaagatggatcgggcgggcctggggtttagcggatgttccgacggctgcgggggcgctgcctgtggatgcttcaatgccgctcctagctgtatcttttggagaaaatgggtcgaaaacccccacggcatcatttggaaggtgtctccgtgcgccgcttgggttccttccgccgtgatcgagcttaccatgcccagcggggaagtccggacgttccaccccatgtctggcattcctacacaggtgttcaaaggagtttccgtgacctatctggggagcgatatggaggtctctggactcaccgacctgtgtgaaatcgaggagctgaagtccaaaaagctcgcgcttgccccgtgcaaccaggctggcatgggcgtggtggggaaagtcggagaaattcagtgtagctccgaggaaagcgcccgcacaatcaagaaggatggctgcatctggaatgctgacctggttgggattgagctgagagtggatgacgccgtgtgttactctaaaatcaccagcgtcgaagcggtggccaactattccgctattcccacaacgatcggaggcctccggtttgagagatctcatgatagccaagggaagatttccggatctcctctggacatcaccgccatccgcggcagcttctccgttaattaccggggccttagactgtctctcagcgagattacagctacctgcacaggggaagtgaccaacgtctccggatgctacagctgtatgacgggcgccaaagtgtctatcaagctgcactccagcaaaaattctaccgcccatgttcgctgcaagggggatgagacagctttttccgtgctggaaggagtccacagctataccgtgtccctttctttcgaccacgcggttgtggatgagcagtgtcagctcaactgcggcgggcatgaaagccaggtcacactgaagggaaatctgatttttctcgacgtgcccaaattcgtggacggctcctacatgcaaacctatcacagctctgtccctacgggcgccaacatcccctcccctacagattggctgaatgctctttttgggaacggactgagcagatggattctcggcgttatcggggtgctgctgggaggccttgccctcttctttctgttcatgtctctgtttaagctcgggaccaaacaggtgttccggagccgcacaaagctggcctga

SEQ ID NO: 14813 - RNA, 3222 nt, synthetic construct
  misc_feature 1..3222: note = derived and/or modified CDS sequence (opt5) from SFTSV(ZJZHSH-HYC/China/05/2012)__KR017847.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctccctcaaccctttgatgtcgcctggatggacgtgggccactcccataagatcattatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatgcagttttgtaaggttgctggatgcgaacacggcgaggaggcctctgaagctaaatgtcggtgctccctggtgcataagcctggcgaggtggtcgtgagctacgggggaatgcgcgttagacccaaatgttacggcttctcccggatgatggccacgcttgaagtgaatcctcccgagcagcgcatcgggcaatgcaccggatgtcacctggaatgcattaacggcggggtcagactcatcacactgacctctgagcttaagagcgcgacagtgtgtgcctcccatttttgctctagcgctacctccggcaagaaaagcacggagattcagttccactctggatccctcgttggcaaggccgctatccacgtgaaaggggccctggtcgacggaacagagttcacctttgaaggcagctgtatgttccccgatgggtgcgacgcggtggattgcacattttgtcgggagttccttaagaatcctcagtgctatccggccaaaaagtggctgtttatcattatcgtcattctcctgggatacgctggccttatgctgctcaccaacgtgctgaaggccatcggggtttggggctcttgggtgattgctcccgtcaaactgatgttcgccatcatcaagaaactcatgcgctccgtgagctgtctgatgggaaagctgatggacagaggccggcaagttattcatgaagaaatcggggagaatagaaaaggaaaccaggatgacgtgcgcattgagatggtccggcctagacgcgtgcggcactggatgtattctcccgtgatcctgaccattctcgccatcggcctgacagaagggtgcgatgagatggttcatgctgacagcaaacttgtctcctgtagacagggaagcggcaatatgaaggaatgcgtgacgaccgggcgcgcgctgctccctgccgtgaaccccggccaggaggcttgtctgcactttacagccccgggatctcctgattccaagtgcctgaagattaaagtcaagcggatcaatctcaaatgtaaaaagagctcctcttacttcgtgcccgacgccagaagccgctgcacctccgttcggagatgtcgctgggctggcgattgccaatctgggtgccctagccattttacatccaactctttcagcgacgactgggccggaaagatggatcgggcgggcctggggttttccggatgtagcgacggctgcgggggcgctgcctgtggatgcttcaatgccgctccctcttgtatcttttggagaaagtgggtggagaaccctcacggcattatctggaaagtctccccctgcgccgcttgggtgccgagcgccgttattgaacttaccatgccttctggggaggtgcggacgttccaccccatgtccggaatccccacacaggtcttcaagggcgtgagcgttacctatctggggtctgatatggaagtgtccggactcaccgacctgtgtgagattgaggaactgaaaagcaagaaacttgcgctcgccccttgcaaccaggctggcatgggcgtcgtggggaaggtgggagagatccagtgttccagcgaagagtctgcccgcacaatcaagaaagatggctgcatttggaatgctgacctggtcgggatcgaactgagagttgatgacgccgtgtgttacagcaagattacctccgtggaggcggtcgccaactattctgctatcccgacaacgattggaggcctccggtttgaaagaagccatgattcccaagggaaaatctctggaagccccctggacatcaccgccattcgcggctccttctctgtgaattaccggggccttagactgagcctctccgagatcacagctacctgcacaggggaggttaccaacgtgagcggatgctactcttgtatgacgggcgccaaggtctccattaaactgcacagctctaaaaattccaccgcccatgtgcgctgcaagggggatgaaacagcttttagcgttctggagggagtgcactcctataccgtctctcttagcttcgaccacgcggtggttgatgaacagtgtcagctcaactgcggcgggcatgagtcccaggtgacactgaagggaaatctgatctttctcgacgtccctaagttcgtggacggcagctacatgcaaacctatcactcttccgtgcccacgggcgccaacattcctagccccacagattggctgaatgctctttttgggaacggactgtctagatggatcctcggcgtcatcggggttctgctgggaggccttgccctcttctttctgattatgagcctgttcaaactcgggaccaaacaggtgtttcggtcccgcacaaagctggcctga

SEQ ID NO: 14814 - RNA, 3222 nt, synthetic construct
  misc_feature 1..3222: note = derived and/or modified CDS sequence (opt5) from SFTSV(ZJZHSH-HYJ/China/07/2012)__KR017852.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctccctcaaccctttgatgtcgcctggatggacgtgggccactcccataagatcattatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatgcagttttgtaaggttgctggatgcgaacacggcgaggaggcctctgaagctaaatgtcggtgctccctggtgcataagcctggcgaggtggtcgtgagctacgggggaatgcgcgttagacccaaatgttacggcttctcccggatgatggccacgcttgaagtgaatcctcccgagcagcgcatcgggcaatgcaccggatgtcacctggaatgcattaacggcggggtcagactcatcacactgacctctgagcttaagagcgcgacagtgtgtgcctcccatttttgctctagcgctacctccggcaagaaaagcacggagattcagttccactctggatccctcgttggcaaggccgctatccacgtgaaaggggccctggtcgacggaacagagttcacctttgaaggcagctgtatgttccccgatgggtgcgacgcggtggattgcacattttgtcgggagttccttaagaatcctcagtgctatccggccaaaaagtggctgtttatcattatcgtcattctcctgggatacgctggccttatgctgctcaccaacgtgctgaaggccatcggggtttggggctcttgggtgattgctcccgtcaaactgatgttcgccatcatcaagaaactcatgcgctccgtgagctgtctgatgggaaagctgatggacagaggccggcaagttattcatgaagaaatcggggagaatagagagggaaaccaggatgacgtgcgcattgaaatggtccggcctagacgcgtgcggcactggatgtattctcccgtgatcctgaccattctcgccatcggcctgacagaggggtgcgatgaaatggttcatgctgacagcaaacttgtctcctgtagacagggaagcggcaatatgaaggagtgcgtgacgaccgggcgcgcgctgctccctgccgtgaaccccggccaggaggcttgtctgcactttacagccccgggatctcctgattccaagtgcctgaaagtcaaggtgaaacggattaatctcaagtgtaaaaagagctcctcttacttcgttcccgacgccagaagccgctgcacctccgtgcggagatgtcgctgggctggcgattgccaatctgggtgccctagccattttacatccaactctttcagcgacgactgggccggaaagatggatcgggcgggcctggggttttccggatgtagcgacggctgcgggggcgctgcctgtggatgcttcaatgccgctccctcttgtatcttttggagaaaatgggtcgaaaaccctcacggcatcatttggaaggtgtccccctgcgccgcttgggttccgagcgccgtgatcgagcttaccatgccttctggggaagtccggacgttccaccccatgtccggcattcccacacaggtgttcaaaggagttagcgtgacctatctggggtctgatatggaggtctccggactcaccgacctgtgtgaaatcgaggagcttaagagcaaaaagctggcgctcgccccttgcaaccaggctggcatgggcgtggtggggaaagtcggagaaattcagtgttccagcgaggaatctgcccgcacaatcaagaaggatggctgcatctggaatgctgacctggttgggattgagctgagagtggatgacgccgtgtgttacagcaaaatcacctccgtcgaagcggtggccaactattctgctattccgacaacgatcggaggcctccggtttgagagaagccatgattcccaagggaagatttctggaagccccctggacatcaccgccatccgcggctccttctctgttaattaccggggccttagactgagcctctccgagattacagctacctgcacaggggaagtgaccaacgtcagcggatgctactcttgtatgacgggcgccaaagtgtccatcaagctgcacagctctaaaaattccaccgcccatgttcgctgcaagggggatgagacagcttttagcgtgctggaaggagtccactcctataccgtgtctcttagcttcgaccacgcggttgtggatgagcagtgtcagctcaactgcggcgggcatgaatcccaggtcacactgaagggaaatctgatttttctcgacgtgcctaaattcgtggacggcagctacatgcaaacctatcactcttccgtccccacgggcgccaacatccctagccccacagattggctgaatgctctttttgggaacggactgtctagatggattctcggcgttatcggggtgctgctgggaggccttgccctcttctttctgatcatgagcctgttcaagctcgggaccaaacaggtgtttcggtcccgcacaaagctggcctga

SEQ ID NO: 14815 - RNA, 3222 nt, synthetic construct
  misc_feature 1..3222: note = derived and/or modified CDS sequence (opt5) from SFTSV(ZJZHSH-LU/China/10/2011)__KR017850.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatgtgcaaaatcgacggaattgtgttcaaccagtgtgagtctgaaagcctccctcaaccctttgatgtcgcctggatggacgtgggccactcccataagatcatcatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatgcagttttgtaaggttgctggatgcgaacacggcgaggaggcctctgaagctaaatgtcggtgctccctggtgcataagcctggcgaggtggtcgtgagctacgggggaatgcgcgttagacccaaatgttacggcttctcccggatgatggccacgcttgaagtgaatcctcccgagcagcgcattgggcaatgcaccggatgtcacctggaatgcatcaacggcggggtcagactcgtgacactgacctctgagcttaagagcgcgacagtttgtgcctcccatttttgctctagcgctacctccggcaagaaaagcacggagattcagttccactctggatccctcgtgggcaaggccgctatccacgtcaaaggggccctggtggacggaacagaatttacctttgagggcagctgtatgttccccgatgggtgcgacgcggtcgattgcacattttgtcgggagttccttaagaatcctcagtgctatccggccaaaaagtggctgtttattatcatcgtgattctcctgggatacgctggccttatgctgctcaccaacgttctgaaggccatcggggtgtggggctcttgggtcattgctcccgtgaaactgatgttcgccatcattaagaaactcatgcgctccgttagctgtctgatgggaaagctgatggacagaggccggcaagtgatccatgaagaaatcggggagaatagagagggaaaccaggatgacgtccgcattgaaatggtgcggcctagacgcgtgcggcactggatgtattctcccgttatcctgaccattctcgccatcggcctgacagaggggtgcgatgaaatggtccatgctgacagcaaacttgtgtcctgtagacagggaagcggcaatatgaaggagtgcgtgacgaccgggcgcgcgctgctccctgccgtcaaccccggccaggaggcttgtctgcactttacagccccgggatctcctgattccaagtgcctgaaaattaaggtgaaacggatcaatctcaagtgtaaaaagagctcctcttacttcgttcccgacgccagaagccgctgcacctccgtgcggagatgtcgctgggctggcgattgccaatctgggtgccctagccattttacatccaactctttcagcgacgactgggccggaaagatggatcgggcgggcctggggttttccggatgtagcgacggctgcgggggcgctgcctgtggatgcttcaatgccgctccctcttgtattttctggagaaaatgggtcgaaaaccctcacggcatcatctggaaggtgtccccctgcgccgcttgggttccgagcgccgtgattgagcttaccatgccttctggggaagtccggacgttccaccccatgtccggaatccccacacaggtgttcaaaggcgttagcgtgacctatctggggtctgatatggaggtctccggactcaccgacctgtgtgaaattgaggagcttaagagcaaaaagctggcgctcgccccttgcaaccaggctggcatgggcgtggtggggaaagtcggagaaatccagtgttccagcgaggaatctgcccgcacaattaagaaggatggctgcatctggaatgctgacctggttgggatcgagctgagagtggatgacgccgtgtgttacagcaaaattacctccgtcgaagcggtggccaactattctgctatcccgacaacgattggaggcctccggtttgagagaagccatgattcccaagggaagatctctggaagccccctggacattaccgccatccgcggctccttctctgttaattaccggggccttagactgagcctctccgagatcacagctacctgcacaggggaagtgaccaacgtcagcggatgctactcttgtatgacgggcgccaaagtgtccattaagctgcacagctctaaaaattccaccgcccatgttcgctgcaagggggatgagacagcttttagcgtgctggaaggagtccactcctataccgtgtctcttagcttcgaccacgcggttgtggatgagcagtgtcagctcaactgcggcgggcatgaatcccaggtcacactgaagggaaatctgatctttctcgacgtgcctaaattcgtggacggcagctacatgcaaacctatcactcttccgtccccacgggcgccaacattcctagccccacagattggctgaatgctctttttgggaacggactgtctagatggatcctcggcgttattggggtgctgctgggaggccttgccctcttctttctgatcatgagcctgttcaagctcgggaccaaacaggtgtttcggtcccgcacaaagctggcctga

SEQ ID NO: 14816 - RNA, 3222 nt, synthetic construct
  misc_feature 1..3222: note = derived and/or modified CDS sequence (opt5) from SFTSV(ZJZHSH-SHZ/China/05/2012)__KR017848.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctccctcaaccctttgatgtcgcctggatggacgtgggccactcccataagatcattatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatgcagttttgtaaggttgctggatgcgaacacggcgaggaggcctctgaagctaaatgtcggtgctccctggtgcataagcctggcgaggtggtcgtgagctacgggggaatgcgcgttagacccaaatgttacggcttctcccggatgatggccacgcttgaagtgaatcctcccgagcagcgcatcgggcaatgcaccggatgtcacctggaatgcattaacggcggggtcagactcgtgacactgacctctgagcttaagagcgcgacagtttgtgcctcccatttttgctctagcgctacctccggcaagaaaagcacggagatccagttccactctggatccctcgtgggcaaggccgctattcacgtcaaaggggccctggtggacggaacagagttcacctttgaaggcagctgtatgttccccgatgggtgcgacgcggtcgattgcacattttgtcgggagttccttaagaatcctcagtgctatccggccaaaaagtggctgtttatcatcattgtgatcctcctgggatacgctggccttatgctgctcaccaacgttctgaaggccattggggtgtggggctcttgggtcatcgctcccgtgaaactgatgttcgccattatcaagaaactcatgcgctccgttagctgtctgatgggaaagctgatggacagaggccggcaagtgatccatgaagaaattggggagaatagagagggaaaccaggatgacgtccgcatcgaaatggtgcggcctagacgcgtgcggcactggatgtattctcccgttattctgaccatcctcgccattggcctgacagaggggtgcgatgaaatggtccatgctgacagcaaacttgtgtcctgtagacagggaagcggcaatatgaaggagtgcgtgacgaccgggcgcgcgctgctccctgccgtcaaccccggccaggaggcttgtctgcactttacagccccgggatctcctgattccaagtgcctgaaaatcaaggtgaaacggattaatctcaagtgtaaaaagagctcctcttacttcgttcccgacgccagaagccgctgcacctccgtgcggagatgtcgctgggctggcgattgccaatctgggtgccctagccattttacatccaactctttcagcgacgactgggccggaaagatggatcgggcgggcctggggttttccggatgtagcgacggctgcgggggcgctgcctgtggatgcttcaatgccgctccctcttgtatcttttggagaaaatgggtcgaaaaccctcacggcatcatttggaaggtgtccccctgcgccgcttgggttccgagcgccgtgatcgagcttaccatgccttctggggaagtccggacgttccaccccatgtccggcattcccacacaggtgttcaaaggagttagcgtgacctatctggggtctgatatggaggtctccggactcaccgacctgtgtgaaatcgaggagcttaagagcaaaaagctggcgctcgccccttgcaaccaggctggcatgggcgtggtggggaaagtcggagaaattcagtgttccagcgaggaatctgcccgcacaatcaagaaggatggctgcatctggaatgctgacctggttgggattgagctgagagtggatgacgccgtgtgttacagcaaaatcacctccgtcgaagcggtggccaactattctgctattccgacaacgatcggaggcctccggtttgagagaagccatgattcccaagggaagatttctggaagccccctggacatcaccgccatccgcggctccttctctgttaattaccggggccttagactgagcctctccgagattacagctacctgcacaggggaagtgaccaacgtcagcggatgctactcttgtatgacgggcgccaaagtgtccatcaagctgcacagctctaaaaattccaccgcccatgttcgctgcaagggggatgagacagcttttagcgtgctggaaggagtccacggctataccgtgtccctttctttcgaccacgcggttgtggatgagcagtgtcagctcaactgcgggggacatgaaagccaggtcacactgaagggcaatctgatttttctcgacgtgcctaaattcgtggacggctcctacatgcaaacctatcacagctctgtccccacgggggccaacatcccttcccccacagattggctgaatgctctttttggaaacggcctgagcagatggattctcggggttatcggagtgctgctgggcgggcttgccctcttctttctgatcatgtctctgttcaagctcggaaccaaacaggtgtttcggagccgcacaaagctggcctga

SEQ ID NO: 14817 - RNA, 3222 nt, synthetic construct
  misc_feature 1..3222: note = derived and/or modified CDS sequence (opt5) from SFTSV(ZJZHSH-WSH/China/08/2012)__KR017854.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgggatcccgcatctgcttggatactccgagaagatctgtcaaattgatagactgatccacgtttctagctggctccggaatcattcccagtttcagggctatgtggggcagcgcggaggcagatctcaagtgagctactatcccgccgaaaactcctacagccggtggtctggcctgctttccccttgcgacgcggattggctggggatgctcgtcgtgaaaaaggctaaaggaagcgacatgattgttcccggcccttcttataaggggaaggtgttctttgagcgccccacattcgatggatacgtcggctgggggtgtggatccggcaaaagcagaacggaatctggcgagctgtgctccagcgactccgggacctctagcggactgctcccttccgatcgggtgctgtggatcggcgacgttgcctgtcagccgatgacacccattcctgaagagacctttcttgagcttaagagcttctctcagtccgaatttcccgatgtgtgcaaaatcgacgggattgtcttcaatcagtgtgagggagaaagcctccctcaaccctttgatgtggcctggatggacgtgggccactctcataagatcatcatgcgcgagcacaaaacaaagtgggtccaggagagctcctctaaggatttcgtttgctataaagaagggaccggaccgtgtagcgagtccgaagagaagacatgcaaaaccagcggctcttgcagaggcgacatgcagttttgtaaggtggctgggtgcgaacacggagaggaggcctccgaagctaaatgtcggtgcagcctggtgcagaagcctggcgaggtcgtggtttcttacgggggaatgcgcgtgagacccaaatgttacggcttctcccggatgatggccacgcttgaagtcaaccctcccgagcaacgcattgggcagtgcaccggctgtcatctggaatgcatcaatggaggcgtgagactcattacactgaccagcgagctgaagtccgcgacagtttgtgcctctcacttttgcagctccgctacctctgggaagaaaagcacggagatccagttccattccggaagcctcgtgggcaagacagccattcacgtcaaaggggctctggtggacggaaccgaatttacatttgagggctcttgtatgttccccgatgggtgcgacgccgtcgattgcaccttttgtcgggagttccttaagaaccctcaatgctatccggcgaaaaagtggctgtttatcatcattgtgatcctcctgggctacgccggacttatgctgctcaccaatgttctgaaggctattggcgtgtgggggtcctgggtcatcgcccccgtgaaactgatgttcgctattatgaagaaactcatgcgcagcgtttcttgtctgatgggaaagctgatggacagaggcagacaggtgatccacgaagaaatcggggagaaccgggagggaaatcaggatgacgtccgcattgaaatggtgcggcctagacgcgtgcggcattggatgtattcccccgttatcctgacaattctcgccatcggcctgacggaggggtgcgatgaaatggtccacgccgacagcaaacttgtgtcttgtagacagggcagcggaaacatgaaggagtgcgtgaccacaggccgcgctctgctccctgcggtcaatcccgggcaagaggcctgtctgcattttaccgctccgggatcccctgatagcaagtgcctgaaaattaaggtgaaacggatcaacctcaagtgtaaaaagtcttccagctacttcgttcccgacgccagatcccgctgcacatctgtgcggagatgtcgctgggccggcgattgccagagcgggtgccctccccactttacctccaattctttcagcgacgactgggctggaaagatggatcgggccggcctggggttttccggctgttctgacggatgcggcggggcggcttgtggatgcttcaacgccgcccctagctgtattttctggagaaaatgggtcgaaaatccccatggcatcatctggaaggtgtccccgtgcgctgcctgggttcctagcgctgtgattgagcttacgatgccctctggggaagtccggacattccaccccatgtccggaatccctacccaggtgttcaaaggcgttagcgtgacctatctgggctctgatatggaggtctccgggctcacagacctgtgtgaaattgaggagcttaagagcaaaaagctggccctcgcgccgtgcaaccaggccggaatgggcgtggtggggaaagtcggagaaatccaatgttcttccgaggaaagcgctcgcaccattaagaaggatggctgcatctggaacgccgacctggttgggatcgagctgagagtggatgacgctgtgtgttactccaaaattacaagcgtcgaagccgtggcgaattattctgccatccccacgaccattggaggcctccggtttgagagaagccacgattcccagggcaagatctctgggagccctctggacattacagctatccgcggatccttctctgttaactaccggggccttagactgagcctctccgagatcaccgccacatgcaccggggaagtgacgaatgtctctggatgctacagctgtatgaccggcgctaaagtgtccattaagctgcatagctctaaaaactccacagcccacgttcgctgcaagggggatgagaccgcctttagcgtgctggaaggagtccattcttattccgtgagcctttccttcgaccacgctgttgtggatgagcagtgtcagctcaattgcggcggccacgaatctcaagtcacactgagagggaacctgatctttctcgacgtgcccaagttcgtggacggaagctacatgcagacctatcattccacggtccctacaggcgcgaatattcccagccctaccgattggctgaacgccctttttgggaatggactgtctcggtggatcctcggcgttattggggtgctgctgggaggccttgctctcttctttctgatcatgtccctgttcaaactcggcacaaaacaggtgtttcgcagcagaaccaagctggcctga

SEQ ID NO: 14818 - RNA, 3222 nt, synthetic construct
  misc_feature 1..3222: note = derived and/or modified CDS sequence (opt5) from SFTSV(ZJZHSH-XAM/China/06/2012)__KR017853.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctccctcaaccctttgatgtcgcctggatggacgtgggccactcccataagatcattatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatgcagttttgtaaggttgctggatgcgaacacggcgaggaggcctctgaagctaaatgtcggtgctccctggtgcataagcctggcgaggtggtcgtgagctacgggggaatgcgcgttagacccaaatgttacggcttctcccggatgatggccacgcttgaagtgaatcctcccgagcagcgcatcgggcaatgcaccggatgtcacctggaatgcattaacggcggggtcagactcgtgacactgacctctgagcttaagagcgcgacagtttgtgcctcccatttttgctctagcgctacctccggcaagaaaagcacggagatccagttccactctggatccctcgtgggcaaggccgctattcacgtcaaaggggccctggtggacggaacagagttcacctttgaaggcagctgtatgttccccgatgggtgcgacgcggtcgattgcacattttgtcgggagttccttaagaatcctcagtgctatccggccaaaaagtggctgtttatcatcattgtgatcctcctgggatacgctggccttatgctgctcaccaacgttctgaaggccattggggtgtggggctcttgggtcatcgctcccgtgaaactggttttcgccattatcaagaaactcatgcgcgccgtgtcctgtctgatgggaaagctgatggacagaggccggcaagtcatccatgaagaaattggggagaatagagagggaaaccaggatgacgtgcgcatcgaaatggctcggcctagacgcgtgcggcactggatgtatagccccgttattctgaccatcctcgcgattggcctggccgaggggtgcgatgaaatggtccatgctgactctaaacttgtgagctgtagacagggatccggcaatatgaaggagtgcgtgacaacggggcgcgccctgctccctgccgtcaaccccggccaggaggcttgtctgcactttaccgccccgggaagccctgattctaagtgcctgaaaatcaaggtgaaacggattaatctcaagtgtaaaaagtccagctcctacttcgttcccgacgcgagatctcgctgcacaagcgtgcggagatgtcgctgggctggcgattgccaatccgggtgcccttctcattttaccagcaactccttctctgacgactgggccggaaagatggatcgggccggcctggggtttagcggatgttccgacggctgcgggggcgctgcctgtggatgcttcaatgctgcccccagctgtatcttttggagaaaatgggtcgaaaaccctcacggcatcatttggaaggtgtctccctgcgcggcctgggttccgtccgctgtgatcgagcttacaatgcctagcggggaagtccggaccttccaccccatgtctggcattcccacacaggtgttcaaaggagtttccgtgacgtatctggggagcgatatggaggtctctggactcaccgacctgtgtgaaatcgaggagctgaagtccaaaaagctcgcccttgctccttgcaaccaggccggcatgggcgtggtggggaaagtcggagaaattcagtgtagctccgaggaaagcgcgcgcaccatcaagaaggatggctgcatctggaatgccgacctggttgggattgagctgagagtggatgacgctgtgtgttactctaaaatcacaagcgtcgaagccgtggctaactattccgccattccgaccacaatcggaggcctccggtttgagagatctcatgatagccaagggaagatttccggatctcccctggacatcacggccatccgcggcagcttctccgttaattaccggggccttagactgtctctcagcgagattaccgctacatgcaccggggaagtgacaaacgtctccggatgctacagctgtatgaccggcgcgaaagtgtctatcaagctgcactccagcaaaaattctacggcccatgttcgctgcaagggggatgagaccgctttttccgtgctggaaggagtccacagctatacagtgtccctttctttcgaccacgccgttgtggatgagcagtgtcagctcaactgcggcgggcatgaaagccaggtcaccctgaagggaaatctgatttttctcgacgtgcctaaattcgtggacggctcctacatgcaaacatatcacagctctgtccccaccggcgccaacatcccttcccccacggattggctgaatgctctttttgggaacggactgagcagatggattctcggcgttatcggggtgctgctgggaggccttgccctcttctttctgatcatgtctctgttcaagctcgggacaaaacaggtgtttcggagccgcaccaagctggcgtga

SEQ ID NO: 14819 - RNA, 3222 nt, synthetic construct
  misc_feature 1..3222: note = derived and/or modified CDS sequence (opt5) from SFTSV(ZJZHSH-YJX/China/06/2012)__KR017860.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctccctcaaccctttgatgtcgcctggatggacgtgggccactcccataagatcattatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatgcagttttgtaaggttgctggatgcgaacacggcgaggaggcctctgacgctaaatgtcggtgctccctggtgcataagcctggcgaagtggtcgtgagctacgggggaatgcgcgttagacccaaatgttacggcttctcccggatgatggccacgcttgaggtgaatcctcccgaacagcgcatcgggcaatgcaccggatgtcacctggagtgcattaacggcggggtcagactcatcacactgacctctgaactgcggagcgcgacagtgtgtgcctcccatttttgctctagcgctacctccggcaaaaagagcacggagattcagttccactctggatccctcgttggcaagacaaccatccacgtgaagggggccctggtcgatggaacagagttcacctttgaaggcagctgtatgttccccgacgggtgcgatgctgtggactgcaccttttgtcgcgagttccttaaaaatcctcagtgctatccggccaagaaatggctgtttatcattatcgtcattctcctgggatacgcgggccttatgctgctcacaaacgtgctgaaggccatcggggtttggggctcttgggtgattgctcccgtcaagctgatgttcgccatcatcaaaaagctcatgagatccgtgagctgtctgatgggaaaacttatggatcggggcagacaagttattcatgaagagatcggggaaaatcgcgagggaaaccaggacgatgtgcggattgagatggctagacctcgccgggtcagacactggatgtattctcccgtgatcctgacgattctcgccatcggcctggccgaagggtgcgacgagatggtgcatgctgatagcaaacttgtttcctgtaagcaggcgagcggaaatatgaaggaatgcgtcaccacaggccgcgccctgctccctgctgtgaaccccgggcaggaggcctgtctgcactttaccgccccgggctctcctgactccaagtgcctgaaaattaaggtgaaacggatcaatctcaagtgtaaaaagagctcctcttacttcgtcctggatgctagaagccgctgcacatccgtgcggagatgtcgctgggccggagactgccaatctggctgccccagccattttacctccaactctttcagcgacgattgggcggggaagatggaccgggctggacttggcttttccgggtgtagcgatggatgcggcggggccgcctgtggctgcttcaatgctgccccttcttgtatcttttggagaaaatgggttgagaacccccacggaattatctggaaggtgtccccttgcgctgcctgggtccccagcgcggtgattgaactgacgatgccgtctggcgaggttcggacattccaccctatgtccgggatccccacccaggtgttcaaaggagtcagcgtgacctatctcggctctgacatggaagtttccgggctgacagatctgtgtgagattgaggaacttaagagcaaaaagctcgccctggctccctgcaaccaggccggaatgggcgtggtcggcaaagtgggggagatccagtgttccagcgaagagtctgctcgcaccatcaagaaggacggatgcatttggaatgccgatctggtgggcatcgaactcagagtcgacgatgcggtttgttacagcaaaattacatccgtggaggccgtggctaactattctgccatccctacgaccattgggggactgcggtttgaaagaagccatgactcccaaggcaagatctctgggagcccgcttgatatcacagctattcgcggatccttctctgtcaattaccggggcctgagactcagcctgtccgaggtgaccgccacatgcaccggcgaggttacgaacgtgagcgggtgctactcttgtatgaccggagccaaagtctccatcaagctgcacagctctaaaaattccacagctcatgtgcgctgcaagggcgacgaaaccgcgtttagcgttcttgagggggtgcactcctatacagtctctctcagcttcgatcacgccgtggttgacgaacagtgtcagctgaactgcggaggccatgagtcccaggtgaccctgaaggggaatctcatttttctggacgtccccaaattcgtggatggaagctacatgcaaacgtatcactcttccgtgcttacaggcgctaacatccctagccccaccgactggctgaatgccctctttggcaacgggctgtctaagtggattctgggagtcatcggcgttcttctcgggggactggccctgttctttctcatcatgagcctgttcaaacttggcacaaagcagatttttagatcccggaccaaactggcttga

SEQ ID NO: 14820 - RNA, 3222 nt, synthetic construct
  misc_feature 1..3222: note = derived and/or modified CDS sequence (opt5) from SFTSV(SPL003A)__AB817988.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttccttgagctgaagtctttttcccagagcgagttccccgatatctgcaaaattgacggaatcgtgtttaaccagtgtgaatctgaaagcctccctcaacccttcgatgtcgcctggatggacgtgggccactcccataagatcattatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggaggcctctgaagctaaatgtcggtgctccctggtgcataagcctggcgaggtggtcgtgagctatgggggaatgcgcgttagacccaaatgttacggcttttcccggatgatggccacgcttgaagtcaattctcctgagcagcgcatcgggcaatgcaccggatgtcacctggaatgcattaacggcggggtgagactcatcacactgaccagcgagctgaagtccgcgacagtgtgtgcctctcatttctgcagctccgctaccagcggcaagaaatctacggagattcagttccactccggaagcctcgttggcaagacagccatccacgtgaaaggggctctggtcgacggaaccgaatttacattcgagggctcttgtatgtttcccgatgggtgcgacgccgtggattgcaccttctgtcgggaatttcttaagaatccccagtgctaccctgcgaaaaagtggctgttcatcattatcgtcattctcctgggatatgccggccttatgctgctcaccaacgtgctgaaggctatcggggtttggggctcctgggtgattgccccggtcaaactgatgtttgctatcatcaagaaactcatgcgcagcgtgtcttgtctgatgggaaagctgatggacagaggccggcaagttattcatgaggaaatcggggagaatagagagggaaaccaggatgacgtgcgcattgaaatggcccggcccagacgcgtccggcactggatgtacagccctgtgatccttacaattctcgccatcggcctggctgaggggtgcgatgaaatggtgcatgcggactccaaacttgttagctgtaagcagggatctggcaatatgaaggagtgcgtcacgaccgggagagccctgctccccgctgtgaaccctggccaggaggcctgtctgcacttcacagcccccggatccccggatagcaaatgcctgaagattaaagtgaagcgcatcaatctcaaatgtaagaagtcctctagctattttgtccctgacgctcggtccagatgcacctctgtgcgccggtgtagatgggccggcgattgccaaagcgggtgcccctcccatttcacatctaacagcttttccgacgactgggcgggaaaaatggatcgcgctggcctggggttcagcggatgttctgacggctgcgggggcgccgcctgtggatgctttaatgctgccccttcctgtatcttctggcggaagtgggttgaaaacccccacggcattatctggaaagtgagcccttgcgctgcctgggtcccctctgcggtgattgagcttaccatgccgtccggggaagttagaacgttccaccctatgagcggaatccccacacaggtgtttaagggcgtctctgtgacctacctggggtccgatatggaggttagcggactcaccgacctgtgtgaaattgaggagctgaaatccaagaaacttgccctcgctccctgcaaccaggccggcatgggcgtggtcgggaaggtgggagaaatccagtgtagctctgaggaaagcgctcggacaatcaagaaagatggctgcatttggaatgccgacctggtggggatcgagctgcgcgtcgatgacgcggtttgttattccaagattacctctgtggaagccgtggctaactacagcgccatccctacaacgattggaggcctcagattcgagcggtcccatgattctcaagggaaaatcagcggatccccgctggacatcaccgctattagaggctcttttagcgtcaattatcgcggccttcggctgtccctcagcgagatcacagctacctgcacaggggaagtgaccaacgtttctggatgctactcctgtatgacgggcgccagagtgagcattaagctgcactcttccaaaaatagcaccgcccatgtccgctgcaagggggatgagacagcgttctccgtgctggaaggagttcactcttacaccgtgagcctttcctttgaccacgccgtcgtggatgagcagtgtcagctcaactgcggcgggcatgaaagccaggttacactgaagggaaatctgatcttcctcgacgtgcccaaatttgtcgacggctcttatatgcaaacctaccactccagcgtgcctacgggcgctaacattccctctcctacagattggctgaatgcccttttcgggaacggactgagcagatggatcctcggcgtgatcggggtcctgctgggaggccttgccctctttttcctgattatgtccctgtttaagctcgggaccaaacaggttttccggtctcgcacaaagctggcttga

SEQ ID NO: 14821 - RNA, 3222 nt, synthetic construct
  misc_feature 1..3222: note = derived and/or modified CDS sequence (opt5) from SFTSV(SPL004A)__AB817989.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctccctcaaccctttgatgtcgcctggatggacgtgggccactcccataagatcattatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatgcagttttgtaaggttgctggatgcgaacacggcgaggaggcctctgaagctaaatgtcggtgctccctggtgcataagcctggcgaggtggtcgtgagctacgggggaatgcgcgttagacccaaatgttacggcttctcccggatgatggccacgcttgaagtgaatcctcccgagcagcgcatcgggcaatgcaccggatgtcacctggaatgcatttctggcggggtcagactcatcacactgaccagcgagctgaagtccgcgacagtgtgtgcctctcatttttgcagctccgctaccagcggcaagaaatctacggagattcagttccactccggaagcctcgttggcaaggccgctatccacgtgaaaggggccctggtcgacggaacagagttcacctttgaaggctcttgtatgttccccgatgggtgcgacgcggtggattgcacattttgtcgggagttccttaagaaccctcagtgctatccggccaaaaagtggctgtttatcattatcgtcattctcctgggatacgctggccttatgctgctcaccaatgtgctgaaggccatcggggtttggggctcctgggtgattgctcccgtcaaactgatgttcgccatcatgaagaaactcatgcgcagcgtgtcttgtctgatgggaaagctgatggacagaggccggcaagttatccatgaagaaattggggagaacagagagggaaatcaggatgacgtgcgcatcgaaatggcccggcctagacgcgtccggcactggatgtatagccccgtgattctgaccatcctcgctattggcctggcggaggggtgcgatgaaatggtgcatgccgactccaaacttgttagctgtagacagggatctggcaacatgaaggagtgcgtcacaacggggcgcgctctgctccctgccgtgaatcccggccaggaggcctgtctgcactttaccgctccgggatcccctgatagcaagtgcctgaaaatcaaggtgaaacggattaacctcaagtgtaaaaagtcctctagctacttcgtccccgacgccagatcccgctgcacatctgtgcggagatgtcgctgggcgggcgattgccaaagcgggtgcccttcccattttacctctaatagcttctccgacgactgggctggaaagatggatcgggccggcctggggtttagcggatgttctgacggctgcgggggcgccgcttgtggatgcttcaacgccgctccctcctgtatcttttggagaaaatgggttgaaaatcctcacggcatcatttggaaggtgagcccctgcgccgcgtgggtcccgtctgccgtgatcgagcttacaatgccttccggggaagttcggaccttccaccccatgagcggcattcccacacaggtgttcaaaggagtctctgtgacgtatctggggtccgatatggaggttagcggactcaccgacctgtgtgaaatcgaggagctgaagtccaaaaagctcgctcttgccccttgcaaccaggctggcatgggcgtggtcgggaaagtgggagaaattcagtgtagctctgaggaaagcgcccgcaccatcaagaaggatggctgcatctggaacgcggacctggtggggattgagctgagagtcgatgacgccgtttgttactccaaaatcacatctgtggaagctgtggccaattatagcgctattccgaccacaatcggaggcctccggtttgagagatcccatgattctcaagggaagattagcggatctcccctggacatcacggccatccgcggctccttcagcgtcaactaccggggccttagactgtccctcagcgagattaccgccacatgcaccggggaagtgacaaatgtttctggatgctactcctgtatgaccggcgctaaagtgagcatcaagctgcactcttccaaaaacagcacggcgcatgtccgctgcaaggaggatgaaaccgccttttccgtgctggagggggttcactcttatacagtgagcctttccttcgaccacgctgtcgtggatgaacagtgtcagctcaattgcggaggccatgagagccacgttaccctgaaggggaacctgatttttctcgacgtgcctaaattcgtcgacggatcttacatgcagacatatcattccagcgtgcccaccggcgccaatatcccttctcccacggattggctgaacgccctttttggcaatgggctgagcagatggattctcggagtgatgggcgtcctgcttgggggacttgctctcttctttctgatcatgtccctgttcaagctcggcacaaaacaagtttttcggtctcgcaccaagctggcctga

SEQ ID NO: 14822 - RNA, 3222 nt, synthetic construct
  misc_feature 1..3222: note = derived and/or modified CDS sequence (opt5) from SFTSV(SPL005A)__AB817990.1__GP
  source 1..3222: mol_type = other RNA
atgatgaaggtgatctggttcagctccctgatttgcctcgtcatccagtgttctggcgacgccagccccattatctgcgctgggcctattcactccaacaaatctgccaatatcccgcatctgcttggatacagcgagaagatctgtcaaattgatagactgatccacgtttcctcttggctccggaaccatagccagtttcagggctatgtggggcagcgcggaggcagatcccaagtgagctacttccccgcggaaaattcttattcccggtggagcgggctgctttctccttgcgacgctgattggctgggaatgctcgtcgtgaaaaaggccaaaggctccgacatgattgttcccggccctagctacaaggggaaggtgtttttcgagcgccccacctttgatggatatgtcggctgggggtgtggatctggcaaatccagaacagaaagcggggagctgtgctcctctgacagcggaacgtccagcggcctgctcccttctgatcgggtgctgtggatcggcgacgttgcctgtcagccgatgacccccattcctgaagagacattccttgagctgaagtcctttagccagtctgagttccccgatatctgcaaaattgacgggatcgtgtttaaccagtgtgaaagcgaatccctccctcaacccctggatgtcgcttggatggacgtgggacactctcataagatcattatgcgcgagcacaaaaccaagtgggtgcaggagagctccagcaaggatttcgtctgctacaaagaaggcacagggccgtgttctgagtccgaagagaagacctgcaaaacaagcggatcttgcagaggcgacatgcagttttgtaaggttgccgggtgcgaacacggagaggaggcttccgaagccaaatgtcggtgcagccttgtgcataagcctggcgaggtggtcgtgtcctatggcgggatgcgcgttagacccaaatgttacggattctctcggatgatggcgaccctggaagtgaatcctctcgagcagcgcatcggccaatgcacggggtgtcacctggaatgcattaacggaggcgtcagactgatcaccctcacaagcgagctgaagtccgccaccgtgtgtgcttctcatttttgcagctccgccacaagcgggaagaaatctaccgagattcagttccactccggcagccttgttggaaagacggctatccacgtgaaaggcgccctggtcgacgggacagagttcacctttgaaggatcttgtatgttccccgatggctgcgacgcggtggattgcacattttgtcgggagttcctcaagaatccccagtgctaccctgccaaaaagtggctgtttatcattatcgtcattcttctggggtatgctggactcatgctgctgaccaacgtgctcaaggccatcggcgtttgggggtcctgggtgattgctccggtcaaactgatgttcgccatcatcaagaaacttatgcgcagcgtgtcttgtctgatgggcaagctcatggacagaggacggcaagttattcatgaagaaatcggcgagaatagagaggggaaccaggatgacgtgcgcattgaaatggcccggcccagacgcgtccggcactggatgtacagccctgtgatcctgaccattcttgctatcggactggcggagggctgcgatgaaatggtgcatgccgactccaaactcgttagctgtaagcaagggggaggcaatatgaaggagtgcgtcacaacggggagagctctgctgcccgccgtgaaccctggccaggaggcctgtctccactttaccgctcccggatctccggattccaaatgcctgaagattaaagtgaagcgcatcaatcttaaatgtaagaagtcctcctcttatttcgtccctgacgcccggagcagatgcacatccgtgcgccggtgtagatgggcgggcgattgccagtctgggtgccccagccattttacctccaactctttcagcgacgactgggctggaaaaatggatcgcgccggcctggggttttccggatgtagcgacggctgcgggggcgccgcttgtggatgcttcaatgccgctccttcttgtatcttttggcggaagtgggttgaaaacccccacggcattatctggaaagtgtccccttgcgccgcgtgggtccccagcgccgtgattgagctcacaatgccgtctggggaagttagaaccttccaccctatgtccggaatccccacacaggtgttcaagggcgtcagcgtgacgtacctggggtctgatatggaggtttccggactgaccgacctttgtgaaattgaggagctcaaaagcaagaaactggctctggccccctgcaaccaggctggcatgggcgtggtcgggaaggtgggagaaatccagtgttccagcgaggaatctgcccggaccatcaagaaagatggctgcatttggaatgcggacctcgtggggatcgagctgcgcgtcgatgacgccgtttgttatagcaagattacatccgtggaagctgtggccaactactctgctatccctaccacaattggaggccttagatttgagcggagccatgattcccaagggaaaatctctggaagcccgctggacatcacggccattagaggctccttctctgtcaattatcgcggcctccggctgagcctgtccgagatcaccgccacatgcaccggggaagtgacaaacgttagcggatgctactcttgtatgaccggcgctaaggtgtccattaaacttcacagctctaagaatagcacggcgcatgtcagatgcaagggggatgagaccgcctttagcgtgctcgaaggagttcactcctacacagtgtctctgagcttcgaccacgctgtcgtggatgagcagtgtcagctgaactgcggcgggcatgaatcccaggttaccctcaaaggaaatctgatctttcttgacgtgcccaagttcgtcgacggcagctatatgcaaacataccactcttccgtgcctaccggcgccaacattcccagccctacggattggctgaatgccctctttgggaacggactgtctcgctggatcctgggcgtgatcggggtccttctcggaggcctggctctgttctttctcattatgagcctgttcaaacttgggacaaagcaggtttttagatcccggaccaaactggcctga

SEQ ID NO: 14823 - RNA, 3222 nt, synthetic construct
  misc_feature 1..3222: note = derived and/or modified CDS sequence (opt5) from SFTSV(SPL010A)__AB817991.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttccttgagctgaagtctttttcccagagcgagttccccgatatctgcaaaattgacggaatcgtgtttaaccagtgtgaatctgaaagcctccctcaacccttcgatgtcgcctggatggacgtgggccactcccataagatcattatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggaggcctctgaagctaaatgtcggtgctccctggtgcataagcctggcgaggtggtcgtgagctatgggggaatgcgcgttagacccaaatgttacggcttttcccggatgatggccacgcttgaagtcaattctcctgagcagcgcatcgggcaatgcaccggatgtcacctggaatgcattaacggcggggtgagactcatcacactgaccagcgagctgaagtccgcgacagtgtgtgcctctcatttctgcagctccgctaccagcggcaagaaatctacggagattcagttccactccggaagcctcgttggcaagacagccatccacgtgaaaggggctctggtcgacggaaccgaatttacattcgagggctcttgtatgtttcccgatgggtgcgacgccgtggattgcaccttctgtcgggaatttcttaagaatccccagtgctaccctgcgaaaaagtggctgttcatcattatcgtcattctcctgggatatgccggccttatgctgctcaccaacgtgctgaaggctatcggggtttggggctcctgggtgattgccccggtcaaactgatgtttgctatcatcaagaaactcatgcgcagcgtgtcttgtctgatgggaaagctgatggacagaggccggcaagttattcatgaggaaatcggggagaatagagagggaaaccaggatgacgtgcgcattgaaatggcccggcccagacgcgtccggcactggatgtacagccctgtgatccttacaattctcgccatcggcctggctgaggggtgcgatgaaatggtgcatgcggactccaaacttgttagctgtaagcagggatctggcaatatgaaggagtgcgtcacgaccgggagagccctgctccccgctgtgaaccctggccaggaggcctgtctgcacttcacagcccccggatccccggatagcaaatgcctgaagattaaagtgaagcgcatcaatctcaaatgtaagaagtcctctagctattttgtccctgacgctcggtccagatgcacctctgtgcgccggtgtagatgggccggcgattgccaaagcgggtgcccctcccatttcacatctaacagcttttccgacgactgggcgggaaaaatggatcgcgctggcctggggttcagcggatgttctgacggctgcgggggcgccgcctgtggatgctttaatgctgccccttcctgtatcttctggcggaagtgggttgaaaacccccacggcattatctggaaagtgagcccttgcgctgcctgggtcccctctgcggtgattgagcttaccatgccgtccggggaagttagaacgttccaccctatgagcggaatccccacacaggtgtttaagggcgtctctgtgacctacctggggtccgatatggaggttagcggactcaccgacctgtgtgaaattgaggagctgaaatccaagaaacttgccctcgctccctgcaaccaggccggcatgggcgtggtcgggaaggtgggagaaatccagtgtagctctgaggaaagcgctcggacaatcaagaaagatggctgcatttggaatgccgacctggtggggatcgagctgcgcgtcgatgacgcggtttgttattccaagattacctctgtggaagccgtggctaactacagcgccatccctacaacgattggaggcctcagattcgagcggtcccatgattctcaagggaaaatcagcggatccccgctggacatcaccacaattagaggctcttttagcgtcaattatcgcggccttcggctgtccctcagcgagatcaccgctacatgcaccggggaagtgacgaacgtttctggatgctactcctgtatgaccggcgccagagtgagcattaagctgcactcttccaaaaatagcacagcccatgtccgctgcaagggggatgagaccgctttctccgtgctggaaggagttcactcttacacagtgagcctttcctttgaccacgcggtcgtggatgagcagtgtcagctcaactgcggcgggcatgaaagccaggttaccctgaagggaaatctgatcttcctcgacgtgcccaaatttgtcgacggctcttatatgcaaacgtaccactccagcgtgcctacaggcgccaacattccctctcctaccgattggctgaatgctcttttcgggaacggactgagcagatggatcctcggcgtgatcggggtcctgctgggaggccttgccctctttttcctgattatgtccctgtttaagctcgggacaaaacaggttttccggtctcgcaccaagctggcctga

SEQ ID NO: 14824 - RNA, 3222 nt, synthetic construct
  misc_feature 1..3222: note = derived and/or modified CDS sequence (opt5) from SFTSV(SPL030A)__AB817992.1__GP
  source 1..3222: mol_type = other RNA
atgatgaaggtgatctggttcagctccctgatttgcctcgtcatccagtgttctggcgacaccagccccattatctgcgccgggcctattcactccaacaaatctgctagcatcccgcatctgcttggatactccgagaagatctgtcaaattgatagactgatccacgtttctagctggctccggaatcattcccagtttcagggctatgtggggcagcgcggaggcagaagccaagtgtcttacttccccgccgaaaactcctatagccggtggtctgggctgctttccccttgcgacgcggattggctgggaatgctcgtcgtgaaaaaggctaaaggcagcgacatgattgttcccggcccttcttacaaggggaaggtgtttttcgagcgccccacatttgatggatatgtcggctgggggtgtggatccggcaaaagcagaacggaatccggggagctgtgctctagcgactccggaaccagctctggcctgctcccttccgatcgggtgctgtggatcggcgacgttgcctgtcagccgatgacacccattcctgaagagaccttccttgagcttaagagcttttctcagagcgagttccccgatatctgcaaaattgacgggatcgtgtttaatcagtgtgaatccgaatctctccctcaacccctggatgtcgcctggatggacgtgggacacagccataagatcattatgcgcgagcacaaaacaaagtgggtgcaggagtccagctctaaggatttcgtctgctacaaagaaggcaccgggccgtgttccgagagcgaagagaagacatgcaaaacctctggatcctgcagaggcgacatgcagttttgtaaggttgctgggtgcgaacacggagaggaggccagcgaagctaaatgtcggtgctcccttgtgcataagcctggcgaggtggtcgtgtcttatggcgggatgcgcgttagacccaaatgttacggattcagccggatgatggccacgctggaagtgaaccctcccgagctccgcatcggccagtgcaccgggtgtcacctggaatgcattaatggaggcgtcagactgatcacactcacctccgagctgaagtctgcgacagtgtgtgccagccatttttgctccagcgctacctctgggaagaaatccacggagattcaattccacagcggctctcttgttggaaagacagccatccacgtgaaaggcgctctggtcgacgggaccgagttcacatttgaaggatcctgtatgttccccgatggctgcgacgccgtggattgcaccttttgtcgggagttcctcaagaaccctcagtgctacccggcgaaaaagtggctgtttatcattatcgtcattcttctggggtatgccggactcatgctgctgaccaatgtgctcaaggctatcggcgtttgggggagctgggtgattgcccccgtcaaactgatgttcgctatcatcaagaaacttatgcgctctgtgagctgtctgatgggcaagctcatggacagaggacggcaggttattcatgaagaaatcggcgagaacagagaggggaatcaagatgacgtgcgcattgaaatggcccggcctagacgcgtccggcactggatgtactcccccgtgatcctgacaattcttgccatcggactggctgagggctgcgatgaaatggtgcatgcggacagcaaactcgtttcttgtaagcaagggggaggcaacatgaaggagtgcgtcacgaccgggagagccctgctgcctgctgtgaatcccggccaggaggcctgtctccactttacagccccgggatcccctgatagcaaatgcctgaagattcgcgtgaaacggatcaaccttaagtgtaaaaagtcctctagctatttcgtccccgacgctagatcccgctgcacctctgtgcggagatgtcgctgggccggcgattgccagagcgggtgcccttcccattttacatctaatagcttctccgacgactgggcgggaaagatggatcgggctggcctggggtttagcggatgttctgacggctgcgggggcgccgcctgtggatgcttcaacgctgccccctcctgtatcttttggagaaaatgggttgaaaatcctcacggcattatctggaaggtgagcccctgcgctgcctgggtcccgtctgcggtgattgagctcaccatgccttccggggaagttcggacgttccaccccatgagcggaatccccacacaggtgttcaaaggcgtctctgtgacctacctggggtccgatatggaggttagcggactgaccgacctttgtgaaattgaggagctcaagtccaaaaagctggccctggctccttgcaaccaggccggcatgggcgtggtcgggaaagtgggagaaatccagtgtaacagcgaggaatctgctcgcacaatcaagaaggatggctgcatttggaatgccgacctcgtggggatcgagctgagagtcgatgacgcggtttgttatagcaaaattacctccgtggaagccgtggctaactactctgccatcccgacaacgattggaggccttcggtttgagagaagccatgattcccaggggaagatctctggaagccccctggacatcaccgctattcgcggctccttctctgtcaattatcggggcctcagactgagcctgtccgagatcacagctacctgcacaggggaagtgaccaacgttagcggatgctactcttgtatgacgggcgccaaagtgtccattaagctgcacagctctaaaaattccaccgcccatgtccgctgcaagggggatgagacagcgtttagcgtgctcgaaggagttcactcctacaccgtgtctctgagcttcgaccacgccgtcgtggatgagcaatgtcagctgaactgcggcgggcatgaatcccaggttacactcaagggaaatctgatctttcttgacgtgcctaaattcgtcgacggcagctatatgcagacctaccactcttccgtgcccacgggcgctaacattcctagccccacagattggctgaatgccctctttgggaacggactgtctagatggatcctgggcgtgatcggggtccttctcggaggcctggccctgttctttctcattatgagcctgttcaaacttgggaccaagcaagtttttcggtcccgcacaaagctggcttga

SEQ ID NO: 14825 - RNA, 3222 nt, synthetic construct
  misc_feature 1..3222: note = derived and/or modified CDS sequence (opt5) from SFTSV(SPL053A)__AB985292.1__GP
  source 1..3222: mol_type = other RNA
atgatgaaggtgatctggttcagctccctgatttgcctcgtcatccagtgttctggcgacaccgggcccattatctgcgccggacctattcacagcaacaaaggcgctaatatcccgcatctgcttgggtactccgagaagatctgtcaaattgatagactgatccacgtttctagctggctccggaaccattcccagtttcagggatatgtgggccagcgcgggggaagatctcaagtgagctacttccccgccgaaaattcctatagccggtggtctggcctgctttccccttgcgacgcggattggctgggcatgctcgtcgtgaaaaaggctaaagggagcgacatgattgttcccggaccttcttacaagggcaaggtgtttttcgagcgccccacatttgatgggtatgtcggatggggctgtgggtccggaaaaagcagaacggaatctggcgagctgtgcatctccgacagcggcacctcctctgggctgctccctagcgatcgggtgctgtggattggagacgttgcctgtcagccgatgacacccatccctgaagagaccttccttgagctgaagtcctttagccagtctgagttccccgatatttgcaaaatcgacggcatcgtgtttaaccagtgtgaatccgaaagcctccctcaacccttcgatgtcgcctggatggacgtggggcactctcataagattatcatgcgcgagcacaaaacaaagtgggtgcaggagagctcctctaaggattttgtctgctacaaagaaggaaccggcccgtgtagcgagtccgaagagaagacatgcaaaaccagcgggtcttgcagaggagacatgcagttctgtaaggttgctggctgcgaacacggcgaggaggcctccgaagctaaatgtcggtgcagcctggtgcataagcctggggaggtggtcgtgtcttatggaggcatgcgcgttagacccaaatgttacgggttttcccggatgatggccacgcttgaagtgaatagccctgagcagcgcattggacaatgcaccggctgtcacctggaatgcatcaacgggggcgtcagactcattacactgacctccgagctgaagtctgcgacagtgtgtgccagccatttctgctcctctgctaccagcggaaagaaatccacggagatccagttccacagcggctctctcgttgggaagacagccatccacgtgaaaggagctctggtcgacggcaccgaatttacattcgaggggtcctgtatgtttcccgatggatgcgacgccgtggattgcaccttctgtcgggaatttcttaagaatccccagtgctaccctgcgaaaaagtggctgttcattatcattgtcatcctcctgggctatgccgggcttatgctgctcaccaacgtgctgaaggctattggcgtttggggaagctgggtgatcgccccggtcaaactgatgtttgctatcattaagaaactcatgcgctctgtgtcctgtctgatgggcaagctgatggacagagggcggcaagttatccatgaggaaattggagagaatagagagggcaaccaggatgacgtgcgcatcgaaatggcccggcccagacgcgtccggcactggatgtacagccctgtgattcttacaatcctcgccattgggctggctgagggatgcgatgaaatggtgcatgcggactctaaacttgttagctgtaagcagggctccgggaatatgaaggagtgcgtcacgaccggcagagccctgctccccgctgtgaaccctggacaggaggcctgtctgcacttcacagcccccggcagcccggattctaaatgcctgaagatcaaagtgaagcgcatcaatctcaaatgtaagaagtccagctcctattttgtccctgacgctcggtctagatgcaccagcgtgcgccggtgtagatgggccggggattgccaatccggatgcccctctcatttcacaagcaactccttttctgacgactgggcgggcaaaatggatcgcgctgggctgggattcagcggctgttccgacgggtgcggcggagccgcctgtggctgctttaatgctgcccctagctgtattttctggcggaagtgggttgaaaacccccacgggatcatttggaaagtgtctccttgcgctgcctgggtcccctccgcggtgatcgagcttaccatgccgagcggagaagttagaacgttccaccctatgtctggcattcccacacaggtgtttaagggggtctccgtgacctacctgggaagcgatatggaggtttctggcctcaccgacctgtgtgaaatcgaggagctgaaatccaagaaacttgccctcgctccctgcaaccaggccggcatgggggtggtcggaaaggtgggcgaaatccagtgtagctccgaggaaagcgctcggacaattaagaaagatgggtgcatctggaatgccgacctggtgggaattgagctgcgcgtcgatgacgcggtttgttattctaagatcaccagcgtggaagccgtggctaactactccgccattcctacaacgatcggcgggctcagattcgagcggtctcatgatagccaaggaaaaatctccggctctccgctggacattaccgctatcagaggcagcttttccgtcaattatcgcgggcttcggctgtctctcagcgagattacagctacctgcacaggagaagtgaccaacgtttccggctgctacagctgtatgacgggggccagagtgtctatcaagctgcactccagcaaaaattctaccgcccatgtccgctgcaagggagatgagacagcgttctccgtgctggaaggcgttcacagctacaccgtgtccctttcttttgaccacgccgtcgtggatgagcagtgtcagctcaactgcgggggacatgaaagccaggttacactgaagggcaatctgattttcctcgacgtgcccaaatttgtcgacggctcctatatgcaaacctaccacagctctgtgcctacgggggctaacatcccctcccctacagattggctgaatgcccttttcggaaacggcctgagcagatggatcctcggggtgattggagtcctgctgggcgggcttgccctctttttcctgatcatgtctctgtttaagctcggaaccaaacaggttttccggagccgcacaaagctggcttga

SEQ ID NO: 14826 - RNA, 3222 nt, synthetic construct
  misc_feature 1..3222: note = derived and/or modified CDS sequence (opt5) from SFTSV(SPL054A)__AB985293.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttcatggagcttaagtctttttcccagagcgaatttcccgatatctgcaaaattgacggaatcgtgtttaaccagtgtgagtctgaaagcctgcctcaacccttcgatgtcgcctggatggacgtgggccactcccataagatcattatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggaggcctctgaagctaaatgtcggtgctccctcgtgcataagcctggcgaggtggtcgtgagctatgggggaatgcgcgttagacccaaatgttacggcttttcccggatgatggccacgctggaagtgaatcctcccgagcagcgcatcgggcaatgcaccggatgtcaccttgaatgcattaacggcggggtcagactgatcacactcacctctgagctgaagtccgcgacagtgtgtgcctcccatttctgctctagcgctacctccggcaagaaaagcacggagattcagttccactctggatccctggttggcaagacagccatccacgtgaaaggggctctcgtcgacggaaccgaatttacattcgagggcagctgtatgtttcccgatgggtgcgacgccgtggattgcaccttctgtcgggaatttctgaagaatcctcagtgctacccggcgaaaaagtggcttttcatcattatcgtcattctgctcggatatgccggcctgatgcttctgaccaacgtgctcaaggctatcggggtttggggctcttgggtgattgcccccgtcaaactgatgtttgctatcatcaagaaactgatgcgctccgtgagctgtctcatgggaaagctgatggacagaggccggcaagttattcatgaggaaatcggggagaatggagagggcaaccaggatgacgtgagaattgaaatcgcccgccctcggagagtccgccactggatgtactctcccgtgattcttacaatcctggccattgggctcgctgagggatgcgatgaaatggtgcatgcggacagcaaactggtttcctgtaagcagggcagcgggaatatgaaggagtgcgtcacgaccggccgggcccttctgcctgctgtgaaccccggacaggaggcctgtctccacttcacagccccgggctctcctgattccaaatgcctgaagatcaaagtgaagagaatcaatctgaaatgtaaaaagagctcctcttattttgtccccgacgctcgcagccggtgcacctccgtgagacgctgtcggtgggccggggattgccaatctggatgccctagccatttcacatccaactcttttagcgacgactgggcgggcaagatggatagagctgggctcggattctccggctgtagcgacgggtgcggcggagccgcctgtggctgctttaatgctgccccctcttgtattttctggcgcaagtgggttgaaaaccctcacgggatcatttggaaagtgtccccctgcgctgcctgggtcccgagcgcggtgatcgagctgaccatgccttctggagaagttcggacgttccaccccatgtccggcattcccacacaggtgtttaagggggtcagcgtgacctaccttggatctgatatggaggtttccggcctgaccgacctctgtgaaatcgaggagctgaaaagcaagaaactggcccttgctccttgcaaccaggccggcatgggggtggtcggaaaggtgggcgaaatccagtgttccagcgaggaatctgctagaacaattaagaaagatgggtgcatctggaatgccgacctcgtgggaattgagctgcgggtcgatgacgcggtttgttatagcaagatcacctccgtggaagccgtggctaactactctgccattccgacaacgatcggcgggctgcgcttcgagagaagccatgattcccaaggaaaaatctctggcagccccctcgacattaccgctatccggggctccttttctgtcaattatagagggctgcgccttagcctgtccgagattacagctacctgcacaggagaagtgaccaacgttagcggctgctactcttgtatgacgggggccaaggtgtccatcaaactccacagctctaagaatagcaccgcccatgtccggtgcaagggagatgagacagcgttcagcgtgctggaaggcgttcactcctacaccgtgtctctgagctttgaccacgccgtcgtggatgagcagtgtcagcttaactgcgggggacatgaatcccaggttacactcaaaggcaatctgattttcctggacgtgcctagatttgtcgacggcagctatatgcaaacctaccactcttccgtgcccacgggggctaacatccctagccccacagattggctcaatgccctgttcggaaacggcctttctcgctggatcctgggggtgattggagtcctcctgggcgggctggcccttttcttcctcatcatgagcctgtttaagctgggaaccaaacaggttttcagatcccggacaaagctcgcttga

SEQ ID NO: 14827 - RNA, 3222 nt, synthetic construct
  misc_feature 1..3222: note = derived and/or modified CDS sequence (opt5) from SFTSV(SPL055A)__AB985294.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttccttgagctgaagtctttttcccagagcgagttccccgatatctgcaaaattgacggaatcgtgtttaaccagtgtgaatctgaaagcctccctcaacccttcgatgtcgcctggatggacgtgggccactcccataagatcattatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggaggcctctgaagctaaatgtcggtgctccctggtgcataagcctggcgaggtggtcgtgagctatgggggaatgcgcgttagacccaaatgttacggcttttcccggatgatggccacgcttgaagtcaattctcctgagcagcgcatcgggcaatgcaccggatgtcacctggaatgcattaacggcggggtgagactcatcacactgaccagcgagctgaagtccgcgacagtgtgtgcctctcatttctgcagctccgctaccagcggcaagaaatctacggagattcagttccactccggaagcctcgttggcaagacagccatccacgtgaaaggggctctggtcgacggaaccgaatttacattcgagggctcttgtatgtttcccgatgggtgcgacgccgtggattgcaccttctgtcgggaatttcttaagaatccccagtgctaccctgcgaaaaagtggctgttcatcattatcgtcattctcctgggatatgccggccttatgctgctcaccaacgtgctgaaggctatcggggtttggggctcctgggtgattgccccggtcaaactgatgtttgctatcatcaagaaactcatgcgcagcgtgtcttgtctgatgggaaagctgatggacagaggccggcaagttattcatgaggaaatcggggagaatagagagggaaaccaggatgacgtgcgcattgaagtcgcccggcccagacgcgtgcggcactggatgtacagccctgtgatccttacaattctcgccatcggcctggctgaggggtgcgatgaaatggttcatgcggactccaaacttgtcagctgtaagcagggatctggcaatatgaaggagtgcgtgacgaccgggagagccctgctccccgctgtgaaccctggccaggaggcctgtctgcacttcacagcccccggatccccggatagcaaatgcctgaagattaaagtcaagcgcatcaatctcaaatgtaagaagtcctctagctattttgtgcctgacgctcggtccagatgcacctctgttcgccggtgtagatgggccggcgattgccaaagcgggtgcccctcccatttcacatctaacagcttttccgacgactgggcgggaaaaatggatcgcgctggcctggggttcagcggatgttctgacggctgcgggggcgccgcctgtggatgctttaatgctgccccttcctgtatcttctggcggaagtgggtggaaaacccccacggcattatctggaaagtcagcccttgcgctgcctgggtgccctctgcggttattgagcttaccatgccgtccggggaagtgagaacgttccaccctatgagcggaatccccacacaggtctttaagggcgtgtctgttacctacctggggtccgatatggaggtgagcggactcaccgacctgtgtgaaattgaggagctgaaatccaagaaacttgccctcgctccctgcaaccaggccggcatgggcgtcgtggggaaggtgggagaaatccagtgtagctctgaggaaagcgctcggacaatcaagaaagatggctgcatttggaatgccgacctggtcgggatcgagctgcgcgttgatgacgcggtgtgttattccaagattacctctgtggaagccgtcgctaactacagcgccatccctacaacgattggaggcctcagattcgagcggtcccatgattctcaagggaaaatcagcggatccccgctggacatcaccgctattagaggctcttttagcgtgaattatcgcggccttcggctgtccctcagcgagatcacagctacctgcacaggggaagttaccaacgtgtctggatgctactcctgtatgacgggcgccagagtcagcattaagctgcactcttccaaaaatagcaccgcccatgtgcgctgcaagggggatgagacagcgttctccgttctggaaggagtgcactcttacaccgtcagcctttcctttgaccacgccgtggttgatgagcagtgtcagctcaactgcggcgggcatgaaagccaggtgacactgaagggaaatctgatcttcctcgacgtccccaaatttgtggacggctcttatatgcaaacctaccactccagcgtgcctacgggcgctaacattccctctcctacagattggctgaatgcccttttcgggaacggactgagcagatggatcctcggcgtcatcggggttctgctgggaggccttgccctctttttcctgattatgtccctgtttaagctcgggaccaaacaggtgttccggtctcgcacaaagctggcttga

SEQ ID NO: 14828 - RNA, 3222 nt, synthetic construct
  misc_feature 1..3222: note = derived and/or modified CDS sequence (opt5) from SFTSV(SPL057A)__AB985295.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctgatatcccgcatctgcttggctactctgagaagatctgtcaaattgacagactgatccacgttagctcctggctccggaatcattctcagtttcaggggtatgtgggacagcgcggcgggagaagccaagtgtcctactatcccgccgaaaacagctactctcggtggtccggactgcttagcccttgcgatgcggactggctgggcatgctcgtcgtgaaaaaggctaaaggctctgatatgattgttcccgggccttcctataagggaaaggtgttctttgagcgccccacattcgacggctacgtcgggtggggatgtggcagcgggaaatctagaacggaatccggagagctgtgcagctccgattctggcaccagctccggcctgctccctagcgaccgggtgctgtggatcggggatgttgcctgtcagccgatgacacccattcctgaagagacctttcttgagctgaagtctttctcccagagcgaatttcccgacatctgccgcattgatggaatcgtgttcaatcagtgtgagtctgaaagcctccctcaaccctttgacgtcgcctggatggatgtgggccactcccataaaatcattatgagagagcacaagacaaaatgggtgcaggagtctagctccaaggacttcgtctgctataaggaagggaccggaccgtgtagcgagtctgaagagaaaacatgcaagacctccggcagctgccgcggggacatgcagttttgtaaagttgctggatgcgaacacggcgaggaggcctctgaagctaagtgtcggtgctccctggtgcataaacctggcgaggtggtcgtgagctacgggggaatgagagttcggcccaagtgttacggcttctcccgcatgatggccacgcttgaagtgaaccctcccgagcagagaatcgggcaatgcaccggatgtcacctggaatgcgtcaatggcggggtgcggctcattacactgacctctgagctgaaaagcgcgacagtttgtgcctcccatttttgctctagcgctatctccggcaaaaagagcaccgagattcagttccactctggatccctcgtgggcaagacggccatccacgtcaagggggctctggtggatggaacagaatttacctttgagggcagctgtatgttccccgacgggtgcgatgccgtcgactgcacattttgtcgcgagttccttaaaaaccctcagtgctatccggcgaagaaatggctgtttatcattatcgtgattctcctgggatacgccggccttatgctgctcaccaatgttctgaaggctatcggggtgtggggctcttgggtcattgcccccgtgaagctgatgttcgctatcatgaaaaagctcatgagatccgttagctgtctgatgggaaaacttatggatcggggcagacaagtgatccatgaagaaattggggagaaccgcgagggaaatcaggacgatgtccggatcgaaatggccagacctcgccgggtgagacactggatgtattctcccgtgattctgaccatcctcgccgttggcctggctgaggggtgcgacgaaatggtccatgcggatagcaaacttgtgtcctgtaagcagggaagcggcaacatgaaggagtgcgtgacaacggggcgcgccctgctccctgctgtcaatcccggccaggaggcctgtctgcactttaccgccccgggatctcctgactccaagtgcctgaaaattaaggtgaaaaagatcaacctcaaatgtaaaaagagctcctcttacttcgttcccgatgctcggagcagatgcacatccgtgcgccggtgtagatgggccggcgactgccaatctgggtgccctagccattttacctccaattctttcagcgacgattgggcgggaaagatggaccgcgctggcctggggttttccggatgtagcgatggctgcgggggcgccgcctgtggatgcttcaacgctgccccctcttgtattttctggcggaagtgggtcgaaaatcctcacggcatcatctggaaagtgtccccctgcgctgcctgggttccgagcgcggtgattgagcttacaatgccttctggggaagtcagaaccttccaccccatgtccggaatccccacacaggtgttcaagggcgttagcgtgacgtatctggggtctgacatggaggtctccggactcaccgatctgtgtgaaattgaggagctgaaaagcaagaaacttgccctcgctccttgcaaccaggccggcatgggcgtggtggggaaggtcggagaaatccagtgttccagcgaggaatctgctcggaccattaagaaagacggctgcatctggaacgccgatctggttgggatcgagctgcgcgtggacgatgcggtgtgttacagcaagattacatccgtcgaagccgtggctaattattctgccatcccgaccacaattggaggcctcagatttgagcggagccatgactcccaagggaaaatctctggaagccccctggatattacggctatcagaggctccttctctgttaactaccgcggccttcggctgagcctctccgagatcaccgccacatgcaccggggaagtgacaaatgtcagcggatgctactcttgtatgaccggcgccaaggtgtccattaaactgcacagcaacaaaaattctacggctcatgttagatgcaagggggacgagaccgcgttttccgtgctggaaggagtccacagctatacagtgtccctttctttcgatcacgccgttgtggacgagcagtgtcagctcaactgcggcgggcatgaaagccaggtcaccctgaagggaaatctgatctttctcgacgtgcctaagttcgtggatggctcctacatgcaaacatatcacagctctgtccccaccggcgctaacattccttcccccacggactggctgaatgccctttttgggaacggactgagccgctggatcctcggcgttattggggtgctgctgggaggccttgccctcttctttctgatcatgtctctgttcaaactcgggacaaaacaggtgtttagaagccggaccaagctggcttga

SEQ ID NO: 14829 - RNA, 3222 nt, synthetic construct
  misc_feature 1..3222: note = derived and/or modified CDS sequence (opt5) from SFTSV(SPL062A)__AB985297.1__GP
  source 1..3222: mol_type = other RNA
atgatgaaggtgatctggttcagctccctgatttgcctcgtcatcagatgttctggcgggaccggacccattatctgcgccggccctattcacagcaacaaatccgctaatatcccgcatctgcttgggtactctgagaagatctgtcagattgaccggctgatccacgttagctcctggctccgcaaccattctcaatttcagggatatgtgggccagagagggggacggagccaggtgtcctacttccccgccgaaaatagctattctcgctggtccggcctgcttagcccttgcgatgcggactggctgggcatgctcgtcgtgaaaaaggctagagggtctgatatgattgttcccggaccttcctacaaaggcaaggtgtttttcgagcggcccacatttgacgggtatgtcggatggggctgtgggagcggaaagtctcgcacggaatccggcgagctgtgcagctccgattctggcaccagctccgggctgctccctagcgacagagtgctgtggatcggagatgttgcctgtcaaccgatgacacccattcctgaagagaccttccttgagctgaaatctttttcccagagcgagttccccgacatctgcaagattgatggcatcgtgtttaaccagtgtgaatctgaaagcctccctcagcccttcgacgtcgcctggatggatgtggggcactcccataaaatcattatgcgggagcacaagacaaaatgggtgcaagagtctagctccaaggactttgtctgctacaaggaaggaaccggcccgtgtagcgagtctgaagagaaaacatgcaagacctccgggagctgccgcggagatatgcagttctgtaaagttgctggctgcgaacacggcgaggaggcctctgaagctaagtgtagatgctccctggtgcataaacctggggaggtggtcgtgagctatggaggcatgcgggttcgccccaagtgttacgggttttccagaatgatggccacgcttgaagtgaatcctcccgagcagcggatcggacagtgcaccggctgtcacctggaatgcattaacgggggcgtccgcctcatcacactgacctctgagctgaaaagcgcgacagtgtgtgcctcccatttctgctctagcgctacctccggaaagaaaagcacggagattcaattccactctggctccctcgttgggaagacagccatccacgtgaagggagctctggtcgacggcaccgaatttacattcgaggggagctgtatgtttcccgacggatgcgatgccgtggactgcaccttctgtagagaatttcttaaaaatcctcagtgctacccggcgaagaaatggctgttcatcattatcgccattctcctgggctatgctgggcttatgctgctcaccaacgtcctgaaggccatcggcgtgtggggatcttgggttattgctcccgtgaagctgatgtttgccatcatcaaaaagctcatgcggtccgtcagctgtctgatgggcaaacttatggatagagggcgccaggtgattcatgaggaaatcggagagaatcgggagggcaaccaagacgatgttagaattgaaatggcccgccctcggagagtgcgccactggatgtactctcccgtcatcctgacaattctcgctatcgggctggcggagggatgcgacgaaatggtgcatgccgatagcaaacttgtgtcctgtaagcagggcagcgggaatatgaaggagtgcgttacgaccggccgggctctgctccctgccgtcaaccccggacaggaggcctgtctgcacttcacagctccgggctctcctgactccaagtgcctgaaaattaaggtgaaaagaatcaatctcaagtgtaaaaagagctcctcttattttgtgcccgatgcccgcagccggtgcacctccgtcagacgctgtcggtgggcgggggactgccagtctggatgccctagccatttcacatccaactcttttagcgatgactgggctggcaagatggacagagccgggctgggattctccggctgtagcgatgggtgcggcggagccgcttgtggctgctttaatgccgctccctcttgtatcttctggcggaaatgggtggaaaaccctcacgggattatctggaaggtttccccctgcgccgcgtgggtgccgagcgccgtcattgagcttaccatgccttctggagaagtgcgcacgttccaccccatgtccggcatccccacacaagtttttaaaggggtgagcgtcacctacctgggatctgacatggaggtgtccggcctcaccgatctgtgtgaaattgaggagcttaagagcaaaaagctggctctcgccccttgcaaccaggctggcatgggggttgtgggaaaagtcggcgaaatccagtgttccagcgaggaatctgccagaacaatcaagaaggacgggtgcatttggaatgcggatctggtgggaatcgagctgcgggtggacgatgccgtctgttatagcaaaattacctccgttgaagctgtggccaactactctgctatcccgacaacgattggcgggctcagattcgagcgcagccatgactcccagggaaagatctctggcagccccctggatatcaccgccattcggggctccttttctgtgaattatagagggcttcgcctgagcctctccgagatcacagctacctgcacaggagaagtcaccaacgtgagcggctgctactcttgtatgacgggggccaaagtttccattaagctgcacagctctaaaaattccaccgcgcatgtgagatgcaagggagacgagacagccttcagcgtcctggaaggcgtgcactcctacaccgtttctcttagctttgatcacgctgtggtcgacgagcaatgtcagctcaactgcgggggacatgaatcccaggtgacactgaagggcaatctgatcttcctcgatgttcctaaatttgtggacggcagctatatgcagacctaccactcttccgtccccacgggggccaacattcctagccccacagactggctgaatgcccttttcggaaacggcctgtctcggtggatcctcggggtgatcggagtgctgctgggcgggcttgctctctttttcctgattatgagcctgtttaagctcggaaccaaacaagtcttccgctccagaacaaagctggcctga

SEQ ID NO: 14830 - RNA, 3222 nt, synthetic construct
  misc_feature 1..3222: note = derived and/or modified CDS sequence (opt5) from SFTSV(SPL066A)__AB985298.1__GP
  source 1..3222: mol_type = other RNA
atgatgaaggtgatctggttcagctccctgatttgcctcgtcatccagtgttctggcgacgccagccccattatctgcgctgggcctattcactccaacaaatctgccaatatcccgcatctgcttggatacagcgagaagatctgtcaaattgatagactgatccacgtttcctcttggctccggaaccatagccagtttcagggctatgtggggcagcgcggaggcagatcccaagtgagctacttccccgcggaaaattcttattcccggtggagcgggctgctttctccttgcgacgctgattggctgggaatgctcgtcgtgaaaaaggccaaaggctccgacatgattgttcccggccctagctacaaggggaaggtgtttttcgagcgccccacctttgatggatatgtcggctgggggtgtggatctggcaaatccagaacagaaagcggggagctgtgctcctctgacagcggaacgtccagcggcctgctcccttctgatcgggtgctgtggatcggcgacgttgcctgtcagccgatgacccccattcctgaagagacattccttgagctgaagtcctttagccagtctgagttccccgatatctgcaaaattgacgggatcgtgtttaaccagtgtgaaagcgaatccctccctcaacccttcgatgtcgcttggatggacgtgggacactctcataagatcattatgcgcgagcacaaaaccaagtgggtgcaggagagctccagcaaggattttgtctgctacaaagaaggcacagggccgtgttctgagtccgaagagaagacctgcaaaacaagcggatcttgcagaggcgacatgcagttctgtaaggttgccgggtgcgaacacggagaggaggcttccgaagccaaatgtcggtgcagcctggtgcataagcctggcgaggtggtcgtgtcctatggcgggatgcgcgttagacccaaatgttacggattttctcggatgatggcgacccttgaagtgaatcctcccgagcagcgcatcggccaatgcacggggtgtcacctggaatgcattaacggaggcgtcagactcatcaccctgacaagcgagctgaagtccgccaccgtgtgtgcttctcatttctgcagctccgccacaagcgggaagaaatctaccgagattcagttccactccggcagcctcgttggaaaggctgccatccacgtgaaaggcgcgctggtcgacgggacggaatttacattcgagggatcttgtatgtttcccgatggctgcgacgccgtggattgcaccttctgtcgggaatttcttaagaatcctcagtgctacccggctaaaaagtggctgttcatcattatcgtcattctcctggggtatgccggacttatgctgctcacaaacgtgctgaaggctatcggcgtttgggggtcctgggtgattgcccccgtcaaactgatgtttgccatcatcaagaaactcattcgcagcgtgtcttgtctgatgggcaagctgatggacagaggacggcaagttatccatgaggaaattggcgagaatggggagggaaaccaggatgacgtgagaatcgaaatggctcgccctcggagagtccgccactggatgtacagccccgtgattcttaccatcctcgcgattggcctggccgaggggtgcgatgaaatggtgcatgctgactccaaacttgttagctgtaagcagggatctggcaatatgaaggagtgcgtcaccacagggcgggccctgctccctgccgtgaaccccggccaggaggcttgtctgcacttcacggccccgggatcccctgatagcaaatgcctgaagatcaaagtgaagagaatcaatctcaaatgtaagaagtcctctagctattttgtccccgacgcgcgctcccggtgcacctctgtgagacgctgtcggtgggctggcgattgccaaagcgggtgcccttcccatttcacatctaacagcttttccgacgactgggccggaaaaatggatagagccggcctggggttcagcggatgttctgacggctgcgggggcgctgcctgtggatgctttaatgctgccccctcctgtattttctggcgcaagtgggttgaaaaccctcacggcatcatttggaaagtgagcccctgcgcggcctgggtcccgtctgctgtgatcgagcttaccatgccttccggggaagttcggacattccaccccatgagcggcattcccacccagatctttaagggagtgtctgtcacgtacctggggtccgatatggaggtgagcggactcacagacctgtgtgaaatcgaggagctgagatccaaaaagctcgcccttgctccttgcaaccaggccggcatgggcgttgtggggaaagtcggagaaattcagtgtagctctgaggaaagcgcgcggaccatcaagaaggatggctgcatttggaatgccgacctggtggggatcgagctgcgcgtggatgacgctgtctgttattccaaaattacctctgttgaagccgtggctaactacagcgccatcccgacaaccatcggaggcctcagattcgagcggtcccatgattctcaagggaagattagcggatctcccctggacatcacagccattagaggctcctttagcgtgaattatcgcggccttcggctgtccctcagcgagatcacggctacctgcacaggggaagtcaccaacgtgtctggatgctactcctgtatgacaggcgcgaaagttagcattaagctgcactcttccaaaaatagcaccgcccatgtgagatgcaagggggatgagacggctttctccgtcctggaaggagtgcactcttacaccgttagcctttcctttgaccacgccgtggtcgatgagcagtgtcagctcaactgcggcgggcatgaaagccaggtgacactgaagggaaatctgatcttcctcgacgttcctaaatttgtggacggctcttatatgcaaacctaccactccagcgtccccacaggcgccaacatcccttctcccaccgattggctgaatgctcttttcgggaacggactgagccgctggattctcggcgtgatcggggtgctgctgggaggccttgccctctttttcctgattatgtccctgtttaagctcgggacgaaacaggtcttcagatctcggacaaagctggcgtga

SEQ ID NO: 14831 - RNA, 3222 nt, synthetic construct
  misc_feature 1..3222: note = derived and/or modified CDS sequence (opt5) from SFTSV(SPL070A)__AB985301.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttcatggagcttaagtctttttcccagagcgaatttcccgatatctgcaaaattgacggaatcgtgtttaaccagtgtgagtctgaaagcctgcctcaacccttcgatgtcgcctggatggacgtgggccactcccataagatcattatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggaggcctctgaagctaaatgtcggtgctccctcgtgcataagcctggcgaggtggtcgtgagctatgggggaatgcgcgttagacccaaatgttacggcttttcccggatgatggccacgctggaagtgtctcctcccgagcagcgcatcgggcaatgcaccggatgtcaccttgaatgcattaatggcggggtcagactgatcacactcaccagcgagctgaagtccgcgacagtgtgtgcctctcatttctgcagctccgctaccagcggcaagaaatctacggagattcagttccactccggaagcctggttggcaagacagccatccacgtgaaaggggctctcatggacggaaccgaatttacattcgagggctcttgtatgtttcccgatgggtgcgacgccgtcgattgcaccttctgtcgggaatttctgaagaaccctcagtgctacccggcgaaaaagtggcttttcatcattatcgtgattctgctcggatatgccggcctgatgcttctgaccaatgtcctcaaggctatcggggtgtggggctcctgggttattgcccccgtgaaactgatgtttgctatcatcaagaaactgatgcgcagcgtctcttgtctcatgggaaagctgatggacagaggccggcaagtgattcatgaggaaatcggggagaacggagagggcaatcaggatgacgttagaattgaaatggcccgccctcggagagtgcgccactggatgtacagccccgtcatccttacaattctggccatcgggctcgctgagggatgcgatgaaatggtgcatgcggactccaaactggtgagctgtaagcagggctctgggaacatgaaggagtgcgttacgaccggccgggcccttctgcctgctgtcaatcccggacaggaggcctgtctccacttcacagccccgggctcccctgatagcaaatgcctgaagattaaagtgaagagaatcaacctgaaatgtaagaagtcctctagctattttgtgcccgacgctcgctcccggtgcacctctgtcagacgctgtcggtgggccggggattgccaaagcggatgcccttcccatttcacatctaatagcttttccgacgactgggcgggcaaaatggatagagctgggctcggattcagcggctgttctgacgggtgcggcggagccgcctgtggctgctttaacgctgccccctcctgtatcttctggcgcaagtgggtggaaaatcctcacgggattatctggaaagttagcccctgcgctgcctgggtgccgtctgcggtcattgagctgaccatgccttccggagaagtgcggacgttccaccccatgagcggcatccccacacaggtttttaagggggtgtctgtcacctaccttggatccgatatggaggtgaccggcctgacagacctctgtgaaattgaggagctgaaaagcaagaaactggcccttgctccttgcaaccaggccggcatgggggttgtgggaaaggtcggcgaaatccagtgttccagcgaggaatctgctagaaccatcaagaaagatgggtgcatttggaacgccgacctcgtgggaatcgagctgcgggtggatgacgcggtctgttatagcaagattacatccgttgaagccgtggctaattactctgccatcccgacgaccattggcgggctgcgcttcgagagaagccatgattcccaaggaaaaatctctggcagccccctcgacatcacagctattcggggctccttttctgtgaactatagagggctgcgccttagcctgtccgagatcaccgccacatgcaccggagaagtcacgaatgtgagcggctgctactcttgtatgaccggggccaaggtttccattaaactccacagctctaagaactccacagctcatgtgcggtgcaagggagatgagaccgcgttcagcgtcctggaaggcgtgcactcctacacagtttctctgagctttgaccacgccgtggtcgatgagcagtgtcagcttaattgcgggggacatgaatcccaggtgaccctcaaaggcaacctgatcttcctggacgttcctaagtttgtggacggcagctatatgcaaacgtaccactcttccgtccccacaggggctaatattcctagccccaccgattggctcaacgccctgttcggaaatggcctttctagatggatcctgggggtgatcggagtgctcctgggcgggctggcccttttcttcctcattatgagcctgtttaaactgggaacaaagcaggtcttccgccctagaaccaaactcgcttga

SEQ ID NO: 14832 - RNA, 3222 nt, synthetic construct
  misc_feature 1..3222: note = derived and/or modified CDS sequence (opt5) from SFTSV(SPL071A)__AB985302.1__GP
  source 1..3222: mol_type = other RNA
atgatgaaggtgatctggttcagctccctgatttgcctcatcattcagtgttctggcgacaccgggcccatcatttgcgccggacctatccacagcaacaaatccgctaatatcccgcatctgcttggctactctgagaagatttgtcaaatcgatagactgattcacgtcagctcctggctccggaaccattctcagtttcaggggtatgttggacagcgcggcgggagaagccaagtgtcctacttccccgccgaaaatagctattctcggtggtccggactgcttagcccttgcgacgcggattggctgggcatgctcgtggtcaaaaaggctaaaggctctgacatgatcgtgcccgggccttcctacaagggaaaggttttcttcgagcgccccacatttgatggctatgtggggtggggatgtggcagcgggaaatctagaacggaatccggagagctgtgcagctccgactctggcaccagctccggcctgctccctagcgatcgggtcctgtggattggggacgtggcctgtcagccgatgacacccatccctgaagagaccttccttgagctgaagtctttttcccagagcgaatttcccgatatttgcaaaatcgacggaatcgtttttaaccagtgtgagtctgaaagcctccctcaacccttcgatgtggcctggatggacgtcggccactcccataagattatcatgcgcgagcacaaaacaaagtgggtgcaggagtctagctccaaggattttgtgtgctacaaagaagggaccggaccgtgtagcgagtctgaagagaagacatgcaaaacctccggcagctgcagaggggacatgcagttctgtaaggtcgctggatgcgaacacggcgaggagacgtctgaagccaaatgtcggtgctccctggttcataagcctggcgaggtggtggtcagctatgggggaatgcgcgtgagacccaaatgttacggcttttcccggatgatggctacccttgaagttaatcctcccgagcagcgcattgggcaatgcacaggatgtcacctggaatgcatcaacggcggggtgagactcattaccctgacatctgagcttaagagcgccaccgtctgtgcgtcccatttctgctctagcgccacgtccggcaagaaaagcacagagatccagttccactctggatccctcgtgggcaagaccgctatccacgttaaaggggccctggtggacggaacagaatttaccttcgagggcagctgtatgtttcccgatgggtgcgacgctgtcgattgcaccttctgtcgggaatttcttaagaatcctcagtgctacccggccaaaaagtggctgttcattatcattgtgatcctcctgggatatgcgggccttatgctgctcacaaacgtcctgaaggccattggggtgtggggctcttgggttatcgctcccgtgaaactgatgtttgccatcattaagaaactcatgcgctccgtcagctgtctgatgggaaagctgatggacagaggccggcaagtgatccatgaggaaattggggagaatagagagggaaaccaggatgacgttcgcatcgaaatggctcggcctagacgcgtgcggcactggatgtactctcccgtcattctggccatcctcgccattggcctggctgaggggtgcgatgaaatggtgcatgcggacagcaaacttgtgtcctgtaagcagggaagcggcaatatgaaggagtgcgttacgaccgggagagccctgctccctgctgtcaaccccggccaggaggcctgtctgcacttcacagccccgggatctcctgattccaaatgcctgaagatcaaagtgaagcgcatcaatctcaaatgtaaaaagagctcctcttattttgtgcccgacgctcggagcagatgcacctccgtccgccggtgtagatgggccggcgattgccaatctgggtgccctagccatttcacatccaactcttttagcgacgactgggcgggaaagatggatcgcgctggcctggggttctccggatgtagcgacggctgcgggggcgccgcctgtggatgctttaatgctgccccctcttgtattttctggcggaagtgggtggaaaaccctcacggcatcatttggaaagtttccccctgcgctgcctgggtgccgagcgcggtcatcgagcttaccatgccttctggggaagtgagaacgttccaccccatgtccggcattcccacacaggtttttaagggagtgagcgtcacctacctggggtctgatatggaggtgtccggactcaccgacctgtgtgaaatcgaggagctgaaaagcaagaaacttgccctcgctccttgcaaccaggccggcatgggcgttgtggggaaggtcggagaaatccagtgttccagcgaggaatctgctcggacaattaagaaagatggctgcatctggaatgccgacctggtggggattgagctgcgcgtggatgacgcggtctgttatagcaagatcacctccgttgaagccgtggctaactactctgccattccgacaacgatcggaggcctcagattcgagcggagccatgattcccaagggaaaatctctggaagccccctggacattaccgctatcagaggctccttttctgtgaattatcgcggccttcggctgagcctctccgagattacagctacctgcacaggggaagtcaccaacgtgagcggatgctactcttgtatgacgggcgccaaggtttccatcaaactgcacagctctaaaaattccaccgcccatgtgagatgcaagggggatgagacagcgttcagcgtcctggaaggagtgcactcctacaccgtttctcttagctttgaccacgccgtggtcgatgagcagtgtcagctcaactgcggcgggcatgaatcccaggtgacactgaagggaaatctgattttcctcgacgttcctaagtttgtggacggcagctatatgcaaacctaccactcttccgtccccacgggcgctaacatccctagccccacagattggctgaatgcccttttcgggaacggactgtctcgctggatcctcggcgtgattggggtgctgctgggaggccttgccctctttttcctgatcatgagcctgtttaaactcgggaccaagcaggtcttcagatcccggacaaaactggcttga

SEQ ID NO: 14833 - RNA, 3222 nt, synthetic construct
  misc_feature 1..3222: note = derived and/or modified CDS sequence (opt5) from SFTSV(SPL077A)__AB985304.1__GP
  source 1..3222: mol_type = other RNA
atgatgaaggtgatctggttcagctccctgatttgcctcgtcacccagtgttctggcgacacagggcccatcatttgcgccggacctatccacagcaacaaatccgctaatattccgcatctgcttggctactctgagaagatctgtcaaatcgatagactgattcacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgatcgttcccgggccttcctacaagggaaaggtgtttttcgagcgccccacgtttgatggctatgtcgggtggggatgtggcagcgggaaatctagaaccgaatccggagagctgtgcagctccgactctggcacaagctccggcctgctccctagcgatcgggtgctgtggattggggacgttgcctgtcagccgatgacccccatccctgaagagacattccttgagctgaagtctttttcccagagcgagttccccgatatttgcaaaatcgacggaattgtgtttaaccagtgtgaatctgaaagcctccctcaacccttcgatgtcgcctggatggacgtgggccactcccataagatcatcatgcgcgagcacaaaaccaagtgggtgcaggagtctagctccaaggattttgtctgctacaaagaagggacaggaccgtgtagcgagtctgaagagaagacctgcaaaacgtccggcagctgcagaggggacatgcagttctgtaaggttgctggatgcgaacacggcgaggaggcctctgaagctaaatgtcggtgctccctggtgcataagcctggcgaggtggtcgtgagctatgggggaatgcgcgttagacccaaatgttacggcttttcccggatgatggccacccttgaagtgaatcctcccgagcagcgcattgggcaatgcacaggatgtcacctggaatgcatcaacggcggggtcagactcattaccctgacatctgagctgaagtccgcgaccgtgtgtgcctcccatttctgctctagcgctacgtccggcaagaaaagcacagagatccagttccactctggatccctcgttggcaagaccgccattcacgtgaaaggggctctggtcgacggaacagaatttaccttcgagggcagctgtatgtttcccgatgggtgcgacgccgtggattgcaccttctgtcgggaatttcttaagaatcctcagtgctacccggcgaaaaagtggctgttcatcatcattgtcatcctcctgggatatgccggccttatgctgctcacaaacgtgctgaaggctattggggtttggggctcttgggtgatcgcccccgtcaaactgatgtttgctattctcaagaaactgatgcgctccgtgagctgtcttatgggaaagctgatggacagaggccggcaagttatccatgaggaaatcggggagaatagagagggaaaccaggatgacgtgcgcattgaaatggcccggcctagacgcgtccggcactggatgtactctcccgtgatcctcacgattctggccatcggccttgctgaggggtgcgatgaaatggtgcatgcggacagcaaactggtttcctgtaagcagggaagcggcaatatgaaggagtgcgtcaccacagggagagccctcctgcctgctgtgaaccccggccaggaggcctgtctgcacttcaccgccccgggatctcctgattccaaatgcctcaagattaaagtgaagcgcatcaatctgaaatgtaaaaagagctcctcttattttgtccccgacgctcggagcagatgcacatccgtgcgccggtgtagatgggccggcgattgccaatctgggtgccctagccatttcacctccaactcttttagcgacgactgggcgggaaagatggatcgcgctggccttgggttctccggatgtagcgacggctgcgggggcgccgcctgtggatgctttaatgctgccccctcttgtattttctggcggaagtgggttgaaaaccctcacggcatcatctggaaagtgtccccctgcgctgcctgggtcccgagcgcggtgattgagctgacgatgccttctggggaagttagaacattccaccccatgtccagcatccccacccaggtgtttaagggagtctctgtgacctacctcggctccgatatggaggttagcgggctgacagacctgtgtgaaattgaggagcttaaatccaagaaactcgccctggctccttgcaaccaggccggaatgggcgtggtcggcaaggtgggggaaatccagtgtagctctgaggaaagcgctcggaccattaagaaagatggatgcatctggaatgccgacctggtgggcatcgagctccgcgtcgatgacgcggtttgttattccaagattacatctgtggaagccgtggctaactacagcgccatcccgacgaccattgggggactgagattcgagcggtcccatgattctcaaggcaaaatcagcgggagcccccttgacattacagctatcagaggatcttttagcgtcaattatcgcggcctgcggctctccctgagcgagatcaccgccacatgcaccggcgaagtgacgaacgtttctgggtgctactcctgtatgaccggagccaaggtgagcattaaactgcactcttccaagaatagcacagctcatgtcagatgcaagggcgatgagaccgcgttctccgtgcttgaaggggttcactcttacacagtgagcctctcctttgaccacgccgtcgtggatgagcagtgtcagctgaactgcggaggccatgaaagccaggttaccctgaaagggaatctcatcttcctggacgtgcctaagtttgtcgacggatcttatatgcaaacgtaccactccagcgtgcccacaggcgctaacattccttctcccaccgattggcttaatgccctgttcggcaacgggctcagccgctggatcctgggagtgattggcgtcctgcttgggggactcgccctgtttttcctgatcatgtccctctttaaacagggcacaaagcaggttttcagatctcggaccaaactggcttga

SEQ ID NO: 14834 - RNA, 3222 nt, synthetic construct
  misc_feature 1..3222: note = derived and/or modified CDS sequence (opt5) from SFTSV(SPL084A)__AB985307.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttccttgagctgaagtctttttcccagagcgagttccccgatatctgcaaaattgacggaatcgtgtttaaccagtgtgaatctgaaagcctccctcaacccttcgatgtcgcctggatggacgtgggccactcccataagatcattatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggaggcctctgaagctaaatgtcggtgctccctggtgcataagcctggcgaggtggtcgtgagctatgggggaatgcgcgttagacccaaatgttacggcttttcccggatgatggccacgcttgaagtgaatcctcccgagcagcgcatcgggcaatgcaccggatgtcacctggaatgcattaacggcggggtcagactcatcacactgacctctgagctgaagtccgcgacagtgtgtgcctcccatttctgctctagcgctacctccggcaagaaaagcacggagattcagttccactctggatccctcgttggcaagacagccatccacgtgaaaggggctctggtcgacggaaccgaatttacattcgagggcagctgtatgtttcccgatgggtgcgacgccgtggattgcaccttctgtcgggaatttcttaagaatcctcagtgctacccggcgaaaaagtggctgttcatcattatcgtcattctcctgggatataccggccttatgctgctcacaaacgtgctgaaggccatcggggtttggggctcttgggtgattgctcccgtcaaactgatgtttgccatcctcaagaaactgatgcgctccgtgagctgtcttatgggaaagctgatggacagaggccggcaagttatccatgaggaaattggggagaatagagagggaaaccaggatgacgtgcgcatcgaaatggctcggcctagacgcgtccggcactggatgtactctcccgtgattctcacgatcctggccattggccttgccgaggggtgcgatgaaatggtgcatgctgacagcaaactggtttcctgtaagcagggaagcggcaatatgaaggagtgcgtcaccacagggagagcgctcctgcctgccgtgaaccccggccaggaggcttgtctgcacttcaccgccccgggatctcctgattccaaatgcctcaagatcaaagtgaagcgcattaatctgaaatgtaaaaagagctcctcttattttgtccccgacgcccggagcagatgcacatccgtgcgccggtgtagatgggctggcgattgccaatctgggtgccctagccatttcacctccaactcttttagcgacgactgggccggaaagatggatcgcgcgggccttgggttctccggatgtagcgacggctgcgggggcgctgcctgtggatgctttaatgccgctccctcttgtatcttctggcggaagtgggttgaaaaccctcacggcatcatttggaaagtgtccccctgcgccgcttgggtcccgagcgccgtgatcgagctgacgatgccttctggggaagttagaacattccaccccatgtccggcattcccacccaggtgtttaagggagtcagcgtgacctacctcgggtctgatatggaggtttccggactgacagacctgtgtgaaatcgaggagcttaaaagcaagaaactcgcgctggccccttgcaaccaggctggcatgggcgtggtcgggaaggtgggagaaattcagtgttccagcgaggaatctgcccggaccatcaagaaagatggctgcatctggaatgctgacctggtggggattgagctccgcgtcgatgacgccgtttgttatagcaagatcacatccgtggaagcggtggccaactactctgctattccgacgaccatcggaggcctgagattcgagcggagccatgattcccaagggaaaatttctggaagcccccttgacatcacagccatcagaggctccttttctgtcaattatcgcggcctgcggctcagcctgtccgagattaccgctacatgcaccggggaagtgacgaacgttagcggatgctactcttgtatgaccggcgccaaggtgtccatcaaactgcacagctctaagaatagcacagcccatgtcagatgcaagggggatgagaccgctttcagcgtgcaggaaggagttcactcctacacagtgtctcttagctttgaccacgcggtcgtggatgagcagtgtcagctcaactgcggcgggcatgaatcccaagttaccctgaaaggaaatctgattttcctcgacgtgcctaagtttgtcgacggcagctatatgcagacgtaccactcttccgtgcccacaggcgccaacatccctagccccaccgattggctgaatgctcttttcgggaacggactgtctcgctggattctcggcgtgatcggggtcctgctgggaggccttgccctctttttcctgatcatgagcctgtttaaactcgggacaaagcaggttttcagatcccggaccaaactggcctga

SEQ ID NO: 14835 - RNA, 3222 nt, synthetic construct
  misc_feature 1..3222: note = derived and/or modified CDS sequence (opt5) from SFTSV(SPL086A)__AB985308.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttccttgagctgaagtctttttcccagagcgagttccccgatatctgcaaaattgacggaatcgtgtttaaccagtgtgaatctgaaagcctccctcaacccttcgatgtcgcctggatggacgtgggccactcccataagatcattatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggaggcctctgaagctaaatgtcggtgctccctggtgcataagcctggcgaggtggtcgtgagctatgggggaatgcgcgttagacccaaatgttacggcttttcccggatgatggccacgcttgaagtgaatcctcccgagcagcgcatcgggcaatgcaccggatgtcacctggaatgcattaacggcggggtcagactcatcacactgacctctgagcttaagagcgcgacagtgtgtgcctcccatttctgctctagcgctacctccggcaagaaaagcacggagattcagttccactctggatccctcgttggcaagacagccatccacgtgaaaggggctctggtcgacggaaccgaatttacattcgagggcagctgtatgtttcccgatgggtgcgacgccgtggattgcaccttctgtcgggaatttcttaagaatcctcagtgctacccggcgaaaaagtggctgttcatcattatcgtcattctcctgggatatgccggccttatgctgctcaccaacgtgctgaaggctatcggggtttggggctcttgggtgattgcccccgtcaaactgatgtttgctatcatcaagaaactcatgcgctccgtgagctgtctgatgggaaagctgatggacagaggccggcaagttattcatgaggaaatcggggagaatagagagggaaaccaggatgacgtgcgcattgaaatggcccggcctagacgcgtccggcactggatgtactctcccgtgatcctgacaattctcgccatcggcctggctgaggggtgcgatgaaatggtgcatgcggacagcaaacttgtttcctgtaagcagggaagcggcaatatgaaggagtgcgtcacgaccgggagagccctgctccctgctgtgaaccccggccaggaggcctgtctgcacttcacagccccgggatctcctgattccaaatgcctgaagattaaagtgaagcgcatcaatctcaaatgtaaaaagagctcctcttattttgtccccgacgctcggagcagatgcacctccgtgcgccggtgtagatgggccggcgattgccaatctgggtgccctagccatttcacatccaactcttttagcgacgactgggcgggaaagatggatcgcgctggcctggggttctccggatgtagcgacggctgcgggggcgccgcctgtggatgctttaatgctgccccctcttgtatcttctggcggaagtgggttgaaaaccctcacggcattatctggaaagtgtccccctgcgctgcctgggtcccgagcgcggtgattgagcttaccatgccttctggggaagttagaacgttccaccccatgtccggaatccccacacaggtgtttaagggcgtcagcgtgacctacctggggtctgatatggaggtttccggactcaccgacctgtgtgaaattgaggagctgaaaagcaagaaacttgccctcgctccttgcaaccaggccggcatgggcgtggtcgggaaggtgggagaaatccagtgttccagcgaggaatctgctcggacaatcaagaaagatggctgcatttggaatgccgacctggtggggatcgagctgcgcgtcgatgacgcggtttgttatagcaagattacctccgtggaagccgtggctaactactctgccatcccgacaacgattggaggcctcagattcgagcggagccatgattcccaagggaaaatctctggaagccccctggacatcaccgctattagaggctccttttctgtcaattatcgcggccttcggctgagcctctccgagatcacagctacctgcacaggggaagtgaccaacgttagcggatgctactcttgtatgacgggcgccagagtgtccattaagctgcacagctctaaaaattccaccgcccatgtccgctgcaagggggatgagacagcgttcagcgtgctggaaggagttcactcctacaccgtgtctcttagctttgaccacgccgtcgtggatgagcagtgtcagctcaactgcggcgggcatgaatcccaggttacactgaagggaaatctgatcttcctcgacgtgcctaaatttgtcgacggcagctatatgcaaacctaccactcttccgtgcccacgggcgctaacattcctagccccacagattggctgaatgcccttttcgggaacggactgtctagatggatcctcggcgtgatcggggtcctgctgggaggccttgccctctttttcctgattatgagcctgtttaagctcgggaccaaacaggttttccggtcccgcacaaagctggcttga

SEQ ID NO: 14836 - RNA, 3222 nt, synthetic construct
  misc_feature 1..3222: note = derived and/or modified CDS sequence (opt5) from SFTSV(SPL087A)__AB985309.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctgatatcccgcatctgcttggctacagcgagaagatctgtcaaattgacagactgatccacgtttcctcttggctccggaatcatagccagtttcaggggtatgtgggacagcgcggcgggagatcccaagtgagctactatcccgccgaaaactcttactcccggtggagcggactgctttctccttgcgatgcggactggctgggcatgctcgtcgtgaaaaaggctaaaggctccgatatgattgttcccgggcctagctataagggaaaggtgttctttgagcgccccaccttcgacggctacgtcgggtggggatgtggctctgggaaatccagaagcgaatccggagagctgtgctctagcgattccggcacaagctctggcctgctcccttccgaccgggtgctgtggatcggggatgttgcctgtcagccgatgacgcccattcctgaagagacctttcttgagcttaagagcttctctcagagcgaatttcccgacatctgcaaaattgatggaatcgtgttcaatcagtgtgagggcgaatccctccctcaaccctttgacgtcgcctggatggatgtggggcactctcataagatcattatgcgcgagcacaaaacaaagtgggtgcaggagagctccagcaaggacttcgtctgctataaagaaggaaccggcccgtgttctgagtccgaagagaagacatgcaaaaccagcgggtcttgcagaggagacacacagttttgtaaggttgctggctgcgaacacggcgaggaggcctccgaagctaaatgtcggtgcagcctggtgcataagcctggggaggtggtcgtgtcctacggaggcatgcgcgttagacccaaatgttacgggttctctcggatgatggccacccttgaagtgagccctcccgagcagcgcatcggacaatgcacgggctgtcacctggaatgcattaacgggggcgtcagactcatcaccctgacatccgagctgaagtctgcgaccgtgtgtgccagccatttttgctccagcgctacatctggaaagaaatccaccgagattcagttccacagcggctctctcgttgggaagacggccatccacgtgaaaggagctctggtcgatggcacagaatttacctttgaggggtcctgtatgttccccgacggatgcgatgccgtggactgcacattttgtcgggagttccttaagaatcctcagtgctatccggcgaaaaagtggctgtttatcattatcgtcattctcctgggctacgccgggcttatgctgctcaccaacgtgctgaaggctatcggcgtttggggaagctgggtgattgcccccgtcaaactgatgttcgctatcatcaagaaactcatgcgcaccgtgtcttgtctgatgggcaagctgatggatagagggcggcaagttattcatgaagaaatcggagagaatagagagggcaaccgcgacgatattcggatcgaaatggccagacctcgccgggtgagacactggatgtatagccccgtcattctgacaatcctcgccattgggctggctgagggatgcgacgaaatggtgcatgcggattccaaacttgtgagctgtcgccagggctctgggaatatgaaggagtgcgttacgaccggccgggccctgctccctgctgtcaaccccggacaggaggcctgtctgcactttacagccccgggctcccctgacagcaagtgcctgaaaatcaaggtgaaaagaatcaatctcaagtgtaaaaagtcctctagctacttcgtgcccgatgctcgctcccggtgcacctctgtcagacgctgtcggtgggccggggactgccagagcggatgccctccccattttacatccaactctttcagcgacgattgggcgggcaagatggacagagctgggctgggattttccggctgtagcgatgggtgcggcggagccgcctgtggctgcttcaatgctgccccttcttgtattttctggcggaaatgggtggaaaacccccacgggatcatttggaaggtttccccgtgcgctgcctgggtgcctagcgcggtcatcgagcttaccatgccctctggagaagtgcgcacgttccaccccatgtccggcattcctacacaagttttcaaaggggtgagcgtcacctatctgggatctgacatggaggtgtccggcctcaccgatctgtgtgaaatcgaggagcttaagagcaaaaagctggccctcgctccgtgcaatcaggccggcatgggggttgtgggaaaagtcggcgaaatccagtgttccagcgaggaatctgctagaacaattaagaaggacgggtgcatctggaacgccgatctggtgggaattgagctgcgggtggacgatgcggtctgttacagcaaaatcacctccgttgaagccgtggctaactattctgccattcccacaacgatcggcgggctcagatttgagcgcagccatgactcccagggaaagatctctggcagccctctggatattaccgctatccggggctccttctctgtgaattacagagggcttcgcctgagcctctccgagattacagctacctgcacaggagaagtcaccaacgtgagcggctgctactcttgtatgacgggggccaaagtttccatcaagctgcacagctctaaaaattccaccgcccatgtgagatgcaagggagacgagacagcgtttagcgtcctggaaggcgtgcactcctataccgtttctcttagcttcgatcacgccgtggtcgacgagcggtgtcaactcaactgcgggggacatgaatcccaggtgacactgaagggcaatctgatttttctcgacgttcccaaattcgtggatggcagctacatgcagacctatcactctacggtccctacaggggctaacatcccctcccctaccgactggctgaatgccctttttggaaacggcctgagccgctggatcctcggggtgattggagtgctgctgggcgggcttgccctcttctttctgatcatgtctctgttcaagctcggaacaaaacaggtctttagaagccggaccaagctggcttga

SEQ ID NO: 14837 - RNA, 3222 nt, synthetic construct
  misc_feature 1..3222: note = derived and/or modified CDS sequence (opt5) from SFTSV(SPL090A)__AB985311.1__GP
  source 1..3222: mol_type = other RNA
atgatgaaggtgatctggttccccagcctgatttgcctcgtcatcagatgttccggcgggaccggacctattatctgcgccggcccgattcactctaacaaaagcgctaatatcccccatctgcttgggtactccgagaagatctgtcagattgaccggctgatccacgtttctagctggctccgcaaccattcccaatttcagggatatgtgggccagagagggggacggtctcaggtgagctacttccctgccgaaaattcctatagccgctggtctggcctgctttccccctgcgatgcggactggctgggcatgctcgtcgtgaaaaaggctagagggagcgatatgattgttcctggaccctcttacaaaggcaaggtgtttttcgagcggcctacatttgacgggtatgtcggatggggctgtgggtccggaaagagccgcacggaatctggcgagctgtgctccagcgattccggcacctctagcgggctgctcccgtccgacagagtgctgtggatcggagatgttgcctgtcaacccatgacacctattcccgaagagaccttccttgagctgaaatcttttagccagtccgagttccctgacatctgcaagattgatggcatcgtgtttaaccagtgtgaaagcgaatctctcccccagccgttcgacgtcgcctggatggatgtggggcacagccataaaatcattatgcgggagcacaagacaaaatgggtgcaagagtcctctagcaaggactttgtctgctacaaggaaggaaccggcccttgttccgagagcgaagagaaaacatgcaagacctctgggtcctgccgcggagatatgcagttctgtaaagttgctggctgcgaacacggcgaggaggccagcgaagctaagtgtagatgctctctggtgcataaacccggggaggtggtcgtgtcctatggaggcatgcgggttcgccctaagtgttacgggtttagcagaatgatggccacgcttgaagtgaatcctcccgagcagcggatcggacagtgcaccggctgtcacctggaatgcattaacgggggcgtccgcctcatcacactgacctccgagctgaaatctgcgacagtgtgtgccagccatttctgctcctctgctaccagcggaaagaagtccacggagattcaattccacagcggctctctcgttgggaaaacagccatccacgtgaagggagctctggtcgacggcaccgaatttacattcgaggggtcctgtatgtttcccgacggatgcgatgccgtggactgcaccttctgtagagaatttcttaaaaatccgcagtgctaccccgcgaagaaatggctgttcatcattatcgccattctcctgggctatgctgggcttatgctgctcaccaacgtcctgaaggccatcggcgtgtggggaagctgggttattgctcctgtgaagctgatgtttgccatcatcaaaaagctcatgcggtctgtctcctgtctgatgggcaaacttatggatagagggcgccaggtgattcatgaggaaatcggagagaatcgggagggcaaccaagacgatgttagaattgaaatggcccgcccccggagagtgcgccactggatgtacagccctgtcatcctgacaattctcgctatcgggctggcggagggatgcgacgaaatggtgcatgccgattctaaacttgtgagctgtaagcagggctccgggaatatgaaggagtgcgttacgaccggccgggctctgctccccgccgtcaacccgggacaggaggcctgtctgcacttcacagctcctggcagccccgactctaagtgcctgaaaattaaggtgaaaagaatcaatctcaagtgtaaaaagtccagctcctattttgtgcctgatgcccgctctcggtgcaccagcgtcagacgctgtcggtgggcgggggactgccagtccggatgcccctctcatttcacaagcaactccttttctgatgactgggctggcaagatggacagagccgggctgggattcagcggctgttccgatgggtgcggcggagccgcttgtggctgctttaatgccgctcctagctgtatcttctggcggaaatgggtggaaaacccccacgggattatctggaaggtttctccgtgcgccgcgtgggtgccttccgccgtcattgagcttaccatgcccagcggagaagtgcgcacgttccaccccatgtctggcatccctacacaagtttttaaaggggtgtccgtcacctacctgggaagcgacatggaggtgtctggcctcaccgatctgtgtgaaattgaggagctgaagtccaaaaagctcgctcttgccccgtgcaaccaggctggcatgggggttgtgggaaaagtcggcgaaatccagtgtagctccgaggaaagcgccagaacaatcaagaaggacgggtgcatttggaatgcggatctggtgggaatcgagctgcgggtggacgatgccgtctgttattctaaaattaccagcgttgaagctgtggccaactactccgctatccccacaacgattggcgggctcagattcgagcgctctcatgacagccagggaaagatctccggctctcctctggatatcaccgccattcggggcagcttttccgtgaattatagagggcttcgcctgtctctcagcgagatcacagctacctgcacaggagaagtcaccaacgtgtccggctgctacagctgtatgacgggggccaaagtttctattaagctgcactccagcaaaaattctaccgcgcatgtgagatgcaagggagacgagacagccttctccgtcctggaaggcgtgcacagctacaccgtttccctttcttttgatcacgctgtggtcgacgagcaatgtcagctcaactgcgggggacatgaaagccaggtgacactgaagggcaatctgatcttcctcgatgttcccaaatttgtggacggctcctatatgcagacctaccacagctctgtccctacgggggccaacattccctcccctacagactggctgaatgcccttttcggaaacggcctgagccggtggatcctcggggtgatcggagtgctgctgggcgggcttgctctctttttcctgattatgtctctgtttaagctcggaaccaaacaagtcttccgcagcagaacaaagctggcctga

SEQ ID NO: 14838 - RNA, 3222 nt, synthetic construct
  misc_feature 1..3222: note = derived and/or modified CDS sequence (opt5) from SFTSV(SPL097A)__AB985312.1__GP
  source 1..3222: mol_type = other RNA
atgatgaaggtgatctggttcagctccctgatttgcctcgtcatccagtgttctggcgacaccgggcccattatctgcgccggacctattcacagcaacaagtccgctgatatcccgcatctgcttggctactctgagaagatctgtcaaattgacagactgatccacgttagctcctggctccggaatcattctcagtttcaggggtatgtgggacagcgcggcgggagaagccaagtgtcctactatcccgccgaaaacagctactctcggtggtccggactgcttagcccttgcgatgcggactggctgggcatgctcgtcgtgaaaaaggctaaaggctctgatatgattgttcccgggccttcctataagggaaaggtgttctttgagcgccccacattcgacggctacgtcgggtggggatgtggcagcgggaaatctagaacggaatccggagagctgtgcagctccgattctggcaccagctccggcctgctccctagcgaccgggtgctgtggatcggggatgttgcctgtcagccgatgacacccattcctgaagagacctttcttgagctgaagtctttctcccagagcgaatttcccgacatctgcaaaattgatggaatcgtgttcaatcagtgtgagtctgaaagcctccctcaaccctttgacgtcgcctggatggatgtgggccactcccataagatcattatgcgcgagcacaaaacaaagtgggtgcaggagtctagctccaaggacttcgtctgctataaacaggggaccggaccgtgtcctgaaagcgaggaaaagacatgcaaaacctctggctcctgcagaggggacatgcagttttgtaaggttgctggatgcgagcacggcgaagaggccagcgaggctaaatgtcggtgctctctggtgcataagcccggcgaagtggtcgtgtcctacgggggaatgcgcgttagacctaaatgttacggcttcagccggatgatggccacgcttgaggtgaaccctcccgaacaacgcatcgggcagtgcaccggatgtcacctggagtgcgtcaatggcggggtgagactcattacactgacctccgaactgaagtctgcgacagtttgtgccagccatttttgctcctctgctaccagcggcaagaaaaacacggagatccagttccactccggaagcctcgtgggcaagacagccattcacgtcaaaggggctctgcttgatggaaccgagttcacatttgaaggctcttgtatgttccccgacgggtgcgatgccgtggactgcaccttttgtcgggagttcctgaagaatccgcaatgctatcccgcgaaaaagtggctctttatcatcattgtcatcctgcttggatacgccggcctgatgctcctgaccaacgtgctgaaggctattggggtttggggctcctgggtgatcgcccctgtcaaactcatgttcgctattatcaagaaactgatgcgcagcgtgtcttgtcttatgggaaagctgatggatagaggccggcaggttatccatgaagagattggggaaaatagagagggaaaccaggacgatgtgcgcatcgagatggcccggcccagacgcgtccggcactggatgtattcccctgtgattctcacaatcctggccgtgggccttgctgaagggtgcgacgagatggttcatgcggatagcaaactggtctcttgtaagcagggaagcggcaatatgaaggaatgcgtgacgaccgggagagccctcctgcccgctgtgaacccgggccaagaggcctgtctgcactttacagcccctggatcccccgacagcaaatgcctcaagattaaagtcaagaaaatcaatctgaagtgtaagaaatcttccagctacttcgtgcctgatgctcgctcccggtgcacctctgttagacgctgtcggtgggccggcgactgccagagcgggtgcccctcccattttacatctaacagcttctccgacgattgggcgggaaagatggacagagctggccttgggttttctggatgtagcgatggctgcgggggcgccgcctgtggatgcttcaatgctgccccttcctgtatcttttggcgcaaatgggtggagaacccccacggcattatctggaaggtcagcccgtgcgctgcctgggtgccttctgcggttattgaactgaccatgccctccggggaggtgcggacgttccaccccatgagcggaatccctacacaggtcttcaaaggcgtgtctgttacctatctcgggtccgacatggaagtgagcggactgaccgatctgtgtgagattgaggaacttaagtctaaaaagctcgccctggctccgtgcaaccaggccggcatgggcgtcgtggggaaggtgggagagatccaatgttccagcgaagagtccgctagaacaattaaaaaggacggctgcatctggaatgccgatctggtcgggatcgaactccgggttgacgatgcggtgtgttacagcaaaattacctctgtggaggccgtcgctaactatagcgccatccccacaacgattggaggcctgcgctttgaaagatcccatgactctcaggggaagatcagcggatcccctcttgatattaccgctatccggggctctttcagcgtgaattacagaggcctgcgcctctccctgtctgagatcacagctacctgcacaggggaggttaccaacgtgagcggatgctactcctgtatgacgggcgccaaagtcagcattaagctgcactctaataagaactccaccgcccatgtgcggtgcaaaggggacgaaacagcgtttagcgttcttgagggagtgcactcttataccgtctccctcagcttcgatcacgccgtggttgacgaacagtgtcagctgaattgcggcgggcatgagtcccaagtgacactgaagggaaacctcatctttctggacgtccccaaattcgtggatggctcttacatgcagacctatcacagctccgtgcctacgggcgctaatattcccagccctacagactggcttaacgccctgtttgggaatggactctctagatggatcctgggcgtcattggggttctgcttggaggcctcgccctgttctttctgatcatgtccctcttcaagctggggaccaaacaggtgtttcgcagcagaacaaaacttgcttga

SEQ ID NO: 14839 - RNA, 3222 nt, synthetic construct
  misc_feature 1..3222: note = derived and/or modified CDS sequence (opt5) from SFTSV(SPL100A)__AB985313.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctgatatcccgcatctgcttggctactctgagaagatctgtcaaattgacagactgatccacgttagctcctggctccggaatcattctcagtttcaggggtatgtgggacagcgcggcgggagaagccaagtgtcctactatcccgccgaaaacagctactctcggtggtccggactgcttagcccttgcgatgcggactggctgggcatgctcgtcgtgaaaaaggctaaaggctctgatatgattgttcccgggccttcctataagggaaaggtgttctttgagcgccccacattcgacggctacgtcgggtggggatgtggcagcgggaaatctagaacggaatccggagagctgtgcagctccgattctggcaccagctccggcctgctccctagcgaccgggtgctgtggatcggggatgttgcctgtcagccgatgacacccattcctgaagagacctttcttgagctgaagtctttctcccagagcgaatttcccgacatctgcaaaattgatggaatcgtgttcaatcagtgtgagtctgaaagcctccctcaaccctttgacgtcgcctggatggatgtgggccactcccataagatcattatgcgcgagcacaaaacaaagtgggtgcaggagtctagctccaaggacttcgtctgctataaacaggggaccggaccgtgtagcgaatctgaggaaaagacatgcaaaacctccggcagctgcagaggggacatgcagttttgtaaggttgctggatgcgagcacggcgaagaggcctctgaggctaaatgtcggtgctccctggtgcataagcctggcgaagtggtcgtgagctacgggggaatgcgcgttagacccaaatgttacggcttctcccggatgatggccacgcttgaggtgaaccctcccgaacaacgcatcgggcagtgcaccggatgtcacctggagtgcgtcaatggcggggtgagactcattacactgacctctgaacttaagagcgcgacagtttgtgcctcccatttttgctctagcgctacctccggcaagaaaagcacggagatccagttccactctggatccctcgtgggcaagacagccattcacgtcaaaggggctctgcttgatggaaccgagttcacatttgaaggcagctgtatgttccccgacgggtgcgatgccgtggactgcaccttttgtcgggagttcctgaagaaccctcaatgctatccggcgaaaaagtggctctttatcatcattgtcatcctgcttggatacgccggcctgatgctcctgaccaatgtgctgaaggctattgccgtttgggggtcttgggtgatcgctcccgtcaaactcatgttcgccattatcaagaaactgatgcgctccgtgagctgtcttatgggcaagctgatggatagaggacggcaggttatccatgaagagattggcgaaaacagagaggggaatcaggacgatgtgcgcatcgagatggcccggcctagacgcgtccggcactggatgtattctcccgtgattctcacagtgctggctgttggacttgcggaaggctgcgacgagatggtccatgccgatagcaaactggtgtcctgtaagcaggggagcggaaacatgaaggaatgcgtgacgaccggcagagctctcctgcctgccgtcaatcccgggcaagaggcctgtctgcactttacagctccgggctctcctgactccaaatgcctcaagatcaaagtgaagaaaattaacctgaagtgtaagaaaagctcctcttacttcgttcccgatgcccgcagccggtgcacctccgtgagacgctgtcggtgggcgggagactgccagtctggctgccctagccattttacatccaattctttcagcgacgattgggctgggaagatggacagagccggacttggcttttccgggtgtagcgatggatgcggcggggccgcttgtggctgcttcaacgccgctccctcttgtatcttttggcgcaaatgggtcgagaatcctcacggaattatctggaaggtgtccccctgcgccgcgtgggttccgagcgccgtgatcgaactgaccatgccttctggcgaggtccggacgttccaccccatgtccgggattcccacacaggtgttcaaaggagttagcgtgacctatctcggctctgacatggaagtctccgggctgaccgatctgtgtgagatcgaggaacttaagagcaaaaagctcgctctggccccttgcaaccaggctggaatgggcgtggtgggcaaggtcggggagattcaatgttccagcgaagagtctgccagaacaatcaaaaaggacggatgcatttggaacgcggatctggttggcatcgaactccgggtggacgatgccgtgtgttacagcaaaatcacctccgtcgaggctgtggccaattattctgctattccgacaacgatcgggggactgcgctttgaaagaagccatgactcccagggcaagatttctgggagcccccttgatatcaccgccattcggggatccttctctgttaactacagaggcctgcgcctcagcctgtccgagatcacagctacctgcacaggcgaggtgaccaatgtcagcgggtgctactcttgtatgacgggagccaaagtgtccatcaagctgcacagcaacaaaaattctaccgcgcatgttcggtgcaagggcgacgaaacagccttttccgtgcttgagggggtccacagctataccgtgtccctctctttcgatcacgctgttgtggacgaacagtgtcagctgaactgcggaggccatgagagccaagtcacactgaaggggaatctcatttttctggacgtgcctaaattcgtggatggatcctacatgcagacctatcacagctctgtccccacgggcgccaacatcccttcccccacagactggcttaatgccctgtttggcaacgggctcagcagatggattctgggagttatcggcgtgctgcttgggggactcgctctgttctttctgattatgtctctcttcaagctgggcaccaaacaggtgtttcgcagcagaacaaagctggcctga

SEQ ID NO: 14840 - RNA, 3222 nt, synthetic construct
  misc_feature 1..3222: note = derived and/or modified CDS sequence (opt5) from SFTSV(SPL106A)__AB985316.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttccttgagctgaagtctttttcccagagcgagttccccgatatctgcaaaattgacggaatcgtgtttaaccagtgtgaatctgaaagcctccctcaacccttcgatgtcgcctggatggacgtgggccactcccataagatcattatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggaggcctctgaagctaaatgtcggtgctccctggtgcataagcctggcgaggtggtcgtgagctatgggggaatgcgcgttagacccaaatgttacggcttttcccggatgatggccacgcttgaagtgaatcctcccgagcagcgcatcgggcaatgcaccggatgtcacctggaatgcattaacggcggggtcagactcatcacactgacctctgagctgaagtccgcgacagtgtgtgcctcccatttctgctctagcgctacctccggcaagaaaagcacggagattcagttccactctggatccctcgttggcaagacagccatccacgtgaaaggggctctggtcgacggaaccgaatttacattcgagggcagctgtatgtttcccgatgggtgcgacgccgtggattgcaccttctgtcgggaatttcttaagaatcctcagtgctacccggcgaaaaagtggctgttcatcattatcgtcattctcctgggatatgccggccttatgctgctcaccaacgtgctgaaggctatcggggtttggggctcttgggtgattgcccccgtcaaactgatgtttgctatcctcaagaaactgatgcgctccgtgagctgtcttatgggaaagctgatggacagaggccggcaagttatccatgaggaaattggggagaatagagagggaaaccaggatgacgtgcgcatcgaaatggcccggcctagacgcgtccggcactggatgtactctcccgtgattctcacaatcctggccattggccttgctgaggggtgcgatgaagtggttcatgcggacagcaaactggtctcctgtaagcagggaagcggcaatatgaaggagtgcgtgacgaccgggagagccctcctgcctgctgtgaaccccggccaggaggcctgtctgcacttcacagccccgggatctcctgattccaaatgcctcaagatcaaagtcaagcgcattaatctgaaatgtaaaaagagctcctcttattttgtgcccgacgctcggagcagatgcacctccgttcgccggtgtagatgggccggcgattgccaatctgggtgccctagccatttcacatccaactcttttagcgacgactgggcgggaaagatggatcgcgctggccttgggttctccggatgtagcgacggctgcgggggcgccgcctgtggatgctttaatgctgccccctcttgtatcttctggcggaagtgggtggaaaaccctcacggcatcatttggaaagtctccccctgcgctgcctgggtgccgagcgcggttatcgagctgaccatgccttctggggaagtgagaacgttccaccccatgtccggcattcccacacaggtctttaagggagtgagcgttacctacctcgggtctgatatggaggtgtccggactgaccgacctgtgtgaaatcgaggagcttaaaagcaagaaactcgccctggctccttgcaaccaggccggcatgggcgtcgtggggaaggtgggagaaattcagtgttccagcgaggaatctgctcggacaatcaagaaagatggctgcatctggaatgccgacctggtcgggattgagctccgcgttgatgacgcggtgtgttatagcaagatcacctccgtggaagccgtcgctaactactctgccattccgacaacgatcggaggcctgagattcgagcggagccatgattcccaagggaaaatttctggaagcccccttgacatcaccgctatcagaggctccttttctgtgaattatcgcggcctgcggctcagcctgtccgagattacagctacctgcacaggggaagttaccaacgtgagcggatgctactcttgtatgatcggcgccaaggtctccattaaactgcacagctctaagaatagcacggcccatgtgagatgcaagggggatgagaccgcgttcagcgttcttgaaggagtgcactcctacacagtctctctcagctttgaccacgccgtggttgatgagcagtgtcagctgaactgcggcgggcatgaatcccaggtgaccctgaaaggaaatctcatcttcctggacgtccctaagtttgtggacggcagctatatgcaaacataccactcttccgtgcccaccggcgctaacattcctagccccacggattggcttaatgccctgttcgggaacggactctctcgctggatcctgggcgtcatcggggttctgcttggaggcctcgccctgtttagcctgattatgtccctcttcaaactggggacaaaacaggtgcttagatctcggaccaagctggcttga

SEQ ID NO: 14841 - RNA, 3222 nt, synthetic construct
  misc_feature 1..3222: note = derived and/or modified CDS sequence (opt5) from SFTSV(SPL117A)__AB985321.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctaccgcggaaaggtgtttttcgagagacccacatttgatggctatgtcgggtggggatgtggcagcgggaagtctcggacggaatccggagagctgtgcagctccgactctggcaccagctccggcctgctccctagcgatcgcgtgctgtggatcggggacgttgcctgtcagccgatgacacccattcctgaagagaccttccttgagctgaaatctttttcccagagcgagttccccgatatctgcaagattgacggaatcgtgtttaaccagtgtgaatctgaaagcctccctcaacccttcgatgtcgcctggatggacgtgggccactcccataaaatcattatgagagagcacaagacaaaatgggtgcaggagtctagctccaaggattttgtctgctacaaggaagggaccggaccgtgtagcgagtctgaagagaaaacatgcaagacctccggcagctgccgcggggacatgcagttctgtaaagttgctggatgcgaacacggcgaggaggcctctgaagctaagtgtcggtgctccctggtgcataaacctggcgaggtggtcgtgagctatgggggaatgagagttcggcccaagtgttacggcttttcccgcatgatggccacgcttgaagtgaatcctcccgagcagagaatcgggcaatgcaccggatgtcacctggaatgcattaacggcggggtccggctcatcacactgacctctgagctgaaaagcgcgacagtgtgtgcctcccatttctgctctagcgctacctccggcaaaaagagcacggagattcagttccactctggatccctcgttggcaagacagccatccacgtgaagggggctctggtcgacggaaccgaatttacattcgagggcagctgtatgtttcccgatgggtgcgacgccgtggattgcaccttctgtcgcgaatttcttaaaaatcctcagtgctacccggcgaagaaatggctgttcatcattatcgtcattctcctgggatatgccggccttatgctgctcaccaacgtgctgaaggctatcggggtttggggctcttgggtgattgcccccgtcaagctgatgtttgctatcatcaaaaagctcatgagatccgtgagctgtctgatgggaaaacttatggaccggggcagacaagttattcatgaggaaatcggggagaatcgcgagggaaaccaggatgacgtgcggattgaaatggccagacctcgccgggtcagacactggatgtactctcccgtgatcctgacaattctcgccatcggcctggctgaggggtgcgatgaaatggtgcatgcggacagcaaacttgtttcctgtaagcagggaagcggcaatatgaaggagtgcgtcacgaccgggcgcgccctgctccctgctgtgaaccccggccaggaggcctgtctgcacttcacagccccgggatctcctgattccaagtgcctgaaaattaaggtgaaacggatcaatctcaagtgtaaaaagagctcctcttattttgtccccgacgctagaagccgctgcacctccgtgcggagatgtcgctgggccggcgattgccaatctgggtgccctagccatttcacatccaactcttttagcgacgactgggcgggaaagatggatcgggctggcctggggttctccggatgtagcgacggctgcgggggcgccgcctgtggatgctttaatgctgccccctcttgtatcttctggagaaaatgggttgaaaaccctcacggcattatctggaaggtgtccccctgcgctgcctgggtcccgagcgcggtgattgagcttaccatgccttctggggaagttcggacgttccaccccatgtccggaatccccacacaggtgtttaaaggcgtcagcgtgacctacctggggtctgatatggaggtttccggactcaccgacctgtgtgaaattgaggagcttaagagcaaaaagctggccctcgctccttgcaaccaggccggcatgggcgtggtcgggaaagtgggagaaatccagtgttccagcgaggaatctgctcgcacaatcaagaaggatggctgcatttggaatgccgacctggtggggatcgagctgagagtcgatgacgcggtttgttatagcaaaattacctccgtggaagccgtggctaactactctgccatcccgacaacgattggaggcctccggttcgagagaagccatgattcccaagggaagatctctggaagccccctggacatcaccgctattcgcggctccttttctgtcaattatcggggccttagactgagcctctccgagatcacagctacctgcacaggggaagtgaccaacgttagcggatgctactcttgtatgacgggcgccaaagtgtccattaagctgcacagctctaaaaattccaccgcccatgtccgctgcaagggggatgagacagcgttcagcgtgctggaaggagttcactcctacaccgtgtctcttagctttgaccacgccgtcgtggatgagcagtgtcagctcaactgcggcgggcatgaatcccaggttacactgaagggaaatctgatcttcctcgacgtgcctaaatttgtcgacggcagctatatgcaaacctaccactcttccgtgcccacgggcgctaacattcctagccccacagattggctgaatgcccttttcgggaacggactgtctagatggatcctcggcgtgatcggggtcctgctgggaggccttgccctctttttcctgattatgagcctgtttaagctcgggaccaaacaggttttccggtcccgcacaaagctggcttga

SEQ ID NO: 14842 - RNA, 3222 nt, synthetic construct
  misc_feature 1..3222: note = derived and/or modified CDS sequence (opt5) from SFTSV(SPL120A)__AB985322.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcagattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttccttgagctgaagtctttttcccagagcgagttccccgatatctgcaaaattgacggaatcgtgtttaaccagtgtgaatctgaaagcctccctcaacccttcgatgtcgcctggatggacgtgggccactcccataagatcattatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggaggcctctgaagctaaatgtcggtgctccctggtgcataagcctggcgaggtggtcgtgagctatgggggaatgcgcgttagacccaaatgttacggcttttcccggatgatggccacgcttgaagtgaatcctcccgagcagcgcatcgggcaatgcaccggatgtcacctggaatgcattaacggcggggtcagactcatcacactgacctctgagctgaagtccgcgacagtgtgtgcctcccatttctgctctagcgctacctccggcaagaaaagcacggagattcagttccactctggatccctcgttggcaagacagccatccacgtgaaaggggctctggtcgacggaaccgaatttacattcgagggcagctgtatgtttcccgatgggtgcgacgccgtggattgcaccttctgtcgggaatttcttaagaatcctcagtgctacccggcgaaaaagtggctgttcatcattatcgtcattctcctgggatatgccggccttatgctgctcaccaacgtgctgaaggctatcggggtttggggctcttgggtgattgcccccgtcaaactgatgtttgctatcctcaagaaactgatgcgctccgtgagctgtcttatgggaaagctgatggacagaggccggcaagttatccatgaggaaattggggagaatagagagggaaaccaggatgacgtgcgcatcgaaatggcccggcctagacgcgtccggcactggatgtactctcccgtgattctcacaatcctggccattggccttgctgaggggtgcgatgaagtggttcatgcggacagcaaactggtctcctgtaagcagggaagcggcaatatgaaggagtgcgtgacgaccgggagagccctcctgcctgctgtgaaccccggccaggaggcctgtctgcacttcacagccccgggatctcctgattccaaatgcctcaagatcaaagtcaagcgcattaatctgaaatgtaaaaagagctcctcttattttgtgcccgacgctcggagcagatgcacctccgttcgccggtgtagatgggccggcgattgccaatctgggtgccctagccatttcacatccaactcttttagcgacgactgggcgggaaagatggatcgcgctggccttgggttctccggatgtagcgacggctgcgggggcgccgcctgtggatgctttaatgctgccccctcttgtatcttctggcggaagtgggtggaaaaccctcacggcatcatttggaaagtctccccctgcgctgcctgggtgccgagcgcggttatcgagctgaccatgccttctggggaagtgagaacgttccaccccatgtccggcattcccacacaggtctttaagggagtgagcgttacctacctcgggtctgatatggaggtgtccggactgaccgacctgtgtgaaatcgaggagcttaaaagcaagaaactcgccctggctccttgcaaccaggccggcatgggcgtcgtggggaaggtgggagaaattcagtgttccagcgaggaatctgctcggacaatcaagaaagatggctgcatctggaatgccgacctggtcgggattgagctccgcgttgatgacgcggtgtgttatagcaagatcacctccgtggaagccgtcgctaactactctgccattccgacaacgatcggaggcctgagattcgagcggagccatgattcccaagggaaaatttctggaagcccccttgacatcaccgctatcagaggctccttttctgtgaattatcgcggcctgcggctcagcctgtccgagattacagctacctgcacaggggaagttaccaacgtgagcggatgctactcttgtatgacgggcgccaaggtctccatcaaactgcacagctctaagaatagcaccgcccatgtgagatgcaagggggatgagacagcgttcagcgttcttgaaggagtgcactcctacaccgtctctctcagctttgaccacgccgtggttgatgagcagtgtcagctgaactgcggcgggcatgaatcccaggtgacactgaaaggaaatctcattttcctggacgtccctaagtttgtggacggcagctatatgcaaacctaccactcttccgtgcccacgggcgctaacatccctagccccacagattggcttaatgccctgttcgggaacggactctctcgctggattctgggcgtcatcggggttctgcttggaggcctcgccctgtttagcctgatcatgtccctcttcaaactggggaccaagcaagtgtttagatctcggacaaaacttgcttga

SEQ ID NO: 14843 - RNA, 3222 nt, synthetic construct
  misc_feature 1..3222: note = derived and/or modified CDS sequence (opt5) from SFTSV(SPL121A)__AB985323.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttccttgagctgaagtctttttcccagagcgagttccccgatatctgcaaaattgacggaatcgtgtttaaccagtgtgaatctgaaagcctccctcaacccttcgatgtcgcctggatggacgtgggccactcccataagatcattatgcgcgagcacaaaacaaagtgggtgcaggagtctagcccgaaggattttgtctgctacaaagaagggaccggaccttgttccgagagcgaagagaagacatgcaaaacctctggctcctgcagaggggacatgcagttctgtaaggttgctggatgcgaacacggcgaggaggccagcgaagctaaatgtcggtgctctctggtgcataagcccggcgaggtggtcgtgtcctatgggggaatgcgcgttagacctaaatgttacggctttagccggatgatggccacgcttgaagtgaatagccccgagcagcgcatcgggcaatgcaccggatgtcacctggaatgcattaacggcggggtcagactcatcacactgacctctgagcttaagagcgcgacagtgtgtgcctcccatttctgctctagcgctacctccggcaagaaaagcacggagattcagttccactctggatccctcgttggcaagacagccatccacgtgaaaggggctctggtcgacggaaccgaatttacattcgagggcagctgtatgtttcccgatgggtgcgacgccgtggattgcaccttctgtcgggaatttcttaagaatcctcagtgctacccggcgaaaaagtggctgttcatcattatcgtcattctcctgggatatgccggccttatgctgctcaccaacgtgctgaaggctatcggggtttggggctcttgggtgattgcccccgtcaaactgatgtttgctatcatcaagaaactcatgcgctccgtgagctgtctgatgggaaagctgatggacagaggccggcaagttattcatgaggaaatcggggagaatagagagggaaaccaggatgacgtgcgcattgaaatggcccggcctagacgcgtccggcactggatgtactctcccgtgatcctgacaattctcgccatcggcctggctgaggggtgcgatgaaatggtgcatgcggacagcaaacttgtttcctgtaagcagggaagcggcaatatgaaggagtgcgtcacgaccgggagagccctgctccctgctgtgaaccccggccaggaggcctgtctgcacttcacagccccgggatctcctgattccaaatgcctgaaggtgaaagtcaagcgcattaatctcaaatgtaagaagtcctcctcttattttgtgcccgacgctcggagcagatgcacctccgttcgccggtgtagatgggccggcgattgccaatctgggtgccctagccatttcacatccaactcttttagcgacgactgggcgggaaaaatggatcgcgctggcctggggttctccggatgtagcgacggctgcgggggcgccgcctgtggatgctttaatgctgccccctcttgtatcttctggcggaagtgggtggaaaaccctcacggcatcatttggaaagtctccccctgcgctgcctgggtgccgagcgcggttatcgagcttaccatgccttctggggaagtgagaacgttccaccccatgtccggcattcccacacaggtctttaagggagtgagcgttacctacctggggtctgatatggaggtgtccggactcaccgacctgtgtgaaatggaggagctgaaaagcaagaaacttgccctcgctccttgcaaccaggccggcatgggcgtcgtggggaaggtgggagaaatccagtgttccagcgaggaatctgctcggacaattaagaaagatggctgcatctggaatgccgacctggtcgggatcgagctgcgcgttgatgacgcggtgtgttatagcaagattacctccgtggaagccgtcgctaactactctgccatcccgacaacgattggaggcctcagattcgagcggagccatgattcccaagggaaaatctctggaagccccctggacattaccgctatcagaggctccttttctgtgaattatcgcggccttcggctgagcctctccgagatcacagctacctgcacaggggaagttaccaacgtgagcggatgctactcttgtatgacgggcgccagagtctccattaagctgcacagctctaaaaattccaccgcccatgtgcgctgcaagggggatgagacagcgttcagcgttctggaaggagtgcactcctacaccgtctctcttagctttgaccacgccgtggttgatgagcagtgtcagctcaactgcggcgggcatgaatcccaggtgacactgaagggaaatctgatcttcctcgacgtccctaaatttgtggacggcagctatatgcaaacctaccactcttccgtgcccacgggcgctaacattcctagccccacagattggctgaatgcccttttcgggaacggactgtctagatggatcctcggcgtcattggggttctgctgggaggccttgccctctttttcctgatcatgagcctgtttaagctcgggaccaaacaggtgttccggtcccgcacaaagctggcttga

SEQ ID NO: 14844 - RNA, 3222 nt, synthetic construct
  misc_feature 1..3222: note = derived and/or modified CDS sequence (opt5) from SFTSV(SPL124A)__AB985324.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttccttgagctgaagtctttttcccagagcgagttccccgatatctgcaaaattgacggaatcgtgtttaaccagtgtgaatctgaaagcctccctcaacccttcgatgtcgcctggatggacgtgggccactcccataagatcattatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggaggcctctgaagctaaatgtcggtgctccctggtgcataagcctggcgaggtggtcgtgagctatgggggaatgcgcgttagacccaaatgttacggcttttcccggatgatggccacgcttgaagtcaattctcctgagcagcgcatcgggcaatgcaccggatgtcacctggaatgcattaacggcggggtgagactcatcacactgaccagcgagctgaagtccgcgacagtgtgtgcctctcatttctgcagctccgctaccagcggcaagaaatctacggagattcagttccactccggaagcctcgttggcaagacagccatccacgtgaaaggggctctggtcgacggaaccgaatttacattcgagggctcttgtatgtttcccgatgggtgcgacgccgtggattgcaccttctgtcgggaatttcttaagaatccccagtgctaccctgcgaaaaagtggctgttcatcattatcgtcattctcctgggatatgccggccttatgctgctcaccaacgtgctgaaggctatcggggtttggggctcctgggtgattgccccggtcaaactgatgtttgctatcatcaagaaactcatgcgcagcgtgtcttgtctgatgggaaagctgatggacagaggccggcaagttattcatgaggaaatcggggagaatagagagggaaaccaggatgacgtgcgcattgaaatggcccggcccagacgcgtccggcactggatgtacagccctgtgatccttacaattctcgccatcggcctggctgaggggtgcgatgaaatggtgcatgcggactccaaacttgttagctgtaagcagggatctggcaatatgaaggagtgcgtcacgaccgggagagccctgctccccgctgtgaaccctggccaggaggcctgtctgcacttcacagcccccggatccccggatagcaaatgcctgaagattcgcgtgaaacggatcaatctcaagtgtaaaaagtcctctagctattttgtccctgacgctagatcccgctgcacctctgtgcggagatgtcgctgggccggcgattgccaaagcgggtgcccctcccatttcacatctaacagcttttccgacgactgggcgggaaagatggatcgggctggcctggggttcagcggatgttctgacggctgcgggggcgccgcctgtggatgctttaatgctgccccttcctgtatcttctggagaaaatgggttgaaaacccccacggcattatctggaaggtgagcccttgcgctgcctgggtcccctctgcggtgattgagcttaccatgccgtccggggaagttcggacgttccaccctatgagcggaatccccacacaggtgtttaaaggcgtctctgtgacctacctggggtccgatatggaggttagcggactcaccgacctgtgtgaaattgaggagctgaagtccaaaaagctcgcccttgctccctgcaaccaggccggcatgggcgtggtcgggaaagtgggagaaatccagtgtagctctgaggaaagcgctcgcacaatcaagaaggatggctgcatttggaatgccgacctggtggggatcgagctgagagtcgatgacgcggtttgttattccaaaattacctctgtggaagccgtggctaactacagcgccatccctacaacgattggaggcctccggttcgagagatcccatgattctcaagggaagatcagcggatccccgctggacatcaccgctattcgcggctcttttagcgtcaattatcggggccttagactgtccctcagcgagatcacagctacctgcacaggggaagtgaccaacgtttctggatgctactcctgtatgacgggcgcccgcgtgagcattaaactgcactcttccaagaatagcaccgcccatgtcagatgcaaaggggatgagacagcgttctccgtgctggaaggagttcactcttacaccgtgagcctttcctttgaccacgccgtcgtggatgagcagtgtcagctcaactgcggcgggcatgaaagccaggttacactgaagggaaatctgatcttcctcgacgtgcccaagtttgtcgacggctcttatatgcaaacctaccactccagcgtgcctacgggcgctaacattccctctcctacagattggctgaatgcccttttcgggaacggactgagccggtggatcctcggcgtgatcggggtcctgctgggaggccttgccctctttttcctgattatctccctgtttaaactcgggaccaagcaggttttccgctctagaacaaaactggcttga

SEQ ID NO: 14845 - RNA, 3222 nt, synthetic construct
  misc_feature 1..3222: note = derived and/or modified CDS sequence (opt5) from SFTSV(SPL128A)__AB985325.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttccttgagctgaagtctttttcccagagcgagttccccgatatctgcaaaattgacggaatcgtgtttaaccagtgtgaatctgaaagcctccctcaacccttcgatgtcgcctggatggacgtgggccactcccataagatcattatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggaggcctctgaagctaaatgtcggtgctccctggtgcataagcctggcgaggtggtcgtgagctatgggggaatgcgcgttagacccaaatgttacggcttttcccggatgatggccacgcttgaagtcaattctcctgagcagcgcatcgggcaatgcaccggatgtcacctggaatgcattaacggcggggtgagactcatcacactgaccagcgagctgaagtccgcgacagtgtgtgcctctcatttctgcagctccgctaccagcggcaagaaatctacggagattcagttccactccggaagcctcgttggcaagacagccatccacgtgaaaggggctctggtcgacggaaccgaatttacattcgagggctcttgtatgtttcccgatgggtgcgacgccgtggattgcaccttctgtcgggaatttcttaagaatccccagtgctaccctgcgaaaaagtggctgttcatcattatcgtcattctcctgggatatgccggccttatgctgctcaccaacgtgctgaaggctatcggggtttggggctcctgggtgattgccccggtcaaactgatgtttgctatcatcaagaaactcatgcgcagcgtgtcttgtctgatgggaaagctgatggacagaggccggcaagttattcatgaggaaatcggggagaatagagagggaaaccaggatgacgtgcgcattgaaatggcccggcccagacgcgtccggcactggatgtacagccctgtgatccttacaattctcgccatcggcctggctgaggggtgcgatgaaatggtgcatgcggactccaaacttgttagctgtaagcagggatctggcaatatgaaggagtgcgtcacgaccgggagagccctgctccccgctgtgaaccctggccaggaggcctgtctgcacttcacagcccccggatccccggatagcaaatgcctgaagattcgcgtgaaacggatcaatctcaagtgtaaaaagtcctctagctattttgtccctgacgctagatcccgctgcacctctgtgcggagatgtcgctgggccggcgattgccaaagcgggtgcccctcccatttcacatctaacagcttttccgacgactgggcgggaaagatggatcgggctggcctggggttcagcggatgttctgacggctgcgggggcgccgcctgtggatgctttaatgctgccccttcctgtatcttctggagaaaatgggttgaaaacccccacggcattatctggaaggtgagcccttgcgctgcctgggtcccctctgcggtgattgagcttaccatgccgtccggggaagttcggacgttccaccctatgagcggaatccccacacaggtgtttaaaggcgtctctgtgacctacctggggtccgatatggaggttagcggactcaccgacctgtgtgaaattgaggagctgaagtccaaaaagctcgcccttgctccctgcaaccaggccggcatgggcgtggtcgggaaagtgggagaaatccagtgtagctctgaggaaagcgctcgcacaatcaagaaggatggctgcatttggaatgccgacctggtggggatcgagctgagagtcgatgacgcggtttgttattccaaaattacctctgtggaagccgtggctaactacagcgccatccctacaacgattggaggcctccggttcgagagatcccatgattctcaagggaagatcagcggatccccgctggacatcaccgctattcgcggctcttttagcgtcaattatcggggccttagactgtccctcagcgagatcacagctacctgcacaggggaagtgaccaacgtttctggatgctactcctgtatgacgggcgcccgcgtgagcattaaactgcactcttccaagaatagcaccgcccatgtcagatgcaaaggggatgagacagcgttctccgtgctggaaggagttcactcttacaccgtgagcctttcctttgaccacgccgtcgtggatgagcagtgtcagctcaactgcggcgggcatgaaagccaggttacactgaagggaaatctgatcttcctcgacgtgcccaagtttgtcgacggctcttatatgcaaacctaccactccagcgtgcctacgggcgctaacattccctctcctacagattggctgaatgcccttttcgggaacggactgagccggtggatcctcggcgccatcggggtgctgctgggaggccttgctctctttttcctgattatctccctgtttaaactcgggaccaagcaggtcttccgctctagaacaaaactggcctga

SEQ ID NO: 14846 - RNA, 3222 nt, synthetic construct
  misc_feature 1..3222: note = derived and/or modified CDS sequence (opt5) from SFTSV(SPL129A)__AB985326.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctactatcccgccgaaaatagctactctcggtggtccggactgcttagcccttgcgacgcggattggctgggcatgctcgtcgtgaaaaaggctaaaggctctgacatgattgttcccgggccttcctataagggaaaggtgttctttgagcgccccacattcgatggctacgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagacctttcttgagctgaagtctttctcccagagcgaatttcccgatatctgcaaaattgacggaatcgtgttcaaccagtgtgagtctgaaagcctccctcaaccctttgatgtcgcctggatggacgtgggccactcccataagatcattatgcgcgagcacaaaacaaagtgggtgcaggagtctagctccaaggatttcgtctgctataaagaagggaccggaccgtgtagcgagtctgaagagaagacatgcaaaacctccggcagctgcagaggggacatgcagttttgtaaggttgctggatgcgaacacggcgaggaggcctctgaagctaaatgtcggtgctccctggtgcataagcctggcgaggtggtcgtgagctacgggggaatgcgcgttagacccaaatgttacggcttctcccggatgatggccacgcttgaagtgaatcctcccgagcagcgcatcgggcaatgcaccggatgtcacctggaatgcatttctggcggggtcagactcatcacactgaccagcgagctgaagtccgcgacagtgtgtgcctctcatttttgcagctccgctaccagcggcaagaaatctacggagattcagttccactccggaagcctcgttggcaaggccgctatccacgtgaaaggggccctggtcgacggaacagagttcacctttgaaggctcttgtatgttccccgatgggtgcgacgcggtggattgcacattttgtcgggagttccttaagaaccctcagtgctatccggccaaaaagtggctgtttatcattatcgtcattctcctgggatacgctggccttatgctgctcaccaatgtgctgaaggccatcggggtttggggctcctgggtgattgctcccgtcaaactgatgttcgccatcatgaagaaactcatgcgcagcgtgtcttgtctgatgggaaagctgatggacagaggccggcaagttatccatgaagaaattggggagaacagagagggaaatcgcgatgacgtgcggatcgaaatggccagacctcgccgggtcagacactggatgtatagccccgtgattctgaccatcctcgctattggcctggcggaggggtgcgatgaaatggtgcatgccgactccaaacttgttagctgtcgccagggatctggcaacatgaaggagtgcgtcacaacggggcgggctctgctccctgccgtgaatcccggccaggaggcctgtctgcactttaccgctccgggatcccctgatagcaagtgcctgaaaatcaaggtgaaaagaattaacctcaagtgtaaaaagtcctctagctacttcgtccccgacgcccgctcccggtgcacatctgtgagacgctgtcggtgggcgggcgattgccagagcgggtgcccttcccattttacctctaatagcttctccgacgactgggctggaaagatggatagagccggcctggggtttagcggatgttctgacggctgcgggggcgccgcttgtggatgcttcaacgccgctccctcctgtatcttttggcggaaatgggttgaaaatcctcacggcatcatttggaaggtgagcccctgcgccgcgtgggtcccgtctgccgtgatcgagcttacaatgccttccggggaagttcgcaccttccaccccatgagcggcattcccacgcaagtgttcaaaggagtctctgtgacatatctggggtccgatatggaggttagcggactcaccgacctgtgtgaaatcgaggagctgaagtccaaaaagctcgctcttgccccttgcaaccaggctggcatgggcgtggtcgggaaagtgggagaaattcagtgtagctctgaggaaagcgccagaaccatcaagaaggatggctgcatctggaacgcggacctggtggggattgagctgcgggtcgatgacgccgtttgttactccaaaatcacatctgtggaaaccgtggctaattatagcgccattccgacaacgatcggaggcctcagatttgagcgctcccatgattctcaggggaagattagcggatctcccctggacatcaccgctatccggggctccttcagcgtcaactacagaggccttcgcctgtccctcagcgagattacagctacctgcacaggggaagtgaccaatgtttctggatgctactcctgtatgacgggcgccaaagtgagcatcaagctgcactcttccaaaaacagcaccgcccatgtcagatgcaaggaggatgaaacagcgttttccgtgctggagggggttcactcttataccgtgagcctttccttcgaccacgccgtcgtggatgaacaatgtcagctcaattgcggaggccatgagagccacgttacactgaaggggaacctgatttttctcgacgtgcctaaattcgtcgacggatcttacatgcagacctatcattccagcgtgcccacgggcgctaatatcccttctcccacagattggctgaacgccctttttggcaatgggctgagccggtggattctcggagtgatgggcgtcctgcttgggggacttgccctcttctttctgatcatgtccctgttcaagctcggcaccaaacaggtttttcgctctagaacaaagctggcttga

SEQ ID NO: 14847 - RNA, 3222 nt, synthetic construct
  misc_feature 1..3222: note = derived and/or modified CDS sequence (opt5) from SFTSV(YG1)__AB817987.1__GP
  source 1..3222: mol_type = other RNA
atgatgaaggtgatctggttcagctccctgatttgcctcgtcatccagtgttctggcgacaccgggcccattatctgcgccggacctattcacagcaacaaatccgctaatatcccgcatctgcttggctactctgagaagatctgtcaaattgatagactgatccacgttagctcctggctccggaaccattctcagtttcaggggtatgtgggacagcgcggcgggagaagccaagtgtcctacttccccgccgaaaatagctattctcggtggtccggactgcttagcccttgcgacgcggattggctgggcatgctcgtcgtgaaaaaggctaaaggctctgacatgattgttcccgggccttcctacaagggaaaggtgtttttcgagcgccccacatttgatggctatgtcgggtggggatgtggcagcgggaaatctagaacggaatccggagagctgtgcagctccgactctggcaccagctccggcctgctccctagcgatcgggtgctgtggatcggggacgttgcctgtcagccgatgacacccattcctgaagagaccttccttgagctgaagtctttttcccagagcgagttccccgatatctgcaaaattgacggaatcgtgtttaaccagtgtgaatctgaaagcctccctcaacccttcgatgtcgcctggatggacgtgggccactcccataagatcattatgcgcgagcacaaaacaaagtgggtgcaggagtctagctccaaggattttgtctgctacaaagaagggaccggaccgtgtagcgagtctgaagagaagacatgcaaaacctccggcagctgcagaggggacatgcagttctgtaaggttgctggatgcgaacacggcgaggagacgtctgaagccaaatgtcggtgctccctggtgcataagcctggcgaggtggtcgtgagctatgggggaatgcgcgttagacccaaatgttacggcttttcccggatgatggctacccttgaagtgaatcctcccgagcagcgcatcgggcaatgcacaggatgtcacctggaatgcattaacggcggggtcagactcatcaccctgacatctgagcttaagagcgccaccgtgtgtgcgtcccatttctgctctagcgccacgtccggcaagaaaagcacagagattcagttccactctggatccctcgttggcaagaccgctatccacgtgaaaggggccctggtcgacggaacagaatttaccttcgagggcagctgtatgtttcccgatgggtgcgacgctgtggattgcaccttctgtcgggaatttcttaagaatcctcagtgctacccggccaaaaagtggctgttcatcattatcgtcattctcctgggatatgcgggccttatgctgctcacaaacgtgctgaaggccatcgggatttggggctcttgggttatcgctcccgtgaaactgatgtttgccatcattaagaaactcatgcgctccgtcagctgtctgatgggaaagctgatggacagaggccggcaagtgatccatgaggaaattggggagaatagagagggaaaccaggaagatgttcgcatcgagatggctcggcctagacgcgtgcggcactggatgtactctcccgtcattctggccatcctcgccattggcctggctgaagggtgcgacgagatggtgcatgcggatagcaaacttgtgtcctgtaagcagggaagcggcaatatgaaggagtgcgttacgaccgggagagccctgctccctgctgtcaaccccggccaggaagcctgtctgcacttcacagccccgggatctcctgactccaaatgcctgaagatcaaagtgaagcgcatcaatctcaaatgtaagaagtcctcctcttattttgtgcccgatgctcggagcagatgcacctccgtccgccggtgtagatgggccggcgactgccaatctgggtgccctagccatttcacatccaactcttttagcgatgactgggcgggaaaaatggaccgcgctggcctggggttctccggatgtagcgatggctgcgggggcgccgcctgtggatgctttaatgctgccccctcttgtattttctggcggaagtgggtggagaaccctcacggcatcatttggaaagtttccccctgcgctgcctgggtgccgagcgcggtcatcgaacttaccatgccttctggggaggtgagaacgttccaccccatgtccggcattcccacacaggtttttaagggagtgagcgtcacctacctggggtctgacatggaagtgtccggactcaccgatctgtgtgagatcgaggaactgaaaagcaagaaacttgccctcgctccttgcaaccaggccggcatgggcgttgtggggaaggtcggagagatccagtgttccagcgaagagtctgctcggacaattaagaaagacggctgcatctggaatgccgatctggtggggattgaactgcgcgtggacgatgcggtctgttatagcaagatcacctccgttgaggccgtggctaactactctgccattccgacaacgatcggaggcctcagattcgagcggagccatgactcccaagggaaaatctctggaagccccctggatattaccgctatcagaggctccttttctgtgaattatcgcggccttcggctgagcctctccgaaattacagctacctgcacaggggaggtcaccaacgtgagcggatgctactcttgtatgacgggcgccaaggtttccatcaaactgcacagctctaagaatagcaccgcccatgtgagatgcaagggggacgaaacagcgttcagcgtcctggagggagtgcactcctacaccgtttctcttagctttgatcacgccgtggtcgacgaacagtgtcagctcaactgcggcgggcatgagtcccaggtgacactgaaaggaaatctgattttcctcgatgttcctaagtttgtggacggcagctatatgcaaacctaccactcttccgtccccacgggcgctaacatccctagccccacagactggctgaatgcccttttcgggaacggactgtctcgctggatcctcggcgtgattggggtgctgctgggaggccttgccctctttttcctgatcatgagcctgtttaaactcgggaccaagcaggtcttcagatcccggacaaaactggcttga

SEQ ID NO: 14848 - RNA, 3222 nt, synthetic construct
  misc_feature 1..3222: note = derived and/or modified CDS sequence (opt5) from SFTSV(SDTA_1)__KX641913.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctcgcgagtccgacatgattgttcccgggcctagctataaaggaaaggtgttctttgaaagacccaccttcgatggctacgtcgggtggggatgtggctctgggaagtcccggacagagagcggagaactgtgctcctctgacagcggcacgtccagcggcctgctcccttctgatcgcgtgctgtggatcggggacgttgcctgtcagcttatgaccccgattcccgaggagacatttctggaactcaaatccttcagccagtctgagtttcctgatatctgcaagattgacggaatcgtgttcaatcagtgtgaaggcgagagcctgccccaaccttttgatgtcgcctggatggacgtggggcactcccataaaatcattatgagagagcacaagaccaaatgggtgcaggaatctagctccaaggatttcgtctgctataaggagggaacaggcccctgtagcgaatctgaggaaaaggcttgcaagacctccgggagctgccggggagacatgcagttttgtaaagttgccggctgcgagcacggcgaggaaacatctgaggctaagtgtcgctgctcccttgtgcataaaccgggggaagtggtcgtgagctacggaggcatgagagttcggcctaagtgttacgggttctcccgcatgatggccaccctggaggtgaatccccctgaacagagaatcggacaatgcacgggctgtcacctcgagtgcattaacgggggcgtccggctgatcaccctgacatctgagctccgcagcgcgaccgtgtgtgcctcccatttttgctctagcgcttccagcggcaaaaagtctacagaaattcacttccactccggaagcctggttgggaagaccgccatccatgtgaaaggagctcttgtcgacggcacggagttcacatttgaagggtcttgtatgttccccgatggatgcgacgccgtggattgcaccttttgtagagagttcctgaagaacccccagtgctatcctgcgaaaaagtggctctttatcattatcgtcattctgcttggctacgccgggctgatgctcctgacaaatgtgctgaaagctatcggcgtttggggatcctgggtgattgccccggtcaagctcatgttcgctatcatcaagaaactgatgcggaccgtgagctgtcttgttggcaagctgatggacagagggcgccaggtgattcacgaagagatcggagagaacggcgaagggaatcaagatgacgtccggattgagatcgccagaccccgccgggtgagacattggatgtattctcctgtgattctcaccatcctggccattggacttgctgaaggctgcgatgagatggttcacgcggacagcaaactggtctcctgtcgccaggggagcggcaacatgaaggagtgcatcacaacgggacgggccctcctgcccgctgtgaatcctggccaggaagcctgtctgcattttaccgcccccgggtctccggattccaaatgcctcaagatcaaggtgaaaagaattaacctgaagtgtaaaaagagctcctcttacttcgtccctgacgctcgcagccggtgcacatccgtgagacgctgtcggtgggccggagattgccagtctggctgtccccctcactttaccagcaattccttctctgacgactgggcggggaaaatggatagagctggacttggctttagcgggtgctccgacggctgcggaggcgccgcctgtgggtgcttcaacgctgcccccagctgtatcttttggcggaagtgggttgagaatcctcacggaattatctggaaggtgtctccctgcgctgcctgggtcccgtccgcggtgattgaactgacaatgcctagcggcgaggttcgcaccttccatcccatgtctgggatccccacgcaagtgttcaaaggagtctccgtgacatatctcggcagcgatatggaagtttctggcctgaccgacctgtgtgagatcgaggaacttaagtccaaaaagctcgccctggctccttgcaaccaggccgggatgggagtggtcggcaaagtgggggagattcagtgtagctccgaagagagcgctagaaccatcaagaaagatggatgcatttggaacgccgacctggtgggcatcgaactccgggtcgatgacgcggtttgttactctaagattacaagcgtggaggccgtggctaattattccgccatcccgaccacaatcgggggactgagatttgagcgctctcacgatagccagggcaagatttccggctctccccttgacatcacggctattcgggggagcttctccgtcaactacagaggactgcgcctctctctgagcgaaatcaccgccacatgcaccggcgaggtgacaaatgtttccgggtgctacagctgtatgaccggagccaaagtgtctattaagctgcattccagcaaaaactctacggctcacgtcagatgcaagggcgatgaaaccgcgttttccgtgcttgagggggttcacagctatatcgtgtccctctctttcgaccatgccgtcgtggatgaacaatgtcagctgaattgcggaggccacgagagccaggttacactgaaaggcaacctcatctttctggacgtgcctaagttcgtcgacgggtcctacatgcagacctatcatagcacagtgcccaccggagctaatattccttctcccacggattggcttaacgccctgtttggcaatgggctctcccggtggatcctgggagtgattggcgtcctgcttgggggactcgccctgttctttctgatcatgttcctcctgaaacttggcacaaaacaagtttttcgcagcagaaccaagctggcttga

SEQ ID NO: 14849 - RNA, 3222 nt, synthetic construct
  misc_feature 1..3222: note = derived and/or modified CDS sequence (opt5) from SFTSV(SDTA_2)__KX641914.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatgtcgcctggatggacgtggggcactcccataagatcattatgcgcgagcacaaaaccaagtgggtgcaggaatctagctccaaggatttcgtctgctataaagagggaacaggcccgtgtagcgaatctgaggaaaaggcttgcaaaacctccgggagctgcagaggagacatgcagttttgtaaggttgccggctgcgagcacggcgaggaagcctctgaggccaaatgtcggtgctccctggtgcataagcctggggaagtggtcgtgagctacggaggcatgcgcgttagacccaaatgttacgggttctcccggatgatggcgacacttgaggtgaaccctcccgaacacatgatcggacagtgcaccggctgtcatctggagtgcattaatgggggcgtccgcctcatcacgctgacctctgagctgagaagcgccacagtgtgtgcttcccacttttgctctagcgcctccagcggaaagaagtctaccgaaattcacttccattccggcagcctcgttgggaaaacagctatccacgtgaagggagccctggtcgacggcaccgagttcacgtttgaagggtcttgtatgttccccgatggatgcgacgcggtggattgcacattttgtcgggagttccttaaaaaccctcaatgctatccggccaagaaatggctgtttatcattatcgtcattctcctgggctacgctgggcttatgctgctcaccaatgtgctgaaggccatcggcgtttggggatcctgggtgattgctcccgtcaagctgatgttcgccatcatcaaaaagctcatgcgcacagtgagctgtctggttggcaaacttatggacagagggagacaggtgattcatgaagagatcggagagaacggcgaagggaatcaggatgacgtcagaattgagatggcccgccctcggagagtgcgccactggatgtattctcccgtgatcctgaccattctcgctatcggactggcggaaggctgcgatgagatggttcatgccgacagcaagctggtctcctgtcggcaagggagcggcaacatgaaagagtgcattaccacaggacgggctctgctccctgccgtgaatcccggccaggaagcctgtctgcactttacggctccggggtctcctgattccaagtgcctgaagatcaaagtgaagcgcatcaacctcaaatgtaagaaaagctcctcttacttcgtccccgacgcccggagcagatgcacctccgtgcgccggtgtagatgggcgggagattgccagtctggctgccctccccactttacaagcaattccttctctgacgactgggctgggaagatggatcgcgccggactgggctttagcgggtgttccgacggctgcggaggcgccgcttgtgggtgcttcaacgccgctcctagctgtatcttttggcggaagtgggttgagaatccccatggaattatttggaaagtgtctccgtgcgccgcgtgggtcccttccgccgtgatcgaacttaccatgcccagcggcgaggttagaacattccaccccatgtctgggattcctacccaggtgttcaagggagtctccgtgacgtatctgggcagcgatatggaagtttctggcctcacagacctgtgtgagatcgaggaactgaaatccaagaaacttgctctcgccccgtgcaaccaagctgggatgggagtggtcggcaaggtgggggagatccagtgtagctccgaagagagcgcccggaccattaaaaaggatggatgcatctggaacgcggacctggtgggcattgaactgcgcgtcgatgacgccgtttgttactctaagatcaccagcgtggaggctgtggccaattattccgctattcccacaaccatcgggggactcagatttgagcggtctcatgatagccagggcaaaatctccggctctcctctggacattacagccatcagagggagcttctccgtcaactaccgcggacttcggctgtctctcagcgaaattacggctacctgcacaggcgaggtgaccaatgtttccgggtgctacagctgtatgacaggagctaaggtgtctatcaaactgcactccagcaagaactctaccgcgcacgtcagatgcaaaggcgatgaaacggccttttccgtgctggagggggttcatagctatattgtgtccctttctttcgaccacgctgtcgtggatgaacagtgtcaactcaattgcggaggccatgagagccaggttaccctgaagggcaacctgatctttctcgacgtgcccaagttcgtcgacgggtcctacatgcagacatatcacagcaccgtgcctacaggagccaatatcccctctcctaccgattggctgaacgccctttttggcaatgggctgtcccgctggattctcggagtgatcggcgtcctgcttgggggacttgctctcttctttctgattatgttcctgctcaaactgggcacgaagcaggtttttagaagccggacaaaacttgcctga

SEQ ID NO: 14850 - RNA, 3222 nt, synthetic construct
  misc_feature 1..3222: note = derived and/or modified CDS sequence (opt5) from SFTSV(SDTA_3)__KX641915.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatgtcgcctggatggacgtggggcactcccataagatcattatgcgcgagcacaaaaccaagtgggtgcaggaatctagctccaaggatttcgtctgctataaagagggaacaggcccgtgtagcgaatctgaggaaaaggcttgcaaaacctccgggagctgcagaggagacatgcagttttgtaaggttgccggctgcgagcacggcgaggaagcctctgaggccaaatgtcggtgctccctggtgcataagcctggggaagtggtcgtgagctacggaggcatgcgcgttagacccaaatgttacgggttctcccggatgatggcgacacttgaggtgaaccctcccgaacagcgcatcggacaatgcaccggctgtcacctggagtgcattaatgggggcgtcagactcatcacgctgacctctgagctgcggagcgccacagtgtgtgcttcccatttttgctctagcgcctccagcggaaagaagtctaccgaaattcacttccactccggcagcctcgttgggaaaacagctatccatgtgaagggagccctggtcgacggcaccgagttcacgtttgaagggtcttgtatgttccccgatggatgcgacgcggtggattgcacattttgtcgcgagttccttaaaaaccctcagtgctatccggccaagaaatggctgtttatcattatcgtcattctcctgggctacgctgggcttatgctgctcaccaatgtgctgaaggccatcggcgtttggggatcctgggtgattgctcccgtcaagctgatgttcgccatcatcaaaaagctcatgagaacagtgagctgtctggttggcaaacttatggaccgggggagacaggtgattcacgaagagatcggagagaacggcgaagggaatcaagatgacgtccgcattgaggtggcccggcctagacgcgtgcggcattggatgtattctcccgttatcctgaccattctcgctatcggactggcggaaggctgcgatgagatggtccacgccgacagcaagctggtgtcctgtagacaggggagcggcaacatgaaagagtgcattaccacaggacgcgctctgctccctgccgtgaatcccggccaggaagcctgtctgcattttacggctccggggtctcctgattccaagtgcctgaagatcaaagtcaagcggatcaacctcaaatgtaagaaaagctcctcttacttcgtgcccgacgccagaagccgctgcacctccgttcggagatgtcgctgggcgggagattgccagtctggctgccctccccactttacaagcaattccttctctgacgactgggctgggaagatggatcgggccggactgggctttagcgggtgttccgacggctgcggaggcgccgcttgtgggtgcttcaacgccgctcctagctgtatcttttggagaaagtgggtggagaatccccacggaattatttggaaagtctctccgtgcgccgcgtgggtgccttccgccgttatcgaacttaccatgcccagcggcgaggtgcggacattccatcccatgtctgggattcctacccaagtcttcaagggagtgtccgttacgtatctgggcagcgatatggaagtgtctggcctcacagacctgtgtgagatcgaggaactgaaatccaagaaacttgctctcgccccgtgcaaccaggctgggatgggagtcgtgggcaaggtgggggagatccagtgtagctccgaagagagcgcccgcaccattaaaaaggatggatgcatctggaacgcggacctggtcggcattgaactgagagttgatgacgccgtgtgttactctaagatcaccagcgtggaggctgtcgccaattattccgctattcccacaaccatcgggggactccggtttgagagatctcacgatagccagggcaaaatctccggctctcctctggacattacagccatccgcgggagcttctccgtgaactaccggggacttagactgtctctcagcgaaattacggctacctgcacaggcgaggttaccaatgtgtccgggtgctacagctgtatgacaggagctaaggtctctatcaaactgcattccagcaagaactctaccgcgcacgtgcgctgcaaaggcgatgaaacggccttttccgttctggagggggtgcacagctatattgtctccctttctttcgaccatgctgtggttgatgaacaatgtcagctcaattgcggaggccacgagagccaggtgaccctgaagggcaacctgatctttctcgacgtccccaagttcgtggacgggtcctacatgcagacatatcatagcaccgtgcctacaggagccaatatcccctctcctaccgattggctgaacgccctttttggcaatgggctgtccagatggattctcggagtcatcggcgttctgcttgggggacttgctctcttctttctgattatgttcctgctcaaactgggcacgaagcaagtgtttcggagccgcacaaaacttgcctga

SEQ ID NO: 14851 - RNA, 3222 nt, synthetic construct
  misc_feature 1..3222: note = derived and/or modified CDS sequence (opt5) from SFTSV(SDTA_4)__KX641916.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatgtcgcctggatggacgtggggcactcccataagatcattatgcgcgagcacaaaaccaagtgggtgcaggaatctagctccaaggatttcgtctgctataaagagggaacaggcccgtgtagcgaatctgaggaaaaggcttgcaaaacctccgggagctgcagaggagacatgcagttttgtaaggttgccggctgcgagcacggcgaggaagctagcgaggccaaatgtcggtgctccctggtgcataagcctggggaagtggtcgtgagctacggaggcatgcgcgttagacccaaatgttacgggttctcccggatgatggcgacacttgaggtgaaccctcccgaacagcgcatcggacaatgcaccggctgtcacctggagtgcattaatgggggcgtcagactcatcacgctgacctctgagctgcggagcgccacagtgtgtgcttcccatttttgctctagcgccacctccggaaagaagtctacagaaattcacttccactctggctccctcgttgggaaaaccgctatccatgtgaagggagccctggtcgacggcacggagttcacatttgaagggagctgtatcttccccgatggatgcgacgcggtggattgcaccttttgtcgcgagttccttaaaaaccctcagtgctatccggccaagaaatggctgtttattatcattgtcatcctcctgggctacgctgggcttatgctgctcacaaatgtgctgaaggccattggcgtttggggatcttgggtgatcgctcccgtcaagctgatcttcgccattatgaaaaagctcatgagaaccgtgtcctgtctggttggcaaacttatggaccgggggagacaggtgatccacgaagagattggagagaacggcgaagggaatcaagatgacgtccgcatcgagatggcccggcctagacgcgtgcggcattggatgtatagccccgtgattctgaccatcctcgctattggactggcggaaggctgcgatgagatggttcacgccgactctaaacttgtcagctgtagacaggggtccggcaacatgaaggagtgcatcacaacgggaggcgctctgctccctgccgtgaatcccgggcaggaagcctgtctgcattttaccgctccgggaagccctgattctaagtgcctgaagatcaaagtgaagcgcattaacctcaaatgtaagaaatccagctcctacttcgtccccgacgcccggtctagatgcacaagcgtgcgccggtgtagatgggcgggcgattgccagtccgggtgccctccccactttacctctaatagcttctccgacgactgggctggaaagatggatcgcgccggcctggggttttctggctgtagcgacggatgcggcggggccgcttgtggatgcttcaacgccgctccttcctgtatcttttggcggaagtgggttgagaatccccacggcattatctggaaagtgagcccgtgcgccgcgtgggtcccttctgccgtgattgaacttacaatgccctccggggaggttagaaccttccatcccatgagcggaatccctacgcaagtgttcaagggcgtctctgtgacatatctgggctccgatatggaagttagcgggctcaccgacctgtgtgagatcgaggaactgaaatctaagaaacttgctctcgccccgtgcaaccaggctggaatgggcgtggtcgggaaggtgggagagattcagtgttccagcgaagagtccgcccggaccatcaaaaaggatggctgcatttggaacgcggacctggtggggatcgaactgcgcgtcgatgacgccgtttgttacagcaagattacatctgtggaggctgtggccaattatagcgctatccccaccacaatcggaggcctcagatttgagcggtcccacgattctcagggcaaaattagcgggtcccctctggacatcacggccattagaggatctttcagcgtcaactaccgcggccttcggctgtccctctctgaaatcaccgccacatgcaccggggaggtgacaaatgttagcggatgctactcctgtatgaccggcgctaaggtgagcattaaactgcattcttccaagaacagcacggcgcacgtcagatgcaaaggggatgaaaccgccttttctgtgctggagggagttcactcctatatcgtgagcctttccttcgaccatgctgtcgtggatgaacaatgtcagctcaattgcggcggccacgagtctcaggttacactgaaggggaacctgatctttctcgacgtgcccaagttcgtcgacggaagctacatgcagacctatcattccacagtgcctaccggcgccaatattcccagccctacggattggctgaacgccctttttgggaatggactgtctcgctggatcctcggcgtgattggggtcctgctgggaggccttgctctcttctttctgatcatgttcctgctcaaactgggcacaaagcaagtttttagatcccggaccaaacttgcctga

SEQ ID NO: 14852 - RNA, 3222 nt, synthetic construct
  misc_feature 1..3222: note = derived and/or modified CDS sequence (opt5) from SFTSV(HBGS13_human_2015)__KY440773.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctaatcgggtgctctggatcggggacgttgcctgtcagccgatgacccccattcctgaagagacattcctggagcttaagtcctttagccagtctgagttccccgatatctgcaaaattgacggaatcgtgtttaaccagtgtgaaggcgaaagcctgcctcaacccttcgatgtcgcctggatggacgtggggcactcccataagatcattatgcgcgagcacaaaaccaagtgggtgcaggagtctagctccaaggattttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaatcagcctgagcaacgcatcggacagtgcacgggctgtcaccttgaatgcattaacgggggcgtcagactgatcaccctcacatctgagctgaagtctgcgaccgtgtgtgcctcccatttctgctctagcgctacatccggaaagaaaagcaccgagattcagttccactctggctccctggttgggaagacggccatccacgtgaaaggagctctcgtcgacggcacagaatttaccttcgaggggagctgtatgtttcccgatggatgcgacgccgtggattgcacattctgtcgggaatttctgaagaatccccaatgctatcctgcgaaaaagtggcttttcatcattatcgtcattctgctcggctacgccgggctgatgcttctgaccaacgtgctcaaggctatcggcatttggggatcttgggttatcgccccggtgaaactgatctttgctattatcaagaaactgatgcgcaccgtctcctgtctcatgggcaagctgatggacagagggagacaggtgattcatgaggaaatcggagagaatcgggagggcaaccaggatgacgttcgcattgaaatggcccggcccagacgcgtgcggcactggatgtatagccctgtcatccttacaattctggccatcgggatcgctgagtcttgcgatgaaatggtgcatgcggacagcaaactcgtgtcctgtagacagggaagcggcaatatgaaggagtgcgttacgaccgggcgcgccctgcttcccgctgtcaaccctggccaagaggcctgtctgcacttcacagcccccggatctccggattccaagtgcctccggattaaagtgaagagaatcaatctgaaatgtaagaaaagctcctcttactttgtgcctgacgctcgcagccggtgcacctccgtcagacgctgtcggtgggccggcgattgccagtctgggtgtccccctcatttcacaagcaactccttttctgacgactgggcgggaaagatggatagagctggcctggggttcagcggatgctccgacggctgcgggggcgccgcctgtggatgctttaatgctgcccccagctgtattttctggcggaagtgggtggaaaaccctcacggcatcatttggaaagtttctccctgcgctgcctgggtgccgtccgcggtcatcgagctcaccatgcctagcggggaagtgcgcacgttccaccccatgtctggaatccccacacaggtttttaagggcgtgtccgtcacctatctggggagcgatatggaggtgtctggacttaccgacctgtgtgaaattgaggagctcaaatccaagaaactggccctggctccttgcaaccaggccggcatgggcgttgtggggaaggtcggagaaatccaatgtagctccgaggaaagcgctagaacaattaaaaaggatggctgcatctggaatgccgaccttgtggggattgagctccgggtggatgacgcggtctgttactctaagatcaccagcgttgaagccgtggctaactattccgccatcccgacaacgattggaggcctgagattcgagcgctctcatgatagccaggggaaaatctccggatctcccctggacattaccgctatccggggcagcttttccgtgaattacagaggcctccgcctgtctcttagcgagattacagctacctgcacaggggaagtcaccaacgtgtccggatgctacagctgtatgacgggcgccaaggtttctatcaaactgcactccagcaagaatagcaccgcccatgtgagatgcaaaggggatgagacagcgttctccgtcctcgaaggagtgcacagctataccgtttccctgtcttttgaccacgccgtggtcgatgagcagtgtcagctgaactgcggcgggcatgaaagccaagtgacacttaagggaaatctcatcttcctggacgttcctaagtttgtggacggctcctacatgcagacctatcacagcacggtccccacaggcgctaacattccttctcccaccgattggctgaatgccctcttcgggaacggactgtcccggtggatccttggcgtgatgggggtgctgctcggaggcctggccctgtttattatcattatgagccttttcaaactcgggacaaagcaggtctttcgctctagaaccaaactggcttga

SEQ ID NO: 14853 - RNA, 3222 nt, synthetic construct
  misc_feature 1..3222: note = derived and/or modified CDS sequence (opt5) from SFTSV(HBMC16_human_2015)__KY440776.1__GP
  source 1..3222: mol_type = other RNA
atgatgaaggtgatctggttcagctccctggtctgcctcgttattcagtgttctggcgacagcgggcccatcatttgcgccggacctatccactccaacaaatctgctggcattccgcatctgcttgggtacagcgagaagatctgtcaaatcgatagactgattcacgtgtcctcttggctccggaatcatagccagtttcagggatatgtgggccagcgcgggggaagatcccaagtcagctactatcccgccgaaaactcttactcccggtggagcggcctgctttctccttgcgacgcggattggctgggcatgctcgtggttaaaaaggctaaagggtccgacatgatcgtgcccggacctagctataagggcaaggtcttctttgagcgccccaccttcgatgggtacgtgggatggggctgtgggtctggaaaatccagaacagaaagcggcgagctgtgctcctctgacagcggcacgtccagcgggctgctcccttctgatcgggttctgtggattggagacgtggcctgtcagccgatgacccccatccctgaagagacatttcttgagctgaagtccttcagccagtctgaatttcccgatatttgcaaaatcgacggcattgtcttcaatcagtgtgagggggaaagcctccctcaaccctttgatgtggcctggatggacgtgggacactcccataagatcatcatgcgcgagcacaaaaccaagtgggtccaggagtctagctccaaggatttcgtttgctataaagaaggcacagggccgtgtagcgagtctgaagagaaggcttgcaaaacctccggaagctgcagaggcgacatgcagttttgtaaggtggccggctgcgaacacggggaggaggcttctgaagccaaatgtcggtgctccctggtgcataagcctggagaggtcgtggttagctacggcgggatgcgcgtgagacccaaatgttacggattctcccggatgatggcgacaatggaagtcaaccctcccgagcagcgcattggccaatgcaccgggtgtcaccttgaatgcatcaatggcggagtgagactgattacgctcacctctgagctcaagagcgccacagtttgtgcttcccatttttgctctagcgccacctccggcaagaaaagcacagagatccacttccactctgggtccctggtgggaaaggctgccattcatgtcaaaggcgcgctggtggacgggaccgaatttacgtttgagggaagctgtatgttccccgatggctgcaacgccgtcgactgcacattttgtcgggagttcctgaagaatcctcagtgctatccggctaaaaagtggctttttatcatcattgtgatcctgctcgggtacgccggcctgatgcttctgaccaacgttctcaaggctattggagtgtggggctcttgggtcatcgcccccgtgaaactgatgttcgccattatgaagaaactgatgcgcacagtttcctgtctcgtggggaagctgatggatagaggacggcaggtcatccacgaagaaatcggcgagaatggggagggaaaccaagacgatgtgagaattgaaatggctcgccctcggagagtgcgccattggatgtatagccccgttatccttaccattctggcgatcggcctcgccgaggggtgcgacgaaatggtccacgctgattctaaactggtgagctgtcggcagggctccggaaatatgaaggagtgcgtgaccacaggcagagcccttctgcctgccgtcaaccccgggcaggaggcttgtctccattttacggccccgggaagccctgactctaagtgcctgaaaattaaggtgaaacgcatcaatctgaagtgtaaaaagtccagctcctacttcgttcccgatgcgcggtctagatgcaccagcgtgcgccggtgtagatgggctggcgactgccagtccgggtgccctccccactttacatctaacagcttctccgatgactgggccggaaagatggaccgcgccggcctcgggttttctggctgtagcgatggatgcggcggggctgcctgtggatgcttcaatgctgccccttcctgtattttctggcggaaatgggtcgaaaacccccacggcatcatctggaaggtgagcccgtgcgcggcctgggttccttctgctgtgattgagctgaccatgccctccggggaagtcagaacattccatcccatgagcggaatccctacccaagtgttcaaaggcgtttctgtgacgtatcttggctccgacatggaggtcagcgggctgacagatctctgtgaaattgaggagctgaagtctaaaaagctggcccttgctccgtgcaaccaggccggaatgggcgtggtggggaaagtcggagaaatccagtgttccagcgaggaatccgcgcggaccattaagaaggacggctgcatctggaatgccgatctcgttgggatcgagctgcgcgtggacgatgctgtgtgttacagcaaaattacctctgtcgaagccgtggctaactatagcgccatccccacaaccattggaggcctgagatttgagcggtcccacgactctcagggcaagatcagcgggtcccctctcgatattacagccatcagaggatctttcagcgttaattaccgcggcctgcggctttccctgtctgagatcacggctacctgcacaggggaagtgaccaacgtcagcggatgctactcctgtatgacaggcgcgaaagtgagcattaagctccattcttccaaaaatagcaccgcccacgttagatgcaagggggacgagacggctttttctgtgctggaaggagtccactcctataccgtgagcctgtccttcgatcatgccgttgtggacgagcaatgtcagcttaactgcggcggccacgaatctcaggtcacactcaaggggaatctgatctttctggatgtgcccaaattcgtggacggaagctacatgcagacctatcattccacagtccctaccggcgccaacattcccagccctacggactggctcaatgctctgtttgggaacggactttctcgctggatcctgggcgttattggggtgctcctgggaggcctggcccttttctttctcatcatgttcctgtttaagctgggcacaaaacaagtgttcagatcccggaccaagctcgcgtga

SEQ ID NO: 14854 - RNA, 3222 nt, synthetic construct
  misc_feature 1..3222: note = derived and/or modified CDS sequence (opt5) from SFTSV(HBMC5_human_2016)__KY440770.1__GP
  source 1..3222: mol_type = other RNA
atgatgaaggtgatctggttcagctccctggtctgcctcgttattcagtgttctggcgacagcgggcccatcatttgcgccggacctatccactccaacaaatctgctggcattccgcatctgcttgggtacagcgagaagatctgtcaaatcgatagactgattcacgtgtcctcttggctccggaatcatagccagtttcagggatatgtgggccagcgcgggggaagatcccaagtcagctactatcccgccgaaaactcttactcccggtggagcggcctgctttctccttgcgacgcggattggctgggcatgctcgtggttaaaaaggctaaagggtccgacatgatcgtgcccggacctagctataagggcaaggtcctgttcgagcgccccacctttgatgggtacgtgggatggggctgtgggtctggaaaatccagaacagaaagcggcgagctgtgctcctctgacagcggcacgtccagcgggctcctgccttctgatcgggttctttggattggagacgtggcctgtcagccgatgacccccatccctgaagagacattcctggagctcaagtcctttagccagtctgagttccccgatatttgcaaaatcgacggcattgtctttaatcagtgtgaaggggaaagcctgcctcaacccttcgatgtggcctggatggacgtgggacactcccataagatcatcatgcgcgagcacaaaaccaagtgggtccaggagtctagctccaaggattttgtttgctataaagaaggcacagggccgtgtagcgagtctgaagagaaggcttgcaaaacctccggaagctgcagaggcgacatgcagttctgtaaggtggccggctgcgaacacggggaggaggcttctgaagccaaatgtcggtgctcccttgtgcataagcctggagaggtcgtggttagctacggcgggatgcgcgtgagacccaaatgttacggattttcccggatgatggcgacaatggaagtcaaccctcccgagcagcgcattggccaatgcaccgggtgtcacctggaatgcatcaatggcggagtgagactcattacgctgacctctgagcttaagagcgccacagtttgtgcttcccatttctgctctagcgccacctccggcaagaaaagcacagagatccactttcactctgggtccctcgtgggaaaggctgccattcatgtcaaaggcgcgctggtggacgggaccgagttcacgttcgaaggaagctgtatgtttcccgatggctgcaacgccgtcgactgcacattctgtcgggaatttcttaagaatcctcagtgctatccggctaaaaagtggctgttcatcatcattgtgatcctcctggggtacgccggccttatgctgctcaccaacgttctgaaggctattggagtgtggggctcttgggtcatcgcccccgtgaaactgatgtttgccattatgaagaaactcatgcgcacagtttcctgtctggtggggaagctgatggatagaggacggcaggtcatccacgaggaaatcggcgagaatggggagggaaaccaagacgatgtgagaattgaaatggctcgccctcggagagtgcgccattggatgtatagccccgttatcctgaccattctcgcgatcggcctggccgaggggtgcgacgaaatggtccacgctgattctaaacttgtgagctgtcggcagggctccggaaatatgaaggagtgcgtgaccacaggcagagccctgctccctgccgtcaaccccgggcaggaggcttgtctgcatttcacggccccgggaagccctgactctaagtgcctgaaaattaaggtgaaacgcatcaatctcaagtgtaaaaagtccagctcctactttgttcccgatgcgcggtctagatgcaccagcgtgcgccggtgtagatgggctggcgactgccagtccgggtgccctccccacttcacatctaacagcttttccgatgactgggccggaaagatggaccgcgccggcctggggttctctggctgtagcgatggatgcggcggggctgcctgtggatgctttaatgctgccccttcctgtattttctggcggaaatgggtcgaaaacccccacggcatcatctggaaggtgagcccgtgcgcggcctgggttccttctgctgtgattgagcttaccatgccctccggggaagtcagaacatttcatcccatgagcggaatccctacccaagtgttcaaaggcgtttctgtgacgtatctgggctccgacatggaggtcagcgggctcacagatctgtgtgaaattgaggagctgaagtctaaaaagctcgcccttgctccgtgcaaccaggccggaatgggcgtggtggggaaagtcggagaaatccagtgttccagcgaggaatccgcgcggaccattaagaaggacggctgcatctggaatgccgatctggttgggatcgagctgcgcgtggacgatgctgtgtgttacagcaaaattacctctgtcgaagccgtggctaactatagcgccatccccacaaccattggaggcctcagattcgagcggtcccacgactctcagggcaagatcagcgggtcccctctggatattacagccatcagaggatcttttagcgttaattaccgcggccttcggctgtccctctctgagatcacggctacctgcacaggggaagtgaccaacgtcagcggatgctactcctgtatgacaggcgcgaaagtgagcattaagctgcattcttccaaaaatagcaccgcccacgttagatgcaagggggacgagacggctttctctgtgctggaaggagtccactcctataccgtgagcctttcctttgatcatgccgttgtggacgagcaatgtcagctcaactgcggcggccacgaatctcaggtcacactgaaggggaatctgatcttcctcgatgtgcccaaatttgtggacggaagctacatgcagacctatcattccacagtccctaccggcgccaacattcccagccctacggactggctgaatgctcttttcgggaacggactgtctcgctggatcctcggcgttattggggtgctgctgggaggccttgccctctttttcctgatcatgtttctgttcaagctcggcacaaaacaagtgtttagatcccggaccaagctggcgtga

SEQ ID NO: 14855 - RNA, 3222 nt, synthetic construct
  misc_feature 1..3222: note = derived and/or modified CDS sequence (opt5) from SFTSV(HB29)__KP202164.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatgtcgcctggatggacgtggggcactcccataagatcattatgcgcgagcacaaaaccaagtgggtgcaggaatctagctccaaggatttcgtctgctataaagagggaacaggcccgtgtagcgaatctgaggaaaaggcttgcaaaacctccgggagctgcagaggagacatgcagttttgtaaggttgccggctgcgagcacggcgaggaagcctctgaggccaaatgtcggtgctccctggtgcataagcctggggaagtggtcgtgagctacggaggcatgcgcgttagacccaaatgttacgggttctcccggatgatggcgacacttgaggtgaaccctcccgaacagcgcatcggacaatgcaccggctgtcacctggagtgcattaatgggggcgtcagactcatcacgctgacctctgagctgcggagcgccacagtgtgtgcttcccatttttgctctagcgcctccagcggaaagaagtctaccgaaattcacttccactccggcagcctcgttgggaaaacagctatccatgtgaagggagccctggtcgacggcaccgagttcacgtttgaagggtcttgtatgttccccgatggatgcgacgcggtggattgcacattttgtcgcgagttccttaaaaaccctcagtgctatccggccaagaaatggctgtttatcattatcgtcattcacctcggctacgctgggctgatgcttctgaccaatgtgctcaaggccatcggcgtttggggatcctgggtgattgctcccgtcaagctgatgttcgccatcatcaaaaagctgatgagaacagtgagctgtctcgttggcaaactgatggaccgggggagacaggtgattcatgaagagatcggagagaacggcgaagggaatcaagatgacgtccgcattgagatggcccggcctagacgcgtgcggcactggatgtattctcccgtgatccttaccattctggctatcggactcgcggaaggctgcgatgagatggttcatgccgacagcaagctggtctcctgtagacaggggagcggcaacatgaaagagtgcattaccacaggacgcgctctgctgcctgccgtgaatcccggccaggaagcctgtctccactttacggctccggggtctcctgattccaagtgcctgaagatcaaagtgaagcggatcaacctgaaatgtaagaaaagctcctcttacttcgtccccgacgccagaagccgctgcacctccgtgcggagatgtcgctgggcgggagattgccagtctggctgccctccccactttacaagcaattccttctctgacgactgggctgggaagatggatcgggccggactcggctttagcgggtgttccgacggctgcggaggcgccgcttgtgggtgcttcaacgccgctcctagctgtatcttttggagaaagtgggttgagaatccccatggaattatttggaaagtgtctccgtgcgccgcgtgggtcccttccgccgtgatcgaactgaccatgcccagcggcgaggttcggacattccaccccatgtctgggattcctacccaagtgttcaagggagtctccgtgacgtatcttggcagcgatatggaagtttctggcctgacagacctctgtgagatcgaggaactgaaatccaagaaactggctcttgccccgtgcaaccaggctgggatgggagtggtcggcaaggtgggggagatccagtgtagctccgaagagagcgcccgcaccattaaaaaggatggatgcatctggaacgcggacctcgtgggcattgaactgagagtcgatgacgccgtttgttactctaagatcaccagcgtggaggctgtggccaattattccgctattcccacaaccatcgggggactgcggtttgagagatctcatgatagccagggcaaaatctccggctctcctctcgacattacagccatccgcgggagcttctccgtcaactaccggggactgagactttctctgagcgaaattacggctacctgcacaggcgaggtgaccaatgtttccgggtgctacagctgtatgacaggagctaaggtgtctatcaaactccactccagcaagaacaataccgcgcacgtccgctgcaaaggcgatgaaacggccttttctgtgctggagggggttcattcctatattgtgagcctgtccttcgaccacgctgtcgtggatgaacaatgtcagcttaactgcggaggccatgagtctcaggttaccctcaagggcaatctgatctttctggacgtgcccaagttcgtcgacgggagctacatgcagacatatcactccaccgtgcctacaggagccaacatccccagccctaccgattggctcaatgccctgtttggcaacgggctttctagatggattctgggagtgatcggcgtcctccttgggggactggctcttttctttctcattatgttcctgctgaaactcggcacgaagcaagtttttcggtcccgcacaaaactggcctga

SEQ ID NO: 14856 - RNA, 3222 nt, synthetic construct
  misc_feature 1..3222: note = derived and/or modified CDS sequence (opt5) from SFTSV(HNXY_115)__KC292312.1__GP
  source 1..3222: mol_type = other RNA
atgatgaaggtgatctggttcagctccctgatttactttgtcatccagtgctctggcgacagcgggtccattatctgtgccggacccattcactctaacaaaagcgctgatatccctcatctcctgggctattccgagaagatctgccaaattgacagacttatccacgtttctagctggctgcggaatcattcccagttccaggggtacgtgggacagcgcggcgggagaagccaagtgtcttattacccggccgaaaactcctatagccggtggtctggactcctgtccccctgtgatgcggactggcttggcatgctggtcgtgaaaaaggctaaaggcagcgatatgattgttcctgggccctcttacaagggaaaggtgtttttcgagcgccctacctttgacggctatgtcgggtggggatgcggctccgggaaaagcagaacagaatccggagagctctgttctagcgattccggcacgagctctggcctgctgccctccgaccgggtgctctggatcggggatgttgcctgccagcctatgaccccgattcccgaagagacattcctggagcttaagagcttttctcagagcgagttccctgacatctgtaaaattgatggaatcgtgtttaatcagtgcgaaggcgaatccctgccccaacctttcgacgtcgcctggatggatgtggggcactctcataagatcattatgcgcgagcacaaaaccaagtgggtgcaggagagctccagcaaggactttgtctgttacaaagaaggaacaggcccctgctctgagtccgaagagaagacctgtaaaacaagcgggtcttgcagaggagacatgcagttctgcaaggttgctggctgtgaacacggcgaggaggcctccgaagctaaatgccggtgtagcctcgtgcataagccgggggaggtggtcgtgtcctacggaggcatgcgcgttagacctaaatgctatgggttttctcggatgatggccaccctggaagtgaaccagcccgagcaacgcatcggacagtgtacgggctgccaccttgaatgtattaatgggggcgtcagactgatcaccctcacaagcgagctgaagtccgcgaccgtgtgcgcctctcatttctgtagctccgctacaagcggaaagaaatctaccgagattcagttccactccggcagcctggttgggaagacggccatccacgtgaaaggagctctcgtcgatggcacagaatttaccttcgaggggtcttgcatgtttcctgacggatgtgatgccgtggactgcacattctgccgggaatttctgaagaacccccaatgttaccccgcgaaaaagtggcttttcatcattatcgtcattctgctcggctatgccgggctgatgcttctgaccaatgtgctcaaggctatcggcatttggggatcctgggttatcgcccctgtgaaactgatctttgctattatcaagaaactgatgcgcaccgtcagctgcctcatgggcaagctgatggatagagggagacaggtgattcatgaggaaatcggagagaaccgggagggcaatcaggacgatgttcgcattgaaatggcccggccgagacgcgtgcggcactggatgtactctcccgtcatccttacaattctggccatcgggctcgctgagagctgtgacgaaatggtgcatgcggattccaaactggtgagctgcagacagggatctggcaacatgaaggagtgtgttacgaccgggcgcgcccttctgcctgctgtcaatcccggccaagaggcctgcctccacttcacagcccctggatcccccgacagcaagtgtctgaaaatcaaggtgaaacggattaacctgaagtgcaaaaagtcctctagctattttgtgccggatgctagatcccgctgtacctctgtccggagatgccgctgggccggcgactgtcagagcgggtgccctccccatttcacatccaattcttttagcgacgattgggcgggaaagatggaccgggctggcctcgggttctccggatgcagcgatggctgtgggggcgccgcctgcggatgttttaacgctgccccttcttgcatcttctggagaaaatgggtggaaaatccccacggcattatctggaaggtttccccttgtgctgcctgggtgcccagcgcggtcattgagctgaccatgccgtctggggaagtgcggacgttccaccctatgtccggaatccccacacaggtttttaaaggcgtgagcgtcacctaccttgggtctgacatggaggtgtccggactgaccgatctctgcgaaatcgaggagcttaagagcaaaaagctggcccttgctccctgtaaccaggccggcatgggcgttgtggggaaagtcggagaaattcaatgctccagcgaggaatctgctcgcacaatcaagaaggacggctgtatttggaacgccgatctcgtggggatcgagctgagagtggacgatgcggtctgctatagcaaaattacctccgttgaagccgtggctaattactctgccatccctacaacgatcggaggcctgcggttcgagagaagccatgactcccaggggaagatttctggaagcccgctcgatatcaccgctattcgcggctccttttctgtgaactaccggggcctgagacttagcctgtccgagatcacagccacctgtacaggggaagtcaccaatgtgagcggatgctattcttgcatgacgggcgccaaagtttccattaagctccacagctctaaaaactccaccgctcatgtgcgctgtaagggggacgagacagcgttcagcgtcctggaaggagtgcactcctacaccgtttctctgagctttgatcacgccgtggtcgacgagcagtgccagcttaattgtggcgggcatgaatcccaagtgacactcaagggaaacctgatcttcctggacgttcccaaatttgtggatggcagctatatgcagacctaccactctacggtccctacaggcgctaatatcccctcccctaccgactggctcaacgccctgttcgggaatggacttagcagatggattctgggcgtgatcggggtgctcctgggaggcctggccctgtttttcatgattatgtctctctttaagctggggacaaaacaggtcttccggagccgcaccaagctggcttga

SEQ ID NO: 14857 - RNA, 3222 nt, synthetic construct
  misc_feature 1..3222: note = derived and/or modified CDS sequence (opt5) from SFTSV(HNXY_144)__KC292307.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgcgcaccgtctcctgtctcatgggcaagctgatggatagagggagacaggtgattcatgaggaaatcggagagaaccgggagggcaatcaggacgatgttcgcattgaaatggcccggcccagacgcgtgcggcactggatgtatagccctgtcatccttacaattctggccatcgggctcgctgagtcttgcgacgaaatggtgcatgcggatagcaaactggtgtcctgtagacagggaagcggcaacatgaaggagtgcgttacgaccgggcgcgcccttctgcccgctgtcaatcctggccaagaggcctgtctccacttcacagcccccggatctccggactccaagtgcctgaaaatcaaggtgaaacggattaacctgaagtgtaaaaagagctcctcttactttgtgcctgatgctagaagccgctgcacctccgtccggagatgtcgctgggccggcgactgccagtctgggtgtccccctcatttcacaagcaattccttttctgacgattgggcgggaaagatggaccgggctggcctcgggttcagcggatgctccgatggctgcgggggcgccgcctgtggatgctttaacgctgcccccagctgtatcttctggagaaaatgggtggaaaatcctcacggcattatctggaaggtttctccctgcgctgcctgggtgccgtccgcggtcattgagctgaccatgcctagcggggaagtgcggacgttccaccccatgtctggaatccccacacaggtttttaaaggcgtgtccgtcacctatcttgggagcgacatggaggtgtctggactgaccgatctctgtgaaatcgaggagctgaagtccaaaaagctggcccttgctccttgcaaccaggccggcatgggcgttgtggggaaagtcggagaaattcaatgtagctccgaggaaagcgctcgcacaatcaagaaggacggctgcatttggaacgccgatctcgtggggatcgagctgagagtggacgatgcggtctgttactctaaaattaccagcgttgaagccgtggctaattattccgccatcccgacaacgatcggaggcctgcggttcgagagatctcatgacagccaggggaagatttccggatctcccctcgatatcaccgctattcgcggcagcttttccgtgaactaccggggcctgagactttctctgagcgagatcacagctacctgcacaggggaagtcaccaatgtgtccggatgctacagctgtatgacgggcgccaaagtttctattaagctccactccagcaaaaactctaccgcccatgtgcgctgcaagggggacgagacagcgttctccgtcctggaaggagtgcacagctataccgtttccctgtcttttgatcacgccgtggtcgacgagcagtgtcagcttaattgcggcgggcatgaaagccaagtgacactcaagggaaacctgatcttcctggacgttcctaaatttgtggatggctcctacatgcagacctatcacagcacggtccccacaggcgctaatatcccttctcccaccgactggctcaacgccctgttcgggaatggactttccagatggattctgggcgtgatgggggtgctcctgggaggcctggccctgtttttcatgatcatgagcctctttaagctggggacaaaacaggtcttccggtctcgcaccaagctggcttga

SEQ ID NO: 14858 - RNA, 3222 nt, synthetic construct
  misc_feature 1..3222: note = derived and/or modified CDS sequence (opt5) from SFTSV(HNXY_157)__KC292305.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctaatcgggtgctctggatcggggacgttgcctgtcagccgatgacccccattcctgaagagacattcctggagcttaagtcctttagccagtctgaatttcccgatatctgcaaaattgacggaatcgtgtttaaccagtgtgagggcgaaagcctgcctcaacccttcgatgtcgcctggatggacgtggggcactcccataagatcattatgcgcgagcacaaaaccaagtgggtgcaggagtctagctccaaggattttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaatcagcctgagcaacgcatcggacagtgcacgggctgtcaccttgaatgcattaacgggggcgtcagactgatcaccctcacatctgagctgaagtctgcgaccgtgtgtgcctcccatttctgctctagcgctacatccggaaagaaaagcaccgagattcagttccactctggctccctggttgggaagacggccatccacgtgaaaggagctctcgtcgacggcacagaatttaccttcgaggggagctgtatgtttcccgatggatgcgacgccgtggattgcacattctgtcgggaatttctgaagaatccccaatgctatcctgcgaaaaagtggcttttcatcattatcgtcattctgctcggctacgccgggctgatgcttctgaccaacgtgctcaaggctatcggcatttggggatcttgggttatcgccccggtgaaactgatctttgctattatcaagaaactgatgcgcaccgtctcctgtctcatgggcaagctgatggacagagggagacaggtgattcatgaggaaatcggagagaatcgggagggcaaccaggatgacgttcgcattgaaatggcccggcccagacgcgtgcggcactggatgtatagccctgtcatccttacaattctggccatcgggctcgctgagtcttgcgatgaaatggtgcatgcggacagcaaactggtgtcctgtagacagggaagcggcaatatgaaggagtgcgttacgaccgggcgcgcccttctgcccgctgtcaaccctggccaagaggcctgtctccacttcacagcccccggatctccggattccaagtgcctgcggatcaaagtgaagagaattaatctgaaatgtaagaaaagctcctcttactttgtgcctgacgctcgcagccggtgcacctccgtcagacgctgtcggtgggccggcgattgccagtctgggtgtccccctcatttcacaagcaactccttttctgacgactgggcgggaaagatggatagagctggcctcgggttcagcggatgctccgacggctgcgggggcgccgcctgtggatgctttaatgctgcccccagctgtatcttctggcggaagtgggtggaaaaccctcacggcattatctggaaagtttctccctgcgctgcctgggtgccgtccgcggtcattgagctgaccatgcctagcggggaagtgcgcacgttccaccccatgtctggaatccccacacaggtttttaagggcgtgtccgtcacctatcttgggagcgatatggaggtgtctggactgaccgacctctgtgaaatcgaggagctgaaatccaagaaactggcccttgctccttgcaaccaggccggcatgggcgttgtggggaaggtcggagaaattcaatgtagctccgaggaaagcgctagaacaatcaaaaaggatggctgcatttggaatgccgacctcgtggggatcgagctgcgggtggatgacgcggtctgttactctaagattaccagcgttgaagccgtggctaactattccgccatcccgacaacgatcggaggcctgagattcgagcgctctcatgatagccaggggaaaatttccggatctcccctcgacatcaccgctattcggggcagcttttccgtgaattacagaggcctgcgcctttctctgagcgagatcacagctacctgcacaggggaagtcaccaacgtgtccggatgctacagctgtatgacgggcgccaaggtttctattaaactccactccagcaagaatagcaccgcccatgtgagatgcaaaggggatgagacagcgttctccgtcctggaaggagtgcacagctataccgtttccctgtcttttgaccacgccgtggtcgatgagcagtgtcagcttaactgcggcgggcatgaaagccaagtgacactcaagggaaatctgatcttcctggacgttcctaagtttgtggacggctcctacatgcagacctatcacagcacggtccccacaggcgctaacatcccttctcccaccgattggctcaatgccctgttcgggaacggactttcccggtgggtgctgggcgtgatgggggtcctcctgggaggcctggcccttttcttcatgattatgagcctctttaaactggggacaaagcaggttttccgctctagaaccaaactggcttga

SEQ ID NO: 14859 - RNA, 3222 nt, synthetic construct
  misc_feature 1..3222: note = derived and/or modified CDS sequence (opt5) from SFTSV(HNXY_170)__KC292304.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctaatcgggtgctctggatcggggacgttgcctgtcagccgatgacccccattcctgaagagacattcctggagcttaagtcctttagccagtctgaatttcccgatatctgcaaaattgacggaatcgtgtttaaccagtgtgagggcgaaagcctgcctcaacccttcgatgtcgcctggatggacgtggggcactcccataagatcattatgcgcgagcacaaaaccaagtgggtgcaggagtctagctccaaggattttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaatcagcctgagcaacgcatcggacagtgcacgggctgtcaccttgaatgcattaacgggggcgtcagactgatcaccctcacatctgagctgaagtctgcgaccgtgtgtgcctcccatttctgctctagcgctacatccggaaagaaaagcaccgagattcagttccactctggctccctggttgggaagacggccatccacgtgaaaggagctctcgtcgacggcacagaatttaccttcgaggggagctgtatgtttcccgatggatgcgacgccgtggattgcacattctgtcgggaatttctgaagaatccccaatgctatcctgcgaaaaagtggcttttcatcattatcgtcattctgctcggctacgccgggctgatgcttctgaccaacgtgctcaaggctatcggcatttggggatcttgggttatcgccccggtgaaactgatctttgctattatcaagaaactgatgcgcaccgtctcctgtctcatgggcaagctgatggacagagggagacaggtgattcatgaggaaatcggagagaatcgggagggcaaccaggatgacgttcgcattgaaatggcccggcccagacgcgtgcggcactggatgtatagccctgtcatccttacaattctggccatcgggctcgctgagtcttgcgatgaaatggtgcatgcggacagcaaactggtgtcctgtagacagggaagcggcaatatgaaggagtgcgttacgaccgggcgcgcccttctgcccgctgtcaaccctggccaagaggcctgtctccacttcacagcccccggatctccggattccaagtgcctgcggatcaaagtgaagagaattaatctgaaatgtaagaaaagctcctcttactttgtgcctgacgctcgcagccggtgcacctccgtcagacgctgtcggtgggccggcgattgccagtctgggtgtccccctcatttcacaagcaactccttttctgacgactgggcgggaaagatggatagagctggcctcgggttcagcggatgctccgacggctgcgggggcgccgcctgtggatgctttaatgctgcccccagctgtatcttctggcggaagtgggtggaaaaccctcacggcattatctggaaagtttctccctgcgctgcctgggtgccgtccgcggtcattgagctgaccatgcctagcggggaagtgcgcacgttccaccccatgtctggaatccccacacaggtttttaagggcgtgtccgtcacctatcttgggagcgatatggaggtgtctggactgaccgacctctgtgaaatcgaggagctgaaatccaagaaactggcccttgctccttgcaaccaggccggcatgggcgttgtggggaaggtcggagaaattcaatgtagctccgaggaaagcgctagaacaatcaaaaaggatggctgcatttggaatgccgacctcgtggggatcgagctgcgggtggatgacgcggtctgttactctaagattaccagcgttgaagccgtggctaactattccgccatcccgacaacgatcggaggcctgagattcgagcgctctcatgatagccaggggaaaatttccggatctcccctcgacatcaccgctattcggggcagcttttccgtgaattacagaggcctgcgcctttctctgagcgagatcacagctacctgcacaggggaagtcaccaacgtgtccggatgctacagctgtatgacgggcgccaaggtttctattaaactccactccagcaagaatagcaccgcccatgtgagatgcaaaggggatgagacagcgttctccgtcctggaaggagtgcacagctataccgtttccctgtcttttgaccacgccgtggtcgatgagcagtgtcagcttaactgcggcgggcatgaaagccaaatcacactcaagggaaatctgatcttcctggacgtgcctaagtttgttgacggctcctacatgcagacctatcacagcacggtgcccacaggcgctaacattccttctcccaccgattggctcaatgccctgttcgggaacggactttcccggtgggtcctgggcgtgatcggggtgctcctgggaggcctggcccttttcttcatgattatgagcctctttaaactggggacaaagcaggtcttccgctctagaaccaaactggcttga

SEQ ID NO: 14860 - RNA, 3222 nt, synthetic construct
  misc_feature 1..3222: note = derived and/or modified CDS sequence (opt5) from SFTSV(HNXY_174)__KC292306.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgccgcattgatggaatcgtgtttaatcagtgtgaaggcgaaagcctgcctcaacccttcgacgtcgcctggatggatgtggggcactcccataaaatcattatgagagagcacaagaccaaatgggtgcaggagtctagctccaaggactttgtctgctataaggaaggaacaggcccgtgtagcgagtctgaagagaaaacctgcaagacatccgggagctgccggggagacatgcagttctgtaaagttgctggctgcgaacacggcgaggaggcctctgaagctaagtgtcgctgctccctcgtgcataaacctggggaggtggtcgtgagctacggaggcatgagagttcggcccaagtgttacgggttttcccgcatgatggccaccctggaagtgaaccagcctgagcaaagaatcggacagtgcacgggctgtcaccttgaatgcattaatgggggcgtccggctgatcaccctcacatctgagctgaaaagcgcgaccgtgtgtgcctcccatttctgctctagcgctacatccggaaagaaaagcaccgagattcagttccactctggctccctggttgggaagacggccatccacgtgaagggagctctcgtcgatggcacagaatttaccttcgaggggagctgtatgtttcccgacggatgcgatgccgtggactgcacattctgtcgcgaatttctgaaaaacccccaatgctatcctgcgaagaaatggcttttcatcattatcgtcattctgctcggctacgccgggctgatgcttctgaccaatgtgctcaaggctatcggcatttggggatcttgggttatcgccccggtgaagctgatctttgctattatcaaaaagctgatgagaaccgtctcctgtctcatgggcaaactgatggatcgggggagacaggtgattcatgaggaaatcggagagaaccgcgagggcaatcaggacgatgttcggattgaaatggccagaccccgccgggtgagacactggatgtatagccctgtcatccttacaattctggccatcgggctcgctgagtcttgcgacgaaatggtgcatgcggatagcaagctggtgtcctgtcgccagggaagcggcaacatgaaagagtgcgttacgaccgggcgggcccttctgcccgctgtcaatcctggccaagaggcctgtctccacttcacagcccccggatctccggactccaagtgcctgagaatcaaggtgaaacgcattaacctgaagtgtaaaaagagctcctcttactttgtgcctgatgctcggagcagatgcacctccgtccgccggtgtagatgggccggcgactgccagtctgggtgtccccctcatttcacaagcaattccttttctgacgattgggcgggaaaaatggaccgggctggcctcgggttcagcggatgctccgatggctgcgggggcgccgcctgtggatgctttaacgctgcccccagctgtatcttctggcgcaagtgggtggaaaatcctcacggcattatctggaaggtttctccctgcgctgcctgggtgccgtccgcggtcattgagctgaccatgcctagcggggaagtgagaacgttccaccccatgtctggaatccccacacaggtttttaaaggcgtgtccgtcacctatcttgggagcgacatggaggtgtctggactgaccgatctctgtgaaatcgaggagctgaagtccaaaaagctggcccttgctccttgcaaccaggccggcatgggcgttgtggggaaagtcggagaaattcaatgtagctccgaggaaagcgctcggacaatcaagaaagacggctgcatttggaacgccgatctcgtggggatcgagctgagagtggacgatgcggtctgttactctaagattaccagcgttgaagccgtggctaattattccgccatcccgacaacgatcggaggcctgcgcttcgagcggtctcatgacagccaggggaagatttccggatctcccctcgatatcaccgctattagaggcagcttttccgtgaactaccgcggcctgagactttctctgagcgagatcacagctacctgcacaggggaagtcaccaatgtgtccggatgctacagctgtatgacgggcgccaaagtttctattaagctccactccagcaaaaactctaccgcccatgtgcggtgcaagggggacgagacagcgttctccgtcctggaaggagtgcacagctataccgtttccctgtcttttgatcacgccgtggtcgacgagcagtgtcagcttaattgcggcgggcatgaaagccaagtgacactcaaaggaaacctgatcttcctggacgttcctaagtttgtggatggctcctacatgcagacctatcacagcacggtccccacaggcgctaatatcccttctcccaccgactggctcaacgccctgttcgggaatggaatgtcccgctggattcttggcgtgatgggggtgctgctcggaggcctggccctgtttttcatgatcatgagcctttttaagctcgggacaaaacaggtcttcagatctcggaccaagctggcttga

SEQ ID NO: 14861 - RNA, 3222 nt, synthetic construct
  misc_feature 1..3222: note = derived and/or modified CDS sequence (opt5) from SFTSV(HNXY_182)__KC292324.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctccaaggctacagcgagaagatctgtcagattgacagactgatccacgtttcctcttggcttcggaatcatagccagttccaggggtatgtgggacaacgcggcgggagatcccaggtgagctactatcccgccgaaaactcttactcccggtggagcggactgctctctccttgcgatgcggactggctgggcatgcttgtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctgtgctcctctgatagcggcacgtccagcggcctcctgccttctgaccgggtgctgtggatcggggatgttgcctgtcagccgatgacccccattcctgaagagacattcctcgagctgaagtcctttagccagtctgaatttcccgacatctgcaaaattgatggaatcgtgtttaatcaatgtgagggcgaaagccttcctcagcccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctggtgcataagcctggggaggtggtcgtgagctacggaggcatgcgcgttagacccaaatgttacgggttttcccggatgatggccaccctcgaagtgaaccaacctgagcagcgcatcggacagtgcacgggctgtcacctggaatgcattaatgggggcgtcagacttatcaccctgacatctgagctcaagagcgcgaccgtgtgtgcctcccatttctgctctagcgctacatccggaaagaaaagcaccgagattcaattccactctggctccctggttgggaagacggccatccacgtgaaaggagctctggtcgatggcacagaatttaccttcgaggggagctgtatgtttcccgacggatgcgatgccgtggactgcacattctgtcgggaatttctcaagaacccccagtgctatcctgcgaaaaagtggctgttcatcattatcgtcattcttctgggctacgccgggctcatgctgcttaccaatgtgctgaaggctatcggcatttggggatcttgggttatcgccccggtgaaactcatctttgctattatcaagaaactgatgcgcaccgtctcctgtctgatgggcaagctcatggatagagggagacaggtgattcatgaggaaatcggagagaaccgggagggcaatcaggacgatgttcgcattgaaatggcccggcccagacgcgtgcggcactggatgtatagccctgtcatcctgacaattcttgccatcgggctggctgagtcttgcgacgaaatggtgcatgcggatagcaaactcgtgtcctgtagacaaggaagcggcaacatgaaggagtgcgttacgaccgggcgcgccctgcttcccgctgtcaatcctggccaggaggcctgtctgcacttcacagcccccggatctccggactccaagtgcctcaaaatcaaggtgaaacggattaacctgaagtgtaaaaagagctcctcttactttgtgcctgatgctagaagccgctgcacctccgtccggagatgtcgctgggccggcgactgccagtctgggtgtccccctcatttcacaagcaattccttttctgacgattgggcgggaaagatggaccgggctggcctggggttcagcggatgctccgatggctgcgggggcgccgcctgtggatgctttaacgctgcccccagctgtatcttctggagaaaatgggtggaaaatcctcacggcattatctggaaggtttctccctgcgctgcctgggtgccgtccgcggtcattgagctcaccatgcctagcggggaagtgcggacgttccaccccatgtctggaatccccacacaggtttttaaaggcgtgtccgtcacctatctggggagcgacatggaggtgtctggacttaccgatctgtgtgaaatcgaggagctcaagtccaaaaagctggccctggctccttgcaaccaagccggcatgggcgttgtggggaaagtcggagaaattcagtgtagctccgaggaaagcgctcgcacaatcaagaaggacggctgcatttggaacgccgatcttgtggggatcgagctcagagtggacgatgcggtctgttactctaaaattaccagcgttgaagccgtggctaattattccgccatcccgacaacgatcggaggcctgcggttcgagagatctcatgacagccaggggaagatttccggatctcccctggatatcaccgctattcgcggcagcttttccgtgaactaccggggcctcagactgtctcttagcgagatcacagctacctgcacaggggaagtcaccaatgtgtccggatgctacagctgtatgacgggcgccaaagtttctattaagctgcactccagcaaaaactctaccgcccatgtgcgctgcaagggggacgagacagcgttctccgtcctcgaaggagtgcacagctataccgtttccctgtcttttgatcacgccgtggtcgacgagcagtgtcaactgaattgcggcgggcatgaaagccaggtgacacttaagggaaacctcatcttcctggacgttcctaaatttgtggatggctcctacatgcagacctatcacagcacggtccccacaggcgctaatatcccttctcccaccgactggctgaacgccctcttcgggaatggactgtccagatggattcttggcctgatcggggtgctcctgggaggcctggcccttttcttcatgattatgagcctctttaagctggggacaaaacaggtgttccggtctcgcaccaagctggcttga

SEQ ID NO: 14862 - RNA, 3222 nt, synthetic construct
  misc_feature 1..3222: note = derived and/or modified CDS sequence (opt5) from SFTSV(HNXY_188)__KC292301.1__GP
  source 1..3222: mol_type = other RNA
atgatgaaggtgatctggttcagctccctgatttgcctcgtcatccagtgtggcgggggaaccggccccattatctgcgccgggcctattcactctaacaaaagcgctgacatcccgcatctgcttggatactccgagaagatctgtcaaattgatagactgatccacgtttctagctggctccggaatcattcccagtttcagggctatgtggggcagcgcggaggcagatctcaagtgagctactatcccgccgaaaactcctacagccggtggtctggcctgctttccccttgcgacgcggattggctggggatgctcgtcgtgaaaaaggctaaaggaagcgacatgattgttcccggcccttcttataaggggaaggtgttctttgagcgccccacattcgatggatacgtcggctgggggtgtggatccggcaaaagcagaacggaatctggcgagctgtgctccagcgactccgggacctctagcggactgctcccttccgatcgggtgctgtggatcggcgacgttgcctgtcagccgatgacacccattcctgaagagacctttcttgagcttaagagcttctctcagtccgaatttcccgatatctgcaaaattgacgggatcgtgttcaatcagtgtgagggagaaagcctccctcaaccctttgatgtcgcctggatggacgtgggccactctcataagatcattatgcgcgagcacaaaacaaagtgggtgcaggagagctcctctaaggatttcgtctgctataaagaagggaccggaccgtgtagcgagtccgaagagaagacatgcaaaaccagcggctcttgcagaggcgacatgcagttttgtaaggttgctgggtgcgaacacggagaggaggcctccgaagctaaatgtcggtgcagcctggtgcataagcctggcgaggtggtcgtgtcttacgggggaatgcgcgttagacccaaatgttacggcttctcccggatgatggccacgcttgaagtgagccagcctgagcaacgcatcgggcagtgcaccggctgtcacctggaatgcattaacggaggcgtcagactcatcacactgacctccgagctgaagtctgcgacagtgtgtgccagccatttttgctcctctgctaccagcgggaagaaatccacggagattcagttccacagcggatctctcgttggcaagacagccatccacgtgaaaggggctctggtcgacggaaccgagttcacatttgaaggctcctgtatgttccccgatgggtgcgacgccgtggattgcaccttttgtcgggagttccttaagaatccccaatgctatcctgcgaaaaagtggctgtttatcattatcgtcattctcctgggctacgccggacttatgctgctcaccaacgtgctgaaggctatcggcgtttgggggagctgggtgattgccccggtcaaactggtgttcgctatcatcaagaaactcatgcgcgccgtttcttgtctgatgggaaagctgatggacagaggcagacaggtgattcatgaagaaatcggggagaatcgggagggaaaccaggatgacgtccgcattgaaatggcccggcccagacgcgtgcggcactggatgtattcccctgtgatcctgacaattctcgctatcggcctggcggaggggtgcgatgaaatggttcatgccgacagcaaacttgtctcttgtagacagggcagcggaaatatgaaggagtgcgtgacgaccggccgcgctctgctccccgccgtgaaccctgggcaagaggcctgtctgcactttacagctcccggatccccggatagcaagtgcctgaaaattaaggtcaaacggatcaatctcaagtgtaaaaagtcttccagctacttcgtgcctgacgccagatcccgctgcacctctgttcggagatgtcgctgggcgggcgattgccagagcgggtgtccccctcattttacatccaactctttcagcgacgactgggctggaaagatggatcgggccggcctggggttttccggctgctctgacggatgcggcggggccgcttgtggatgcttcaatgccgctcccagctgtatcttttggagaaaatgggtggaaaaccctcacggcattatctggaaggtctccccctgcgccgcgtgggtgccgagcgccgttattgagcttaccatgccttctggggaagtgcggacgttccaccccatgtccggaatccccacacaggtcttcaaaggcgtgagcgttacctatctgggctctgatatggaggtgtccgggctcaccgacctgtgtgaaattgaggagcttaagagcaaaaagctggctctcgccccttgcaatcaggctggaatgggcgtcgtggggaaagtgggagaaatccaatgttcttccgaggaaagcgcccgcacaatcaagaaggatggctgcatttggaacgcggacctggtcgggatcgagctgagagttgatgacgccgtgtgttactccaaaattaccagcgtggaagctgtcgccaactattctgctatcccgacaacgattggaggcctccggtttgagagaagccatgattcccagggcaagatctctgggagccccctggacatcaccgccattcgcggatccttctctgtgaattaccggggccttagactgagcctctccgagatcacagctacctgcacaggggaagttaccaacgtgtctggatgctacagctgtatgacgggcgccaaagtctccattaagctgcacagctctaaaaattccaccgcgcatgtgcgctgcaagggggatgagacagcctttagcgttctggaaggagtgcactcttattccgtcagcctttccttcgaccacgctgtggttgatgagcagtgtcagctcaactgcggcggccatgaatctcaagtgaccctgagagggaatctgatctttctcgacgtccctaagttcgtggacggaagctacatgcagacatatcactccaccgtgcccacgggcgccaacattcctagccccacagattggctgaatgccctttttgggaacggactgtctcggtggatcctcggcgtcatcggggttctgctgggaggccttgctctcttctttctgattatgtccctgttcaaactcggcaccaagcagatctttcgcagcagaacaaaactggcctga

SEQ ID NO: 14863 - RNA, 3222 nt, synthetic construct
  misc_feature 1..3222: note = derived and/or modified CDS sequence (opt5) from SFTSV(HNXY_191)__KC292323.1__GP
  source 1..3222: mol_type = other RNA
atgatgaaggtgatctggttcagctccctgatttgcctcgtcatccagtgtggcggggacaccggacccattatctgcgccggccctacacactctaacaaaagcgctgatattccgcatctgcttgggtactccgagaagatctgtcaaatcgacagactgattcacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgatcgttcccggaccttcttataagggcaaggtgttctttgagcgccccacgttcgacgggtacgtcggatggggctgtgggtccggaaaaagcagaaccgaatctggcgagctgtgctccagcgattccggcacatctagcgggctgctcccttccgaccgggtgctgtggattggagatgttgcctgtcagccgatgacccccatccctgaagagacatttcttgagcttaagagcttctctcagtccgaatttcccgacatttgcaaaatcgatggcattgtgttcaatcagtgtgagggggaaagcctccctcaaccctttgacgtcgcctggatggatgtgggacactctcataagatcatcatgcgcgagcacaaaaccaagtgggtgcaggagagctcctctaaggacttcgtctgctataaagaaggcacagggccgtgtagcgagtccgaagagaagacctgcaaaacgagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacccttgaagtgagccagcctgagcaacgcattggccagtgcacagggtgtcacctggaatgcatcaacggcggagtcagactcattaccctgacatccgagctgaagtctgcgaccgtgtgtgccagccatttttgctcctctgctacgagcggcaagaaatccacagagatccagttccacagcgggtctctcgttggaaagaccgccattcacgtgaaaggcgctctggtcgatgggacagagttcacctttgaaggatcctgtatgttccccgacggctgcgatgccgtggactgcaccttttgtcgggagttccttaagaatccccaatgctatcctgcgaaaaagtggctgtttatcatcattgtcatcctcctggggtacgccggccttatgctgctcacaaacgtgctgaaggctattggagtttggggcagctgggtgatcgccccggtcaaactggtgttcgctattatcaagaaactcatgcgcgccgtttcttgtctgatggggaagctgatggatagaggaagacaggtgatccatgaagaaattggcgagaatcgggaggggaaccaggacgatgtccgcatcgaaatggcccggcccagacgcgtgcggcactggatgtattcccctgtgattctgacgatcctcgctattggactggcggagggctgcgacgaaatggttcatgccgatagcaaacttgtctcttgtagacaggggagcggcaatatgaaggagtgcgtgaccacaggacgcgctctgctccccgccgtgaaccctggccaagaggcctgtctgcactttaccgctcccgggtccccggacagcaagtgcctgaaaatcaaggtcaaacggattaatctcaagtgtaaaaagtcttccagctacttcgtgcctgatgccagatcccgctgcacatctgttcggagatgtcgctgggcgggagactgccagagcggctgtccccctcattttacctccaactctttcagcgacgattgggctgggaagatggaccgggccggactgggcttttccgggtgctctgatggctgcggaggcgccgcttgtgggtgcttcaatgccgctcccagctgtatcttttggagaaaatgggtggaaaaccctcacggaatcatttggaaggtctccccctgcgccgcgtgggtgccgagcgccgttatcgagcttacgatgccttctggcgaagtgcggacattccaccccatgtccgggattcccacccaggtcttcaaaggagtgagcgttacctatctgggctctgacatggaggtgtccggcctcacagatctgtgtgaaatcgaggagcttaagagcaaaaagctggctctcgccccttgcaatcaggctgggatgggagtcgtgggcaaagtgggggaaattcaatgttcttccgaggaaagcgcccgcaccatcaagaaggacggatgcatctggaacgcggatctggtcggcattgagctgagagttgacgatgccgtgtgttactccaaaatcacaagcgtggaagctgtcgccaactattctgctattccgacgaccatcgggggactccggtttgagagaagccatgactcccagggcaagatttctggcagccccctggatatcacagccatccgcgggtccttctctgtgaattaccggggacttagactgagcctctccgagattaccgccacatgcaccggcgaagttacgaacgtgtctgggtgctacagctgtatgaccggagctaaagtctccatcaagctgcacagctctaaaaattccacagcgcatgtgcgctgcaagggcgacgagaccgcctttagcgttctggaaggggtgcactcttattccgtcagcctttccttcgatcacgctgtggttgacgagcagtgtcagctcaactgcggaggccatgaatctcaagtgacactgagaggcaatctgatttttctcgacgtccctaagttcgtggatgggagctacatgcagacctatcactccacggtgcccacaggagccaacatccctagccccaccgactggctgaatgccctttttggcaacgggctgtctcggtggattctcggagtcatcggcgttctgcttgggggactggctctcttctttctgatcatgtccctgttcaaactcggcacaaagcagatttttcgcagcagaaccaaactggcctga

SEQ ID NO: 14864 - RNA, 3222 nt, synthetic construct
  misc_feature 1..3222: note = derived and/or modified CDS sequence (opt5) from SFTSV(HNXY_195)__KC292326.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctccaaggctacagcgagaagatctgtcagattgacagactgatccacgtttcctcttggcttcggaatcatagccagttccaggggtatgtgggacaacgcggcgggagatcccaggtgagctactatcccgccgaaaactcttactcccggtggagcggactgctctctccttgcgatgcggactggctgggcatgcttgtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctgtgctcctctgatagcggcacgtccagcggcctcctgccttctgaccgggtgctgtggatcggggatgttgcctgtcagccgatgacccccattcctgaagagacattcctcgagctgaagtcctttagccagtctgagttccccgacatctgcaaaattgatggaatcgtgtttaatcaatgtgaaggcgaaagccttcctcagcccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctggtgcataagcctggggaggtggtcgtgagctacggaggcatgcgcgttagacccaaatgttacgggttttcccggatgatggccaccctcgaagtgaaccaacctgagcagcgcatcggacagtgcacgggctgtcacctggaatgcattaatgggggcgtcagacttatcaccctgacatctgagctcaagagcgcgaccgtgtgtgcctcccatttctgctctagcgctacatccggaaagaaaagcaccgagattcaattccactctggctccctggttgggaagacggccatccacgtgaaaggagctctggtcgatggcacagaatttaccttcgaggggagctgtatgtttcccgacggatgcgatgccgtggactgcacattctgtcgggaatttctcaagaacccccagtgctatcctgcgaaaaagtggctgttcatcattatcgtcattcttctgggctacgccgggctcatgctgcttaccaatgtgctgaaggctatcggcatttggggatcttgggttatcgccccggtgaaactcatctttgctattatcaagaaactgatgcgcaccgtctcctgtctgatgggcaagctcatggatagagggagacaggtgattcatgaggaaatcggagagaaccgggagggcaatcaggacgatgttcgcattgaaatggcccggcccagacgcgtgcggcactggatgtatagccctgtcatcctgacaattcttgccatcgggctggctgagtcttgcgacgaaatggtgcatgcggatagcaaactcgtgtcctgtagacaaggaagcggcaacatgaaggagtgcgttacgaccgggcgcgccctgcttcccgctgtcaatcctggccaggaggcctgtctgcacttcacagcccccggatctccggactccaagtgcctcaaaatcaaggtgaaacggattaacctgaagtgtaaaaagagctcctcttactttgtgcctgatgctagaagccgctgcacctccgtccggagatgtcgctgggccggcgactgccagtctgggtgtccccctcatttcacaagcaattccttttctgacgattgggcgggaaagatggaccgggctggcctggggttcagcggatgctccgatggctgcgggggcgccgcctgtggatgctttaacgctgcccccagctgtatcttctggagaaaatgggtggaaaatcctcacggcattatctggaaggtttctccctgcgctgcctgggtgccgtccgcggtcattgagctcaccatgcctagcggggaagtgcggacgttccaccccatgtctggaatccccacacaggtttttaaaggcgtgtccgtcacctatctggggagcgacatggaggtgtctggacttaccgatctgtgtgaaatcgaggagctcaagtccaaaaagctggccctggctccttgcaaccaagccggcatgggcgttgtggggaaagtcggagaaattcagtgtagctccgaggaaagcgctcgcacaatcaagaaggacggctgcatttggaacgccgatcttgtggggatcgagctcagagtggacgatgcggtctgttactctaaaattaccagcgttgaagccgtggctaattattccgccatcccgacaacgatcggaggcctgcggttcgagagatctcatgacagccaggggaagatttccggatctcccctggatatcaccgctattcgcggcagcttttccgtgaactaccggggcctcagactgtctcttagcgagatcacagctacctgcacaggggaagtcaccaatgtgtccggatgctacagctgtatgacgggcgccaaagtttctattaagctgcactccagcaaaaactctaccgcccatgtgcgctgcaagggggacgagacagcgttctccgtcctcgaaggagtgcacagctataccgtttccctgtcttttgatcacgccgtggtcgacgagcagtgtcaactgaattgcggcgggcatgaaagccaggtgacacttaagggaaacctcatcttcctggacgttcctaaatttgtggatggctcctacatgcagacctatcacagcacggtccccacaggcgctaatatcccttctcccaccgactggctgaacgccctcttcgggaatggactgtccagatggattcttggcgtgatcggggtgctgctcggaggcctggccctgtttttcatgattatgagcctttttaagctcgggacaaaacaggtcttccggtctcgcaccaagctggcttga

SEQ ID NO: 14865 - RNA, 3222 nt, synthetic construct
  misc_feature 1..3222: note = derived and/or modified CDS sequence (opt5) from SFTSV(HNXY_2)__KC292318.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagctcaagagcgcgaccgtgtgtgcctcccatttctgctctagcgctacatccggaaagaaaagcaccgagattcagttccactctggctccctggttgggaagacggccatccacgtgaaaggagctctggtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgcgcaccgtctcctgtctcatgggcaagctgatggatagagggagacaggtgattcatgaggaaatcggagagaaccgggagggcaatcaggacgatgttcgcattgaaatggcccggcccagacgcgtgcggcactggatgtatagccctgtcatccttacaattctggccatcgggctcgctgagtcttgcgacgaaatggtgcatgcggatagcaaactggtgtcctgtagacagggaagcggcaacatgaaggagtgcgttacgaccgggcgcgcccttctgcccgctgtcaatcctggccaagaggcctgtctccacttcacagcccccggatctccggactccaagtgcctgaaaatcaaggtgaaacggattaacctgaagtgtaaaaagagctcctcttactttgtgcctgatgctagaagccgctgcacctccgtccggagatgtcgctgggccggcgactgccagtctgggtgtccccctcatttcacaagcaattccttttctgacgattgggcgggaaagatggaccgggctggcctcgggttcagcggatgctccgatggctgcgggggcgccgcctgtggatgctttaacgctgcccccagctgtatcttctggagaaaatgggtggaaaatcctcacggcattatctggaaggtttctccctgcgctgcctgggtgccgtccgcggtcattgagctgaccatgcctagcggggaagtgcggacgttccaccccatgtctggaatccccacacaggtttttaaaggcgtgtccgtcacctatcttgggagcgacatggaggtgtctggactgaccgatctctgtgaaatcgaggagctgaagtccaaaaagctggcccttgctccttgcaaccaggccggcatgggcgttgtggggaaagtcggagaaattcaatgtagctccgaggaaagcgctcgcacaatcaagaaggacggctgcatttggaacgccgatctcgtggggatcgagctgagagtggacgatgcggtctgttactctaaaattaccagcgttgaagccgtggctaattattccgccatcccgacaacgatcggaggcctgcggttcgagagatctcatgacagccaggggaagatttccggatctcccctcgatatcaccgctattcgcggcagcttttccgtgaactaccggggcctgagactttctctgagcgagatcacagctacctgcacaggggaagtcaccaatgtgtccggatgctacagctgtatgacgggcgccaaagtttctattaagctccactccagcaaaaactctaccgcccatgtgcgctgcaagggggacgagacagcgttctccgtcctggaaggagtgcacagctataccgtttccctgtcttttgatcacgccgtggtcgacgagcagtgtcagcttaattgcggcgggcatgaaagccaagtgacactcaagggaaacctgatcttcctggacgttcctaaatttgtggatggctcctacatgcagacctatcacagcacggtccccacaggcgctaatatcccttctcccaccgactggctcaacgccctgttcgggaatggaatgtccagatggattcttggcgtgatcggggtgctgctcggaggcctggccctgtttttcatgattatgagcctttttaagctcgggacaaaacaggtcttccggtctcgcaccaagctggcttga

SEQ ID NO: 14866 - RNA, 3222 nt, synthetic construct
  misc_feature 1..3222: note = derived and/or modified CDS sequence (opt5) from SFTSV(HNXY_202)__KC292325.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctaatcgggtgctctggatcggggacgttgcctgtcagccgatgacccccattcctgaagagacattcctggagcttaagtcctttagccagtctgaatttcccgatatctgcaaaattgacggaatcgtgtttaaccagtgtgagggcgaaagcctgcctcaacccttcgatgtcgcctggatggacgtggggcactcccataagatcattatgcgcgagcacaaaaccaagtgggtgcaggagtctagctccaaggattttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaatcagcctgagcaacgcatcggacagtgcacgggctgtcaccttgaatgcattaacgggggcgtcagactgatcaccctcacatctgagctgaagtctgcgaccgtgtgtgcctcccatttctgctctagcgctacatccggaaagaaaagcaccgagattcagttccactctggctccctggttgggaagacggccatccacgtgaaaggagctctcgtcgacggcacagaatttaccttcgaggggagctgtatgtttcccgatggatgcgacgccgtggattgcacattctgtcgggaatttctgaagaatccccaatgctatcctgcgaaaaagtggcttttcatcattatcgtcattctgctcggctacgccgggctgatgcttctgaccaacgtgctcaaggctatcggcatttggggatcttgggttatcgccccggtgaaactgatctttgctattatcaagaaactgatgcgcaccgtctcctgtctcatgggcaagctgatggacagagggagacaggtgattcatgaggaaatcggagagaatcgggagggcaaccaggatgacgttcgcattgaaatggcccggcccagacgcgtgcggcactggatgtatagccctgtcatccttacaattctggccatcgggctcgctgagtcttgcgatgaaatggtgcatgcggacagcaaactggtgtcctgtagacagggaagcggcaatatgaaggagtgcgttacgaccgggcgcgcccttctgcccgctgtcaaccctggccaagaggcctgtctccacttcacagcccccggatctccggattccaagtgcctgcggatcaaagtgaagaaaattaatctgaagtgtaaaagaagctcctcttactttgtgcctgacgctcgcagccggtgcacctccgtcagacgctgtcggtgggccggcgattgccagtctgggtgtccccctcatttcacaagcaactccttttctgacgactgggcgggaaagatggatagagctggcctcgggttcagcggatgctccgacggctgcgggggcgccgcctgtggatgctttaatgctgcccccagctgtatcttctggcggaagtgggtggaaaaccctcacggcattatctggaaagtttctccctgcgctgcctgggtgccgtccgcggtcattgagctgaccatgcctagcggggaagtgcgcacgttccaccccatgtctggaatccccacacaggtttttaagggcgtgtccgtcacctatcttgggagcgatatggaggtgtctggactgaccgacctctgtgaaatcgaggagctgaaatccaagaaactggcccttgctccttgcaaccaggccggcatgggcgttgtggggaaggtcggagaaattcaatgtagctccgaggaaagcgctagaacaatcaaaaaggatggctgcatttggaatgccgacctcgtggggatcgagctgcgggtggatgacgcggtctgttactctaagattaccagcgttgaagccgtggctaactattccgccatcccgacaacgatcggaggcctgagattcgagcgctctcatgatagccaggggaaaatttccggatctcccctcgacatcaccgctattcggggcagcttttccgtgaattacagaggcctgcgcctttctctgagcgagatcacagctacctgcacaggggaagtcaccaacgtgtccggatgctacagctgtatgacgggcgccaaggtttctattaaactccactccagcaagaatagcaccgcccatgtgagatgcaaaggggatgagacagcgttctccgtcctggaaggagtgcacagctataccgtttccctgtcttttgaccacgccgtggtcgatgagcagtgtcagcttaactgcggcgggcatgaaagccaagtgacactcaagggaaatctgatcttcctggacgttcctaagtttgtggacggctcctacatgcagacctatcacagcacggtccccacaggcgctaacatcccttctcccaccgattggctcaatgccctgttcgggaacggactttcccggtggattctgggcgtgatgggggtgctcctgggaggcctggcccttttcttcatgatcatgagcctctttaaactggggacaaagcaggtcttccgctctagaaccaaactggcttga

SEQ ID NO: 14867 - RNA, 3222 nt, synthetic construct
  misc_feature 1..3222: note = derived and/or modified CDS sequence (opt5) from SFTSV(HNXY_206)__KC292302.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagcttaagagcttctctcagtccgaatttcccgacatctgcaaaattgatggcatcgtgttcaatcagtgtgagggggaaagcctccctcaaccctttgacgtcgcctggatggatgtgggacactctcataagatcattatgcgcgagcacaaaacaaagtgggtgcaggagagctcctctaaggacttcgtctgctataaagaaggcaccgggccgtgtagcgagtccgaagagaagacatgcaaaaccagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacgcttgaagtgagccagcctgagcaacgcatcggccagtgcaccgggtgtcacctggaatgcattaacggcggagtcagactcatcacactgacctccgagctgaagtctgcgacagtgtgtgccagccatttttgctcctctgctaccagcggcaagaaatccacggagattcagttccacagcgggtctctcgttggaaagacagccatccacgtgaaaggcgctctggtcgatgggaccgaatttacatttgagggatcctgtatgttccccgacggctgcgatgccgtggactgcaccttttgtcgggagttccttaagaatccccaatgctatcctaccaaaaagtggctgtttatcattatcgtcattctcctggggtacgcgggccttatgctgctcacaaacgtgctgaaggccatcggagtttggggcagctgggtgattgctccggtcaaactggtgttcgccatcatcaagaaactcatgcgcgctgtttcttgtctgatggggaagctgatggatagaggaagacaggtgattcatgaagaaatcggcgagaatcgggaggggaaccaggacgatattcgcatcgaaatggcccggcccagacgcgtccggcactggatgtattcccctgtgattctgacgatcctcgccattggactggctgagggctgcgacgaaatggtgcatgcggatagcaaacttgtttcttgtagacaggggagcggcaatatgaaggagtgcgtcaccacaggacgcgccctgctccccgctgtgaaccctggccaagaggcctgtctgcactttaccacacccgggtccccggacagcaagtgcctgaaaatcaaggtgaaacggatcaatctcaagtgtaaaaagtcttccagctacttcgtccctgatgccagatcccgctgcacctctgtgcggagatgtcgctgggctggagactgccagagcggctgtccccctcattttacgtccaactctttcagcgacgattgggccgggaagatggaccgggcgggactgggcttttccgggtgctctgatggctgcggaggcgctgcctgtgggtgcttcaatgccgctcccagctgtattttctggagaaaatgggttgaaaaccctcacggaatcatttggaaggtgtccccctgcgccgcttgggtcccgagcgccgtgatcgagcttacaatgccttctggcgaagttcggaccttccaccccatgtccgggattcccacccaggtgttcaaaggagtcagcgtgacatatctgggctctgacatggaggtttccggcctcaccgatctgtgtgaaatcgaggagcttaagagcaaaaagctggcgctcgccccttgcaatcaggctgggatgggagtggtcggcaaagtgggggaaatccaatgttcttccgaggaaagcgcccgcacaattaagaaggacggatgcatctggaacgctgatctggtgggcattgagctgagagtcgacgatgccgtttgttactccaaaatcacgagcgtggaagcggtggccaactattctgctattccgaccacaatcgggggactccggtttgagagaagccatgactcccagggcaagatctctggcagccccctggatattaccgccatccgcgggtccttctctgtcaattaccggggacttagactgagcctctccgagattacagctacctgcacgggcgaagtgaccaacgtttctgggtgctacagctgtatgacaggagccaaagtgtccatcaagctgcacagctctaaaaattccaccgcccatgtccgctgcaagggcgacgagacagcttttagcgtgctggaaggggttcactcttattccgtgagcctttccttcgatcacgcggtcgtggacgagcagtgtcagctcaactgcggaggccatgaatctcaagttaccctgagaggcaatctgatttttctcgacgtgcctaagttcgtcgatgggagctacatgcagacgtatcactccacagtgcccaccggagccaacatccctagccccacagactggctgaatgctctttttggcaacgggctgtctcggtggatcctcggagtgattggcgtcctgcttgggggactggccctcttctttctgatcatgtccctgttcaaactcggcaccaagcagatttttcgcagcagaaccaaactggcctga

SEQ ID NO: 14868 - RNA, 3222 nt, synthetic construct
  misc_feature 1..3222: note = derived and/or modified CDS sequence (opt5) from SFTSV(HNXY_207)__KC292315.1__GP
  source 1..3222: mol_type = other RNA
atgatgaaggtgatctggttccccagcctgatttgctttgtcatccagtgttccggcgactctgggcctattatctgcgccggaccgattcacagcaacaaatccgctgatatcccccatctcctgggctactctgagaagatctgtcaaattgacagacttatccacgttagctcctggctgcggaatcattctcagttccaggggtatgtgggacagcgcggcgggagaagccaagtgtcctactatcctgccgaaaacagctactctcggtggtccggactcctgagcccctgcgatgcggactggcttggcatgctggtcgtgaaaaaggctaaaggctctgatatgattgttcctgggccctcctataagggaaaggtgtttttcgagcgccctacctttgacggctacgtcgggtggggatgtggcagcgggaaatctagaacagaatccggagagctctgcagctccgattctggcacgagctccggcctgctgccgagcgaccgggtgctctggatcggggatgttgcctgtcagcccatgacccctattcccgaagagacattcctggagcttaagtctttttcccagagcgaatttcctgacatctgcaaaattgatggaatcgtgtttaatcagtgtgagggcgaatctctgccccaaccgttcgacgtcgcctggatggatgtggggcacagccataagatcattatgcgcgagcacaaaaccaagtgggtgcaggagtcctctagcaaggactttgtctgctataaagaaggaacaggcccttgttccgagagcgaagagaagacctgcaaaacatctgggtcctgcagaggagacatgcagttctgtaaggttgctggctgcgaacacggcgaggaggccagcgaagctaaatgtcggtgctctctcgtgcataagcccggggaggtggtcgtgtcctacggaggcatgcgcgttagacctaaatgttacgggtttagccggatgatggccaccctggaagtgaaccagcccgagcaacgcatcggacagtgcacgggctgtcaccttgaatgcattaatgggggcgtcagactgatcaccctcacatccgagctgaagtctgcgaccgtgtgtgccagccatttctgctcctctgctacaagcggaaagaaatccaccgagattcagttccacagcggctctctggttgggaagacggccatccacgtgaaaggagctctcgtcgatggcacagaatttaccttcgaggggtcctgtatgtttcccgacggatgcgatgccgtggactgcacattctgtcgggaatttctgaagaaccctcaatgctatccggcgaaaaagtggcttttcatcattatcgtcattctgctcggctacgccgggctgatgcttctgaccaatgtgctcaaggctatcggcatttggggaagctgggttatcgcccccgtgaaactgatgtttgctatcattaagaaactgatgcgcaccgtctcttgtctcatgggcaagctgatggatagagggagacaggtgatccatgaggaaattggagagaaccgggagggcaatcaggacgatgttcgcatcgaaatggcccggcctagacgcgtgcggcactggatgtattcccccgtcattcttacaatcctggccattgggctcgctgagagctgcgacgaaatggtgcatgcggattctaaactggtgagctgtagacagggatccggcaacatgaaggagtgcgttacgaccgggcgcgcccttctgcctgctgtcaatcccggccaagaggcctgtctccacttcacagccccgggaagccctgactctaagtgcctgaaaatcaaggtgaaacggatcaacctgaagtgtaaaaagtccagctcctactttgtgcccgatgctagatctcgctgcaccagcgtccggagatgtcgctgggccggcgactgccagtccgggtgccctccccatttcacatctaatagcttttccgacgattgggcgggaaagatggaccgggctggcctcgggttctctggatgtagcgatggctgcgggggcgccgcctgtggatgctttaacgctgccccttcctgtattttctggagaaaatgggtggaaaatccccacggcatcatttggaaggttagcccgtgcgctgcctgggtgccttctgcggtcatcgagctgaccatgccctccggggaagtgcggacgttccaccccatgagcggcattcctacacaggtttttaaaggagtgtctgtcacctatcttgggtccgacatggaggtgagcggactgaccgatctctgtgaaatcgaggagctgaagtctaaaaagctggcccttgctccgtgcaaccaggccggcatgggcgttgtggggaaagtcggagaaatccaatgttccagcgaggaatccgctcgcacaattaagaaggacggctgcatctggaacgccgatctcgtggggattgagctgagagtggacgatgcggtctgttacagcaaaatcacctctgttgaagccgtggctaattatagcgccattcccacaacgatcggaggcctgcggttcgagagatcccatgactctcaggggaagatcagcggatcccctctcgatattaccgctatccgcggctcttttagcgtgaactaccggggcctgagactttccctgtctgagattacagctacctgcacaggggaagtcaccaatgtgagcggatgctactcctgtatgacgggcgccaaagttagcatcaagctccactcttccaaaaacagcaccgcccatgtgcgctgcaagggggacgagacagcgttctctgtcctggaaggagtgcactcctataccgttagcctgtcctttgatcacgccgtggtcgacgagcagtgtcagcttaattgcggcgggcatgaatctcaagtgacactcaagggaaacctgattttcctggacgttcccaaatttgtggatggcagctacatgcagacctatcactccacggtccctacaggcgctaatatccccagccctaccgactggctcaacgccctgttcgggaatggactttctagatggatcctgggcgtgattggggtgctcctgggaggcctggcccttttcttcatgatcatgtccctctttaagctggggacaaaacaggtcttccggagccgcaccaagctggcttga

SEQ ID NO: 14869 - RNA, 3222 nt, synthetic construct
  misc_feature 1..3222: note = derived and/or modified CDS sequence (opt5) from SFTSV(HNXY_224)__KC292317.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaacccccaatgctatcctgcgaaaaagtggcttttcatcattgtcgtgatcctgctcggctacgccgggctgatgcttctgaccaatgttctcaaggctattggcatctggggatcttgggtgattgccccggtcaaactgatgtttgctatcatcaagaaactgatgcgcaccgtgtcctgtctcatgggcaagctgatggatagagggcggcaggttattcatgaggaaatcggagagaacagagagggcaatcaggacgatgtgcgcattgaaatggcccggcccagacgcgtccggcactggatgtatagccctgtgatccttacaattctggccatcgggctcacggagtcttgcgacgaaatggtgcatgctgatagcaaactggtttcctgtagacagggaagcggcaacatgaaggagtgcgtcaccacagggcgcgcgcttctgcccgccgtgaatcctggccaagaggcttgtctccacttcaccgcccccggatctccggactccaagtgcctgaaaattaaggtgaaacggatcaacctgaagtgtaaaaagagctcctcttactttgtccctgatgccagaagccgctgcacatccgtgcggagatgtcgctgggctggcgactgcgaatctgggtgtccccctcatttcaccagcaattccttttctgacgattgggccggaaagatggaccgggcgggcctcgggttcagcggatgctccgatggctgcgggggcgctgcctgtggatgctttaacgccgctcccagctgtatcttctggagaaaatgggttgagaatcctcacggcattatctggaaggtgtctccctgcgccgcttgggtcccgtccgccgtgattgaactgacgatgcctagcggggaggttcggacattccagcccatgtctggaatccccacccaggtgtttaaaggcgtctccgtgacctatcttgggagcgacatggaagtttctggactgacagatctctgtgagattgaggaactgaagtccaaaaagctggcgcttgccccttgcaaccaggctggcatgggcgtggtcgggaaagtgggagagatccaatgtagctccgaagagagcgcccgcaccatcaagaaggacggctgcatttggaacgctgatctcgtggggatcgaactgagagtcgacgatgccgtttgttactctaaaattacaagcgtggaggcggtggccaattattccgctatcccgacgaccattggaggcctgcggttcgagagatctcacgacagccaggggaagatctccggatctcccctcgatatcacagccattcgcggcagcttttccgtcaactaccggggcctgagactttctctgagcgaaatcaccgctacatgcaccggggaggtgacgaatgtttccggatgctacagctgtatgaccggcgccaaagtgtctattaagctccattccagcaaaaactctacagcccacgtccgctgcaagggggacgaaaccgctttctccgtgctggagggagttcatagctatacagtgtccctgtcttttgatcacgcggtcgtggacgaacagtgtcagcttaattgcggcgggcacgagagccaagttaccctcaagggaaacctgatcttcctggacgtgcctaaatttgtcgatggctcctacatgcagacgtatcatagcacagtgcccaccggcgccaatattccttctcccacagactggctcaacgctctgttcgggaatggactttccagatggatcctgggcgtgatcggggtcctcctgggaggcctggccctgtttttcatgattatgagcctctttaagctggggaccaaacaggttttccggtctcgcaccaagctggcctga

SEQ ID NO: 14870 - RNA, 3222 nt, synthetic construct
  misc_feature 1..3222: note = derived and/or modified CDS sequence (opt5) from SFTSV(HNXY_231)__KC292313.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctggcatcccgcatctcctggggtacagcgagaagatctgtcaaattgatagacttatccacgtttcctcttggctgcggaatcatagccagttccagggatatgtgggccagcgcgggggaagatcccaagtgagctactatcccgccgaaaactcttactcccggtggagcggcctcctgtctccttgcgacgcggattggcttggcatgctggtcgtgaaaaaggctaaagggtccgacatgattgttcccggacctagctataagggcaaggtgtttttcgagcgccccacctttgatgggtacgtcggatggggctgtgggtctggaaaatccagaacagaaagcggcgagctctgctcctctgacagcggcacgtccagcgggctgctgccttctgatcgggtgctctggatcggagacgttgcctgtcagccgatgacccccattcctgaagagacattcctggagcttaagtcctttagccagtctgagttccccgatatctgcaaaattgacggcatcgtgtttaatcagtgtgaaggggaaagcctgcctcaacccttcgatgtcgcctggatggacgtgggacactcccataagatcattatgcgcgagcacaaaaccaagtgggtgcaggagtctagctccaaggattttgtctgctataaagaaggcacagggccgtgtagcgagtctgaagagaagacctgcaaaacatccggaagctgcagaggcgacatgcagttctgtaaggttgctggctgcgaacacggggaggaggcctctgaagctaaatgtcggtgctccctcgtgcataagcctggagaggtggtcgtgagctacggcgggatgcgcgttagacccaaatgttacggattttcccggatgatggccaccctggaagtgaaccagcctgagcaacgcatcggccagtgcacggggtgtcaccttgaatgcattaatggcggagtcagactgatcaccctcacatctgagcttaagagcgcgaccgtgtgtgcctcccatttctgctctagcgctacatccggcaagaaaagcaccgagattcagttccactctgggtccctggttggaaagacggccatccacgtgaaaggcgctctcgtcgacgggacagaatttaccttcgagggaagctgtatgtttcccgatggctgcgacgccgtggattgcacattctgtcgggaatttctgaagaacccccaatgctatcctgcgaaaaagtggcttttcatcattatcgtcattctgctcgggtacgccggcctgatgcttctgaccaatgtgctcaaggctatcggaatttggggctcttgggttatcgccccggtgaaactgatctttgctattatcaagaaactgatgcgcaccgtctcctgtctcatggggaagctgatggacagaggaagacaggtgattcatgaggaaatcggcgagaaccgggaggggaatcaggatgacgttcgcattgaaatggcccggcccagacgcgtgcggcactggatgtatagccctgtcatccttacaattctggccatcggactcgctgagtcttgcgatgaaatggtgcatgcggacagcaaactggtgtcctgtagacagggcagcgggaacatgaaggagtgcgttacgaccggccgcgcccttctgcccgctgtcaatcctggacaagaggcctgtctccacttcacagcccccggctctccggattccaagtgcctgaaaatcaaggtgaaacggattaacctgaagtgtaaaaagagctcctcttactttgtgcctgacgctagaagccgctgcacctccgtccggagatgtcgctgggccggggattgccagtctggatgtccccctcatttcacaagcaattccttttctgacgactgggcgggcaagatggatcgggctgggctcggattcagcggctgctccgacgggtgcggcggagccgcctgtggctgctttaacgctgcccccagctgtatcttctggagaaaatgggtggaaaatcctcacgggattatctggaaggtttctccctgcgctgcctgggtgccgtccgcggtcattgagctgaccatgcctagcggagaagtgcggacgttccaccccatgtctggcatccccacacaggtttttaaaggggtgtccgtcacctatcttggaagcgatatggaggtgtctggcctgaccgacctctgtgaaatcgaggagctgaagtccaaaaagctggcccttgctccttgcaaccaggccggcatgggggttgtgggaaaagtcggcgaaattcaatgtagctccgaggaaagcgctcgcacaatcaagaaggatgggtgcatttggaacgccgacctcgtgggaatcgagctgagagtggatgacgcggtctgttactctaaaattaccagcgttgaagccgtggctaattattccgccatcccgacaacgatcggcgggctgcggttcgagagatctcatgatagccagggaaagatttccggctctcccctcgacatcaccgctattcgcggcagcttttccgtgaactaccgggggctgagactttctctgagcgagatcacagctacctgcacaggagaagtcaccaatgtgtccggctgctacagctgtatgacgggggccaaagtttctattaagctccactccagcaaaaactctaccgcccatgtgcgctgcaagggagatgagacagcgttctccgtcctggaaggcgtgcacagctataccgtttccctgtcttttgaccacgccgtggtcgatgagcagtgtcagcttaattgcgggggacatgaaagccaagtgacactcaagggcaacctgatcttcctggacgttcctaaatttgtggacggctcctacatgcagacctatcacagcacggtccccacaggggctaatatcccttctcccaccgattggctcaacgccctgttcggaaatggcctttccagatggattctgggggtgatcggagtgctcctgggcgggctggccctgtttttcatgattatgagcctctttaagctgggaacaaaacaggtcttccggtctcgcaccaagctggcttga

SEQ ID NO: 14871 - RNA, 3222 nt, synthetic construct
  misc_feature 1..3222: note = derived and/or modified CDS sequence (opt5) from SFTSV(HNXY_245)__KC292320.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctaatcgggtgctctggatcggggacgttgcctgtcagccgatgacccccattcctgaagagacattcctggagcttaagtcctttagccagtctgaatttcccgatatctgcaaaattgacggaatcgtgtttaaccagtgtgagggcgaaagcctgcctcaacccttcgatgtcgcctggatggacgtggggcactcccataagatcattatgcgcgagcacaaaaccaagtgggtgcaggagtctagctccaaggattttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaatcagcctgagcaacgcatcggacagtgcacgggctgtcaccttgaatgcattaacgggggcgtcagactgatcaccctcacatctgagctgaagtctgcgaccgtgtgtgcctcccatttctgctctagcgctacatccggaaagaaaagcaccgagattcagttccactctggctccctggttgggaagacggccatccacgtgaaaggagctctcgtcgacggcacagaatttaccttcgaggggagctgtatgtttcccgatggatgcgacgccgtggattgcacattctgtcgggaatttctgaagaatccccaatgctatcctgcgaaaaagtggcttttcatcattatcgtcattctgctcggctacgccgggctgatgcttctgaccaacgtgctcaaggctatcggcatttggggatcttgggttatcgccccggtgaaactgatctttgctattatcaagaaactgatgcgcaccgtctcctgtctcatgggcaagctgatggacagagggagacaggtgattcatgaggaaatcggagagaatcgggagggcaaccaggatgacgttcgcattgaaatggcccggcccagacgcgtgcggcactggatgtatagccctgtcatccttacaattctggccatcgggctcgctgagtcttgcgatgaaatggtgcatgcggacagcaaactggtgtcctgtagacagggaagcggcaatatgaaggagtgcgttacgaccgggcgcgcccttctgcccgctgtcaaccctggccaagaggcctgtctccacttcacagcccccggatctccggattccaagtgcctgcggatcaaagtgaagagaattaatctgaaatgtaagaaaagctcctcttactttgtgcctgacgctcgcagccggtgcacctccgtcagacgctgtcggtgggccggcgattgccagtctgggtgtccccctcatttcacaagcaactccttttctgacgactgggcgggaaagatggatagagctggcctcgggttcagcggatgctccgacggctgcgggggcgccgcctgtggatgctttaatgctgcccccagctgtatcttctggcggaagtgggtggaaaaccctcacggcattatctggaaagtttctccctgcgctgcctgggtgccgtccgcggtcattgagctgaccatgcctagcggggaagtgcgcacgttccaccccatgtctggaatccccacacaggtttttaagggcgtgtccgtcacctatcttgggagcgatatggaggtgtctggactgaccgacctctgtgaaatcgaggagctgaaatccaagaaactggcccttgctccttgcaaccaggccggcatgggcgttgtggggaaggtcggagaaattcaatgtagctccgaggaaagcgctagaacaatcaaaaaggatggctgcatttggaatgccgacctcgtggggatcgagctgcgggtggatgacgcggtctgttactctaagattaccagcgttgaagccgtggctaactattccgccatcccgacaacgatcggaggcctgagattcgagcgctctcatgatagccaggggaaaatttccggatctcccctcgacatcaccgctattcggggcagcttttccgtgaattacagaggcctgcgcctttctctgagcgagatcacagctacctgcacaggggaagtcaccaacgtgtccggatgctacagctgtatgacgggcgccaaggtttctattaaactccactccagcaagaatagcaccgcccatgtgagatgcaaaggggatgagacagcgttctccgtcctggaaggagtgcacagctataccatctccctgtcttttgaccacgccgttgtggatgagcagtgtcagcttaactgcggcgggcatgaaagccaagtcacactcaagggaaatctgatcttcctggacgtgcctaagtttgttgacggctcctacatgcagacctatcacagcacggtgcccacaggcgctaacattccttctcccaccgattggctcaatgccctgttcgggaacggactttcccggtggatcctgggcgtcatgggggtgctcctgggaggcctggcccttttcttcatgattatgagcctctttaaactggggacaaaacaggtgttccgctctagaaccaagctggcttga

SEQ ID NO: 14872 - RNA, 3222 nt, synthetic construct
  misc_feature 1..3222: note = derived and/or modified CDS sequence (opt5) from SFTSV(HNXY_262)__KC292309.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccgggtgagctactatcccgccgaaaactcttactcccgctggagcggactcctgtctccttgcgatgcggactggcttggcatgctggtcgtgaaaaaggctaaaggctccgatatgattgttcccgggcctagctataagggaaaggtgtttttcgagagacccacctttgacggctacgtcgggtggggatgtggctctgggaaatcccggacagaaagcggagagctctgctcctctgatagcggcacgtccagcggcctgctgccttctgaccgcgtgctctggatcggggatgttgcctgtcaaccgatgacccccattcctgaagagacattcctggagcttaagtcctttagccagtctgagttccccgacatctgcaaaattgatggaatcgtgtttaatcagtgtgaaggcgaaagcctgcctcagcccttcgacgtcgcctggatggatgtggggcactcccataagatcattatgagagagcacaaaaccaagtgggtgcaagagtctagctccaaggactttgtctgctataaagaaggaacaggcccgtgtagcgagtctgaagagaagacctgcaaaacatccgggagctgccggggagacatgcagttctgtaaggttgctggctgcgaacacggcgaggaggcctctgaagctaaatgtcgctgctccctcgtgcataagcctggggaggtggtcgtgagctacggaggcatgagagttcggcccaaatgttacgggttttcccgcatgatggccaccctggaagtgaaccagcctgagcagagaatcggacaatgcacgggctgtcaccttgaatgcattaatgggggcgtccggctgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgcgaatttctgaagaacccccagtgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgagaaccgtctcctgtctcatgggcaagctgatggatcgggggagacaagtgattcatgaggaaatcggagagaaccgcgagggcaatcaggacgatgttcggattgaaatggccagaccccgccgggtgagacactggatgtatagccctgtcatccttacaattctggccatcgggctcgctgagtcttgcgacgaaatggtgcatgcggatagcaaactggtgtcctgtcgccagggaagcggcaacatgaaggagtgcgttacgaccgggcgggcccttctgcccgctgtcaatcctggccaggaggcctgtctccacttcacagcccccggatctccggactccaagtgcctgaaaatcaaggtgaaaagaattaacctgaagtgtaaaaagagctcctcttactttgtgcctgatgctcgcagccggtgcacctccgtcagacgctgtcggtgggccggcgactgccaatctgggtgtccccctcatttcacaagcaattccttttctgacgattgggcgggaaagatggacagagctggcctcgggttcagcggatgctccgatggctgcgggggcgccgcctgtggatgctttaacgctgcccccagctgtatcttctggcggaaatgggtggaaaatcctcacggcattatctggaaggtttctccctgcgctgcctgggtgccgtccgcggtcattgagctgaccatgcctagcggggaagtgcgcacgttccaccccatgtctggaatccccacacaggtttttaaaggcgtgtccgtcacctatcttgggagcgacatggaggtgtctggactgaccgatctctgtgaaatcgaggagctgagatccaagaaactggcccttgctccttgcaaccaggccggcatgggcgttgtggggaaggtcggagaaattcagtgtagctccgaggaaagcgctcggacaatcaaaaaggacggctgcatttggaacgccgatctcgtggggatcgagctgagagtggacgatgcggtctgttactctaagattaccagcgttgaagccgtggctaattattccgccatcccgacaacgatcggaggcctgcgcttcgagcggtctcatgacagccaagggaaaatttccggatctcccctcgatatcaccgctattagaggcagcttttccgtgaactaccgcggcctgagactttctctgagcgagatcacagctacctgcacaggggaagtcaccaatgtgtccggatgctacagctgtatgacgggcgccaaggtttctattaaactccactccagcaagaactctaccgcccatgtgcggtgcaaaggggacgagacagcgttctccgtcctggaaggagtgcacagctataccgtttccctgtcttttgatcacgccgtggtcgacgagcagtgtcagcttaattgcggcgggcatgaaagccaggtgacactcaagggaaacctgatcttcctggacgttcctaagtttgtggatggctcctacatgcaaacctatcacagcacggtccccacaggcgctaatatcccttctcccaccgactggctcaacgccctgttcgggaatggactttcccgctggattctgggcgtgatgggggtgctcctgggaggcctggccctgtttttcatgatcatgagcctctttaaactggggacaaagcaggtcttcagatctcggaccaaactggcttga

SEQ ID NO: 14873 - RNA, 3222 nt, synthetic construct
  misc_feature 1..3222: note = derived and/or modified CDS sequence (opt5) from SFTSV(HNXY_278)__KC292322.1__GP
  source 1..3222: mol_type = other RNA
atgatgaaggtgatctggttcagctccctgatttgcctcgtcatccagtgtggcggggacaccggacccattatctgcgccggccctacacactctaacaaaagcgctgatattccgcatctgcttgggtactccgagaagatctgtcaaatcgacagactgattcacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgatcgttcccggaccttcttataagggcaaggtgttctttgagcgccccacgttcgacgggtacgtcggatggggctgtgggtccggaaaaagcagaaccgaatctggcgagctgtgctccagcgattccggcacatctagcgggctgctcccttccgaccgggtgctgtggattggagatgttgcctgtcagccgatgacccccatccctgaagagacatttcttgagcttaagagcttctctcagtccgaatttcccgacatttgcaaaatcgatggcattgtgttcaatcagtgtgagggggaaagcctccctcaaccctttgacgtcgcctggatggatgtgggacactctcataagatcatcatgcgcgagcacaaaaccaagtgggtgcaggagagctcctctaaggacttcgtctgctataaagaaggcacagggccgtgtagcgagtccgaagagaagacctgcaaaacgggaggcagctgcagaggcgacatgcagttttgtaaggttgctgggtgcgaacacggagaggaggcctctgaagctaaatgtcggtgctccctggtgcataagcctggcgaggtggtcgtgagctacgggggaatgcgcgttagacccaaatgttacggcttctctcggatgatggccacccttgaagtgtcccagcctgagcaacgcattgggcagtgcacaggctgtcacctggaatgcatcaacggaggcgtcagactcattaccctgacaagcgagctgaagtccgcgaccgtgtgtgcctctcatttttgcagctccgctacgtctgggaagaaaagcacagagatccagttccactccggaagcctcgttggcaagaccgccattcacgtgaaaggggctctggtcgatggaacagagttcacctttgaaggctcttgtatgttccccgacgggtgcgatgccgtggactgcaccttttgtcgggagttccttaagaatccccaatgctatcctgcgaaaaagtggctgtttatcatcattgtcatcctcctgggctacgccggacttatgctgctcacaaacgtgctgaaggctattggcgtttgggggtcctgggtgatcgccccggtcaaactggtgttcgctattatcaagaaactcatgcgcgccgttagctgtctgatgggaaagctgatggatagaggcagacaggtgatccatgaagaaattggggagaatcgggagggaaaccaggacgatgtccgcatcgaaatggcccggcccagacgcgtgcggcactggatgtattctcctgtgattctgacgatcctcgctattggcctggcggaggggtgcgacgaaatgatccatgccgattccaaacttgttagctgtagacagggctctggaaatatgaaggagtgcgtcaccacaggccgcgctctgctccccgccgtgaaccctgggcaagaggcctgtctgcactttaccgctcccggaagcccggactccaagtgcctgaaaattaaggtgaaacggatcaatctcaagtgtaaaaagtctagctcctacttcgtccctgatgccagaagccgctgcacatccgtgcggagatgtcgctgggcgggcgactgccagtctgggtgtccccctcattttacccccaacagcttctccgacgattgggctggaaagatggaccgggccggcctggggttttctggctgcagcgatggatgcggcggggccgcttgtggatgcttcaatgccgctccttcctgtatcttttggagaaaatgggttgaaaacccccacggcattatctggaaggtgtctccgtgcgccgcgtgggtccctagcgccgtgattgagcttacgatgccctccggggaagttcggacattccaccccatgagcggaatccctacccaggtgttcaaaggcgtctctgtgacctatctgggctccgacatggaggttagcgggctcacagatctgtgtgaaattgaggagctgaagtctaaaaagctcgctcttgccccgtgcaatcaggctggaatgggcgtggtcgggaaagtgggagaaatccaatgttccagcgaggaatctgcccgcaccatcaagaaggacggctgcatttggaacgcggatctggtggggatcgagctgagagtcgacgatgccgtttgttactccaaaattacaagcgtggaagctgtggccaactattccgctatccccacgaccattggaggcctccggtttgagagaagccatgactctcagggcaagatcagcgggtcccctctggatatcacagccattcgcggatctttcagcgtcaattaccggggccttagactgtccctctctgagatcaccgccacatgcaccggggaagtgacgaacgttagcggatgctactcctgtatgaccggcgctaaagtgtctattaagctgcacagctccaaaaatagcacagcgcatgtccgctgcaagggggacgagaccgccttttctgtgctggaaggagttcactcctatagcgtgtctctttccttcgatcacgctgtcgtggacgagcagtgtcagctcaactgcggcggccatgaaagccaagttacactgagagggaatctgatctttctcgacgtgcccaagttcgtcgatggatcctacatgcagacctatcactctacggtgcctacaggcgccaacattcccagccctaccgactggctgaatgccctttttgggaacggactgtcccggtggatcctcggcgtgatcggggtcctgctgggaggccttgctctcttctttctgattatgagcctgttcaaactcggcacaaagcagatctttcgctctagaaccaaactggcctga

SEQ ID NO: 14874 - RNA, 3222 nt, synthetic construct
  misc_feature 1..3222: note = derived and/or modified CDS sequence (opt5) from SFTSV(HNXY_31)__KC292310.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgcgcaccgtctcctgtctcatgggcaagctgatggatagagggagacaggtgattcatgaggaaatcggagagaaccgggagggcaatcaggacgatgttcgcattgaaatggcccggcccagacgcgtgcggcactggatgtatagccctgtcatccttacaattctggccatcgggctcgctgagtcttgcgacgaaatggtgcatgcggatagcaaactggtgtcctgtagacagggaagcggcaacatgaaggagtgcgttacgaccgggcgcgcccttctgcccgctgtcaatcctggccaagaggcctgtctccacttcacagcccccggatctccggactccaagtgcctgaaaatcaaggtgaaacggattaacctgaagtgtaaaaagagctcctcttactttgtgcctgatgctagaagccgctgcacctccgtccggagatgtcgctgggccggcgactgccagtctgggtgtccccctcatttcacaagcaattccttttctgacgattgggcgggaaagatggaccgggctggcctcgggttcagcggatgctccgatggctgcgggggcgccgcctgtggatgctttaacgctgcccccagctgtatcttctggagaaaatgggtggaaaatcctcacggcattatctggaaggtttctccctgcgctgcctgggtgccgtccgcggtcattgagctgaccatgcctagcggggaagtgcggacgttccaccccatgtctggaatccccacacaggtttttaaaggcgtgtccgtcacctatcttgggagcgacatggaggtgtctggactgaccgatctctgtgaaatcgaggagctgaagtccaaaaagctggcccttgctccttgcaaccaggccggcatgggcgttgtggggaaagtcggagaaattcaatgtagctccgaggaaagcgctcgcacaatcaagaaggacggctgcatttggaacgccgatctcgtggggatcgagctgagagtggacgatgcggtctgttactctaaaattaccagcgttgaagccgtggctaattattccgccatcccgacaacgatcggaggcctgcggttcgagagatctcatgacagccaggggaagatttccggatctcccctcgatatcaccgctattcgcggcagcttttccgtgaactaccggggcctgagactttctctgagcgagatcacagctacctgcacaggggaagtcaccaatgtgtccggatgctacagctgtatgacgggcgccaaagtttctattaagctccactccagcaaaaactctaccgcccatgtgcgctgcaagggggacgagacagcgttctccgtcctggaaggagtgcacagctattccgtttctctgagctttgatcacgccgtggtcgacgagcagtgtcagcttaattgcggcgggcatgaatcccaagtgaccctcagaggaaacctgatcttcctggacgttcctaagtttgtggatggcagctacatgcagacatatcactctaccgtccccacgggcgctaatatcccttcccccacagactggctcaacgccctgttcgggaatggacttagccggtggattctgggcgtgatcggggtgctcctgggaggcctggccctgtttttcatgattatgtctctctttaaactggggaccaagcaggtcttccgcagcagaacaaaactggcttga

SEQ ID NO: 14875 - RNA, 3222 nt, synthetic construct
  misc_feature 1..3222: note = derived and/or modified CDS sequence (opt5) from SFTSV/FTLSV(2011YGS5)__KF711925.1__GP
  source 1..3222: mol_type = other RNA
atgatgaaggtgatctggttcagctccctggtctgcctcgttattcagtgttctggcgacagcgggcccatcatttgcgccggacctatccactccaacaaatctgctgccattccgcatctgcttggctacagcgagaagatctgtcaaatcgatagactgattcacgtgtcctcttggctccggaatcatagccagtttcaggggtatgtgggacagcgcggcgggagatcccaagtcagctactatcccgcggaaaactcttactcccggtggagcggactgctttctccttgcgacgctgattggctgggcatgctcgtggttaaaaaggccaaaggctccgacatgatcgtgcccgggcctagctataagggaaaggtcttctttgagcgccccaccttcgatggctacgtggggtggggatgtggctctgggaaatccagaacagaaagcggagagctgtgctcctctgacagcggcacgtccagcggcctgctcccttctgatcgggttctgtggattggggacgtggcctgtcagccgatgacccccatccctgaagagacatttcttgagctgaagtccttcagccagtctgaatttcccgatatttgcaaaatcgacggaattgtcttcaatcagtgtgagggcgaaagcctccctcaaccctttgatgtggcttggatggacgtggggcactcccataagatcatcatgcgcgagcacaaaaccaagtgggtccaggagtctagctccaaggatttcgtttgctataaagaaggaacaggcccgtgtagcgagtctgaagagaaggcctgcaaaacctccgggagctgcagaggagacatgcagttttgtaaggtggctggctgcgaacacggcgaggaggcctctgaagcgaaatgtcggtgctccctggtgcataagcctggggaggtcgtggttagctacggaggcatgcgcgtgagacccaaatgttacgggttctcccggatgatggccacaatggaagtcaaccctcccgagcagcgcattggacaatgcaccggctgtcaccttgaatgcatcaatgggggcgtgagactgattacgctcacctctgagctgaagtccgctacagtttgtgcctcccatttttgctctagcgctacctccggaaagaaaagcacagagatccacttccactctggctccctggtggggaagaccgccattcatgtcaaaggagcgctcgtggacggcacggaatttacatttgaggggagctgtatgttccccgatggatgcaacgccgtcgactgcaccttttgtcgggagttcctgaagaatcctcagtgctatccggctaaaaagtggctttttatcatcattgtgatcctgctcggctacgccgggctgatgcttctgacaaacgttctcaaggctattggcgtgtggggatcttgggtcatcgcccccgtgaaactgatgttcgccattatgaagaaactgatgcgcaccgtttcctgtctcgtgggcaagctgatggatagagggcggcaggtcatccacgaagaaatcggagagaatggcgaggggaaccatgacgatgtgagaattgaaatggctcgccctcggagagtgcgccactggatgtatagccccgttatccttaccattctggcgatcggactcgccgagggctgcgacgaaatggtccatgctgattctaaactggtgagctgtcggcaagggtccggcaatatgaaggagtgcgtgacaacggggagagcccttctgcctgccgtcaaccccggccaggaggcttgtctccactttaccgccccggggagccctgactctaagtgcctgaaaattaaggtgaaacgcatcaatctgaagtgtaaaaagtccagctcctacttcgttcccgatgcgcggaacagatgcacatctgtgcgccggtgtagatgggctggagactgccagagcggctgccctccccactttacctccaattctttcagcgatgactgggccgggaagatggaccgcgccggactcggcttttccgggtgttctgatggctgcggaggcgctgcctgtgggtgcttcaacgctgcccctagctgtattttctggcggaaatgggtcgaaaactcccatggaatcatctggaaggtgagcccctgcgcggcctgggttccgtctgctgtgattgagctgacaatgccttccggcgaagtcagaaccttccaccccatgagcgggatccccacacaggtgttcaaaggagtttctgtgacgtatcttggctccgacatggaggtcagcggcctgaccgatctctgtgaaattgaggagctgaagtctaaaaagctggcccttgctccttgcaatcaagccgggatgggagtggtgggcaaagtcggggaaatccagtgttccagcgaggaatccgcgcggaccattaagaaggacggatgcatctggaacgccgatctcgttggcatcgagctgcgcgtggacgatgctgtgtgttacagcaaaattacatctgtcgaagccgtggctaattatagcgccatcccgaccacaattgggggactgagatttgagcggtcccatgactctcagggcaagatcagcggcagccccctcgatattacggccatcagagggtctttcagcgttaactaccgcggactgcggctttccctgtctgagatcaccgctacatgcaccggcgaagtgacaaatgtcagcgggtgctactcctgtatgaccggagcgaaagtgagcattaagctccactcttccaaaaacagcacggcccacgttagatgcaagggcgacgagaccgctttttctgtgctggaaggggtccattcctatacagtgagcctgtccttcgatcacgccgttgtggacgagcagtgtcaacttaattgcggaggccatgaatctcaggtcaccctcaagggcaacctgatctttctggatgtgcctaaattcgtggacgggagctacatgcagacatatcactccaccgtccccacgggagccaatattcctagccccacagactggctcaacgctctgtttggcaatgggctttctcgctggatcctgggagttattggcgtgctcctgggaggactggcccttttctttctcatcatgttcctgtttaagctgggcaccaaacaggtgttcagatcccggacaaagctcgcgtga

SEQ ID NO: 14876 - RNA, 3222 nt, synthetic construct
  misc_feature 1..3222: note = derived and/or modified CDS sequence (opt5) from SFTSV/FTLSV(2011YGS7)__KF711922.1__GP
  source 1..3222: mol_type = other RNA
atgatgaaggtgatctggttcagctccctggtctgcctcgttattcagtgttctggcgacagcgggcccatcatttgcgccggacctatccactccaacaaatctgctgccattccgcatctgcttggctacagcgagaagatctgtcaaatcgatagactgattcacgtgtcctcttggctccggaatcatagccagtttcaggggtatgtgggacagcgcggcgggagatcccaagtcagctactatcccgcggaaaactcttactcccggtggagcggactgctttctccttgcgacgctgattggctgggcatgctcgtggttaaaaaggccaaaggctccgacatgatcgtgcccgggcctagctataagggaaaggtcttctttgagcgccccaccttcgatggctacgtggggtggggatgtggctctgggaaatccagaacagaaagcggagagctgtgctcctctgacagcggcacgtccagcggcctgctcccttctgatcgggttctgtggattggggacgtggcctgtcagccgatgacccccatccctgaagagacatttcttgagctgaagtccttcagccagtctgaatttcccgatatttgcaaaatcgacggaattgtcttctatcagtgtgagggcgaaagcctccctcaaccctttgatgtggcttggatggacgtggggcactcccataagatcatcatgcgcgagcacaaaaccaagtgggtccaggagtctagctccaaggatttcgtttgctacaaagaaggaacaggcccgtgtagcgagtctgaagagaaggcctgcaaaacctccgggagctgcagaggagacatgcagttttgtaaggtggctggctgcgaacacggcgaggaggcctctgaagcgaaatgtcggtgctccctggtgcataagcctggggaggtcgtggttagctacggaggcatgcgcgtgagacccaaatgttatgggttctcccggatgatggccacaatggaagtcaatcctcccgagcagcgcattggacaatgcaccggctgtcaccttgaatgcatcaacgggggcgtgagactgattacgctcacctctgagctcaagagcgctacagtttgtgcctcccatttttgctctagcgctacctccggaaagaaaagcacagagatccacttccactctggctccctggtggggaagaccgccattcatgtcaaaggagcgctggtggacggcacggaatttacatttgaggggagctgtatgttccccgatggatgcaatgccgtcgactgcaccttttgtcgggagttcctgaagaaccctcagtgctacccggctaaaaagtggctttttatcatcattgtgatcctgctcggctatgccgggctgatgcttctgacaaatgttctcaaggctattggcgtgtggggatcttgggtcatcgcccccgtgaaactgatgttcgccattatgaagaaactgatgcgcaccgtttcctgtctcgtgggcaagctgatggatagagggcggcaggtcatccacgaagaaatcggagagaacggcgaggggaatcatgacgatgtgagaattgaaatggctcgccctcggagagtgcgccactggatgtacagccccgttatccttaccattctggcgatcggactcgccgagggctgcgacgaaatggtccatgctgattctaaactggtgagctgtcggcaagggtccggcaacatgaaggagtgcgtgacaacggggagagcccttctgcctagcgtcaatcccggccaggaggcctgtctccactttaccgctccggggtctcctgactccaagtgcctgaaaattaaggtgaaacgcatcaacctgaagtgtaaaaagagctcctcttatttcgttcccgatgcccggaatagatgcacaagcgtgcgccggtgtagatgggcgggagactgccagtccggctgccctccccactttacctctaacagcttctccgatgactgggctgggaagatggaccgcgccggactcggcttttctgggtgtagcgatggctgcggaggcgccgcttgtgggtgcttcaatgccgctccttcctgtattttctggcggaaatgggtcgaaaacagccatggaatcatctggaaggtgtctccctgcgccgcgtgggttccgtccgccgtgattgagctgacaatgcctagcggcgaagtcagaaccttccaccccatgtctgggatccccacacaggtgttcaaaggagtttccgtgacgtaccttggcagcgacatggaggtctctggcctgaccgatctctgtgaaattgaggagctgaagtccaaaaagctggctcttgccccttgcaaccaagctgggatgggagtggtgggcaaagtcggggaaatccagtgtagctccgaggaaagcgcccggaccattaagaaggacggatgcatctggaatgcggatctcgttggcatcgagctgcgcgtggacgatgccgtgtgttattctaaaattacaagcgtcgaagctgtggccaactactccgctatcccgaccacaattgggggactgagatttgagcggtctcatgacagccagggcaagatctccggctctcccctcgatattacggccatcagagggagcttctccgttaattaccgcggactgcggctttctctgagcgagatcaccgccacatgcaccggcgaagtgacaaacgtctccgggtgctatagctgtatgaccggagctaaagtgtctattaagctccactccagcaaaaattctacggcgcacgttagatgcaagggcgacgagaccgccttttccgtgctggaaggggtccatagctacacagtgtccctgtctttcgatcacgctgttgtggacgagcagtgtcaacttaactgcggaggccatgaaagccaggtcaccctcaagggcaatctgatctttctggatgtgcctaaattcgtggacgggtcctatatgcagacataccacagcaccgtccccacgggagccaacattccttctcccacagactggctcaatgccctgtttggcaacgggctttcccgctggatcctgggagttattggcgtgctcctgggaggactggctcttttctttctcatcatgttcctgtttaagctgggcaccaaacaggtgttcagaagccggacaaagctcgcctga

SEQ ID NO: 14877 - RNA, 3222 nt, synthetic construct
  misc_feature 1..3222: note = derived and/or modified CDS sequence (opt5) from SFTSV/FTLSV(2011YPQ11)__KF711926.1__GP
  source 1..3222: mol_type = other RNA
atgatgaaggtgatctggttcagctccctggtctgcctcgttattcagtgttctggcgacagcgggcccatcatttgcgccggacctatccactccaacaaatctgctgccattccgcatctgcttggctacagcgagaagatctgtcaaatcgatagactgattcacgtgtcctcttggctccggaatcatagccagtttcaggggtatgtgggacagcgcggcgggagatcccaagtcagctactatcccgcggaaaactcttactcccggtggagcggactgctttctccttgcgacgctgattggctgggcatgctcgtggttaaaaaggccaaaggctccgacatgatcgtgcccgggcctagctataagggaaaggtcttctttgagcgccccaccttcgatggctacgtggggtggggatgtggctctgggaaatccagaacagaaagcggagagctgtgctcctctgacagcggcacgtccagcggcctgctcccttctgatcgggttctgtggattggggacgtggcctgtcagccgatgacccccatccctgaagagacatttcttgagctgaagtccttcagccagtctgaatttcccgatatttgcaaaatcgacggaattgtcttcaatcagtgtgagggcgaaagcctccctcaaccctttgatgtggcttggatggacgtggggcactcccataagatcatcatgcgcgagcacaaaaccaagtgggtccaggagtctagctccaaggatttcgtttgctataaagaaggaacaggcccgtgtagcgagtctgaagagaaggcctgcaaaacctccgggagctgcagaggagacatgcagttttgtaaggtggctggctgcgaacacggcgaggaggcctctgaagcgaaatgtcggtgctccctggtgcataagcctggggaggtcgtggttagctacggaggcatgcgcgtgagacccaaatgttacgggttctcccggatgatggccacaatggaagtcaaccctcccgagcagcgcattggacaatgcaccggctgtcaccttgaatgcatcaatgggggcgtgagactgattacgctcacctctgagctcaagagcgctacagtttgtgcctcccatttttgctctagcgctacctccggaaagaaaagcacagagatccacttccactctggctccctggtggggaagaccgccattcatgtcaaaggagcgctggtggacggcacggaatttacatttgaggggagctgtatgttccccgatggatgcaacgccgtcgactgcaccttttgtcgggagttcctgaagaatcctcagtgctatccggctaaaaagtggctttttatcatcattgtgatcctgctcggctacgccgggctgatgcttctgacaaacgttctcaaggctattggcgtgtggggatcttgggtcatcgcccccgtgaaactgatgttcgccattatgaagaaactgatgcgcaccgtttcctgtctcgtgggcaagctgatggatagagggcggcaggtcatccacgaagaaatcggagagaatggcgaggggaaccatgacgatgtgagaattgaaatggctcgccctcggagagtgcgccactggatgtatagccccgttatccttaccattctggcgatcggactcgccgagggctgcgacgaaatggtccatgctgattctaaactggtgagctgtcggcaagggtccggcaatatgaaggagtgcgtgacaacgggcagagcccttctgcctagcgtcaaccccggacaggaggcctgtctccactttaccgctccggggtctcctgactccaagtgcctgaaaattaaggtgaaacgcatcaatctgaagtgtaaaaagagctcctcttacttcgttcccgatgcccggtatagatgcacaagcgtgcgccggtgtccttgggcgggagactgccagtccggctgtccccctcactttacctctaacagcttctccgatgactgggctgggaagatggacagagccggactcggcttttctgggtgcagcgatggctgcggaggcgccgcttgtgggtgcttcaatgccgctccctcctgtattttctggcgcaaatgggtcgaaaacagccatggaatcatctggaaggtgtctccgtgcgccgcgtgggttccttccgccgtgattgagctgacaatgcccagcggcgaagtccggaccttccaccccatgtctgggatccctacacaggtgttcaaaggagtttccgtgacgtaccttggcagcgacatggaggtctctggcctgaccgatctctgtgaaattgaggagctgaagtccaaaaagctggctcttgccccgtgcaaccaagctgggatgggagtggtgggcaaagtcggggaaatccagtgtagctccgaggaaagcgccagaaccattaagaaggacggatgcatctggaatgcggatctcgttggcatcgagctgcgggtggacgatgccgtgtgttattctaaaattacaagcgtcgaagctgtggccaactactccgctatccccaccacaattgggggactgcgctttgagagatctcatgacagccagggcaagatctccggctctcctctcgatattacggccatccgggggagcttctccgttaattacagaggactgcgcctttctctgagcgagatcaccgccacatgcaccggcgaagtgacaaacgtctccgggtgctatagctgtatgaccggagctaaagtgtctattaagctccactccagcaaaaattctacggcgcacgttcggtgcaagggcgacgagaccgccttttccgtgctggaaggggtccatagctacacagtgtccctgtctttcgatcacgctgttgtggacgagcagtgtcaacttaactgcggaggccatgaaagccaggtcaccctcaagggcaatctgatctttctggatgtgcccaaattcgtggacgggtcctatatgcagacataccacagcaccgtccctacgggagccaacattccctctcctacagactggctcaatgccctgtttggcaacgggatgtccagatggatccttggagttattggcgtgctgctcgggggactggctctgttctttcttatcatgttcctctttaagctgggcaccaaacaggtgttccgcagcagaacaaagctggcctga

SEQ ID NO: 14878 - RNA, 3222 nt, synthetic construct
  misc_feature 1..3222: note = derived and/or modified CDS sequence (opt5) from SFTSV/FTLSV(2011YPQ12)__KF711930.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctaatcgggtgctctggatcggggacgttgcctgtcagccgatgacccccattcctgaagagacattcctggagcttaagtcctttagccagtctgaatttcccgatatctgcaaaattgacggaatcgtgtttaaccagtgtgagggcgaaagcctgcctcaacccttcgatgtcgcctggatggacgtggggcactcccataagatcattatgcgcgagcacaaaaccaagtgggtgcaggagtctagctccaaggattttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgtctcagcctgagcaacgcatcggacagtgcacgggctgtcaccttgaatgcattaatgggggcgtcagactgatcaccctcacaagcgagctgaagtccgcgaccgtgtgtgcctctcatttctgcagctccgctacaagcggaaagaaatctaccgagattcagttccactccggcagcctggttgggaagacggccatccacgtgaaaggagctctcgtcgacggcacagaatttaccttcgaggggtcttgtatgtttcccgatggatgcgacgccgtggattgcacattctgtcgggaatttctgaagaacccccaatgctatcctgcgaaaaagtggcttttcatcattatcgtcattctgctcggctacgccgggctgatgcttctgaccaatgtgctcaaggctatcggcgtttggggatcctgggtgattgccccggtcaaactggtgtttgctatcatcaagaaactgatgcgcgccgttagctgtctcatgggcaagctgatggacagagggagacaggtgattcatgaggaaatcggagagaaccgggagggcaatcaggatgacgtccgcattgaaatggcccggcccagacgcgtgcggcactggatgtattctcctgtgatccttaccattctggctatcgggctcgcggagggatgcgatgaaatggttcatgccgacagcaaactggtctcctgtagacagggcagcgggaacatgaaggagtgcgtgacaacgggccgcgcccttctgcccgctgtgaatcctggacaagaggcctgtctccacttcaccgctcccggctctccggattccaagtgcctgaaaattaaggtcaaacggatcaacctgaagtgtaaaaagagctcctcttactttgtgcctgttgccagatatcgctgcacaagcgtgcggagatgtcgctgggcgggggactgccagtccggatgtccccctcatttcacctctaatagcttttccgatgactgggctggcaagatggaccgggccgggctcggattctctggctgcagcgatgggtgcggcggagccgcttgtggctgctttaacgccgctccctcctgtatcttctggagaaaatgggtcgaaaatcctcacgggattatctggaaggtgagcccctgcgccgcgtgggttccgtctgccgtgattgagctgacaatgccttccggagaagtccggaccttccaccccatgagcggcatccccacacaggtgtttaaaggggtttctgtgacgtaccttggatccgacatggaggtcagcggcctgaccgatctctgtgaaattgaggagctgaagtctaaaaagctggctcttgccccttgcaaccaggctggcatgggggtggtgggaaaagtcggcgaaatccaatgttccagcgaggaatccgcccgcaccatcaagaaggacgggtgcatttggaacgcggatctcgttggaatcgagctgagagtggacgatgccgtgtgttatagcaaaattacatctgtcgaagctgtggccaattacagcgctatcccgaccacaattggcgggctgcggttcgagagatcccatgactctcagggaaagatcagcggctctcccctcgatatcacggccattcgcggctcctttagcgttaactaccgggggctgagactttccctgtctgagatcaccgccacatgcaccggagaagtgacaaatgtcagcggctgctattcctgtatgaccggggctaaagtgagcattaagctccactcttccaaaaacagcacggcgcatgttcgctgcaagggagacgagaccgccttctctgtgctggaaggcgtccactcctacagcgtgtccctgtcttttgatcacgctgttgtggacgagcagtgtcagcttaattgcgggggacatgaaagccaagtcacactcagaggcaacctgatcttcctggatgtgcctaagtttgtggacggctcctatatgcagacctaccacagcacagtccccaccggggccaatattccttctcccacggactggctcaacgccctgttcggaaatggcctttcccggtggatcctgggggttatcggagtgctcctgggcgggctggctcttttcttcctcattatgagcctgtttaaactgggaacaaagcagatcttccgctctagaaccaaactcgcctga

SEQ ID NO: 14879 - RNA, 3222 nt, synthetic construct
  misc_feature 1..3222: note = derived and/or modified CDS sequence (opt5) from SFTSV/FTLSV(2011YPQ17)__KF711923.1__GP
  source 1..3222: mol_type = other RNA
atgatgaaggtgatctggttcagctccctggtctgcctcgttattcagtgttctggcgacagcgggcccatcatttgcgccggacctatccactccaacaaatctgctgccattccgcatctgcttggctacagcgagaagatctgtcaaatcgatagactgattcacgtgtcctcttggctccggaatcatagccagtttcaggggtatgtgggacagcgcggcgggagatcccaagtcagctactatcccgcggaaaactcttactcccggtggagcggactgctttctccttgcgacgctgattggctgggcatgctcgtggttaaaaaggccaaaggctccgacatgatcgtgcccgggcctagctataagggaaaggtcttctttgagcgccccaccttcgatggctacgtggggtggggatgtggctctgggaaatccagaacagaaagcggagagctgtgctcctctgacagcggcacgtccagcggcctgctcccttctgatcgggttctgtggattggggacgtggcctgtcagccgatgacccccatccctgaagagacatttcttgagctgaagtccttcagccagtctgaatttcccgatatttgcaaaatcgacggaattgtcttcaatcagtgtgagggcgaaagcctccctcaaccctttgatgtggcttggatggacgtggggcactcccataagatcatcatgcgcgagcacaaaaccaagtgggtccaggagtctagctccaaggatttcgtttgctataaagaaggaacaggcccgtgtagcgagtctgaagagaaggcctgcaaaacctccgggagctgcagaggagacatgcagttttgtaaggtggctggctgcgaacacggcgaggaggcctctgaagcgaaatgtcggtgctccctggtgcataagcctggggaggtcgtggttagctacggaggcatgcgcgtgagacccaaatgttacgggttctcccggatgatggccacaatggaagtcaaccctcccgagcagcgcattggacaatgcaccggctgtcaccttgaatgcatcaatgggggcgtgagactgattacgctcacctctgagcttaagagcgctacagtttgtgcctcccatttttgctctagcgctacctccggaaagaaaagcacagagatccacttccactctggctccctggtggggaagaccgccattcatgtcaaaggagcgctcgtggacggcacggaatttacatttgaggggagctgtatgttccccgatggatgcaacgccctggactgcaccttttgtcgggagttccttaagaatcctcactgctatccggctaaaaagtggctgtttatcatcattgtcatcctcctgggctacgccgggcttatgctgctcacaaacgtgctgaaggctattggcgtttggggatcttgggtgatcgcccccgtcaaactgatgttcgccattatgaagaaactcatgcgcaccgtgtcctgtctggttggcaagctgatggatagagggagacaggtgatccatgaagaaatcggagagaatggcgaggggaaccacgacgatgtcagaattgaaatggctcgccctcggagagtgcgccattggatgtatagccccgtgatcctgaccattctcgcgatcggactggccgagggctgcgacgaaatggttcacgctgattctaaacttgtcagctgtcggcaggggtccggcaatatgaaggagtgcgtgacaacgggacgggccctgctccctagcgtgaaccccggccaagaggcctgtctgcactttaccgctccggggtctcctgactccaagtgcctgaaaattaaggtcaaacgcatcaatctcaagtgtaaaaagagctcctcttacttcgtgcccgatgcccggaacagatgcacaagcgttcgccggtgtagatgggcgggagactgccagtccggctgccctccccattttacctctaatagcttctccgatgactgggctgggaagatggaccgcgccggactgggcttttctgggtgtagcgatggctgcggaggcgccgcttgtgggtgcttcaacgccgctccttcctgtattttctggcggaaatgggtggaaaacagccacggaatcatctggaaggtctctccctgcgccgcgtgggtgccgtccgccgttattgagcttacaatgcctagcggcgaagtgagaaccttccatcccatgtctgggatccccacgcaggtcttcaaaggagtgtccgttacatatctgggcagcgacatggaggtgtctggcctcaccgatctgtgtgaaattgaggagctgaagtccaaaaagctggctctcgccccttgcaatcaggctgggatgggagtcgtgggcaaagtgggggaaatccaatgtagctccgaggaaagcgcccggaccattaagaaggacggatgcatctggaacgcggatctggtcggcatcgagctgcgcgttgacgatgccgtgtgttactctaaaattacaagcgtggaagctgtcgccaattattccgctatcccgaccacaattgggggactcagatttgagcggtctcacgacagccagggcaagatctccggctctcccctggatattacggccatcagagggagcttctccgtgaactaccgcggacttcggctgtctctcagcgagatcaccgccacatgcaccggcgaagttacaaatgtgtccgggtgctacagctgtatgaccggagctaaagtctctattaagctgcactccagcaaaaactctacggcgcatgtgagatgcaagggcgacgagaccgccttttccgttctggaaggggtgcacagctatacagtctccctttctttcgatcatgctgtggttgacgagcagtgtcagctcaattgcggaggccacgaaagccaagtgaccctgaagggcaacctgatctttctcgatgtccctaaattcgtggacgggtcctacatgcagacatatcatagcaccgtgcccacgggagccaatattccttctcccacagactggctgaacgccctttttggcaatgggctgtcccgctggatcctcggagtcattggcgttctgcttgggggacttgctctcttctttctgatcatgttcctgtttaagctcggcaccaaacaggtgttcagaagccggacaaagctggcctga

SEQ ID NO: 14880 - RNA, 3222 nt, synthetic construct
  misc_feature 1..3222: note = derived and/or modified CDS sequence (opt5) from SFTSV/FTLSV(2011YSC22)__KF711927.1__GP
  source 1..3222: mol_type = other RNA
atgatgaaggtgatctggttcagctccctggtctgcctcgttattcagtgttctggcgacagcgggcccatcatttgcgccggacctatccactccaacaaatctgctgccattccgcatctgcttggctacagcgagaagatctgtcaaatcgatagactgattcacgtgtcctcttggctccggaatcatagccagtttcaggggtatgtgggacagcgcggcgggagatcccaagtcagctactatcccgcggaaaactcttactcccggtggagcggactgctttctccttgcgacgctgattggctgggcatgctcgtggttaaaaaggccaaaggctccgacatgatcgtgcccgggcctagctataagggaaaggtcttctttgagcgccccaccttcgatggctacgtggggtggggatgtggctctgggaaatccagaacagaaagcggagagctgtgctcctctgacagcggcacgtccagcggcctgctcccttctgatcgggttctgtggattggggacgtggcctgtcagccgatgacccccatccctgaagagacatttcttgagctgaagtccttcagccagtctgaatttcccgatatttgcaaaatcgacggaattgtcttcaatcagtgtgagggcgaaagcctccctcaaccctttgatgtggcttggatggacgtggggcactcccataagatcatcatgcgcgagcacaaaaccaagtgggtccaggagtctagctccaaggatttcgtttgctataaagaaggaacaggcccgtgtagcgagtctgaagagaaggcctgcaaaacctccgggagctgcagaggagacatgcagttttgtaaggtggctggctgcgaacacggcgaggaggcctctgaagcgaaatgtcggtgctccctggtgcataagcctggggaggtcgtggttagctacggaggcatgcgcgtgagacccaaatgttacgggttctcccggatgatggccacaatggaagtcaaccctcccgagcagcgcattggacaatgcaccggctgtcaccttgaatgcatcaatgggggcgtgagactgattacgctcacctctgagctcaagagcgctacagtttgtgcctcccatttttgctctagcgctacctccggaaagaaaagcacagagatccacttccactctggctccctggtggggaagaccgccattcatgtcaaaggagcgctggtggacggcacggaatttacatttgaggggagctgtatgttccccgatggatgcaacgccgtcgactgcaccttttgtcgggagttcctgaagaatcctcagtgctatccggctaaaaagtggctttttatcatcattgtgatcctgctcggctacgccgggctgatgcttctgacaaacgttctcaaggctattggcgtgtggggatcttgggtcatcgcccccgtgaaactgatgttcgccattatgaagaaactgatgcgcaccgtttcctgtctcgtgggcaagctgatggatagagggcggcaggtcatccacgaagaaatcggagagaatggcgaggggaaccatgacgatgtgagaattgaaatggctcgccctcggagagtgcgccactggatgtatagccccgttatccttaccattctggcgatcggactcgccgagggctgcgacgaaatggtccatgctgattctaaactggtgagctgtcggcaagggtccggcaatatgaaggagtgcgtgacaacgggcagagcccttctgcctagcgtcaaccccggacaggaggcctgtctccactttaccgctccggggtctcctgactccaagtgcctgaaaattaaggtgaaacgcatcaatgttaagtgtaaaaagagctcctcttacttcgtgcccgatgcccggaacagatgcacaagcgtccgccggtgtagatgggcgggagactgccagtccggctgccctccccactttacctctaatagcttctccgatgactgggctgggaagatggaccgcgccggactgggcttttctgggtgtagcgatggctgcggaggcgccgcttgtgggtgcttcaacgccgctccttcctgtattttctggcggaaatgggtggaaaacagccatggaatcatctggaaggtttctccctgcgccgcgtgggtgccgtccgccgtcattgagctcacaatgcctagcggcgaagtgagaaccttccaccccatgtctgggatccccacgcaggttttcaaaggagtgtccgtcacatatctgggcagcgacatggaggtgtctggccttaccgatctgtgtgaaattgaggagctcaagtccaaaaagctggctctggccccttgcaatcaagctgggatgggagtggtcggcaaagttggggaaatccagtgtagctccgaggaaagcgcccggaccattaagaaggacggatgcatctggaacgcggatcttgtgggcatcgagctccgcgtggacgatgccgtctgttactctaaaattacaagcgtggaagctgttgccaattattccgctatcccgaccacaattgggggactgagatttgagcggtctcatgacagccagggcaagatctccggctctcccctggatattacggccatcagagggagcttctccgtgaactaccgcggactccggctgtctcttagcgagatcaccgccacatgcaccggcgaagtcacaaatgtgtccgggtgctacagctgtatgaccggagctaaagtttctattaagctgcactccagcaaaaactctacggcgcacgtgagatgcaagggcgacgagaccgccttttccgtcctcgaaggggtgcatagctatacagtttccctgtctttcgatcacgctgtggtcgacgagcagtgtcaactgaattgcggaggccatgaaagccaggtgacccttaagggcaacctcatctttctggatgtgcctaaattcgtcgacgggtcctacatgcagacatatcacagcaccgttcccacgggagccaatattccttctcccacagactggctgaacgccctcctgggcaatgggatgtcccgctggatccttggagtgattggcgtgctgctcgggggactggctctgtttttccttatcatgtttctcttcaagctgggcaccaaacaggtctttagaagccggacaaagctggcctga

SEQ ID NO: 14881 - RNA, 3222 nt, synthetic construct
  misc_feature 1..3222: note = derived and/or modified CDS sequence (opt5) from SFTSV/FTLSV(2011YSC60)__KF711945.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagcttaagagcttctctcagtccgaatttcccgacatctgcaaaattgatggcatcgtgttcaatcagtgtgagggggaaagcctccctcaaccctttgacgtcgcctggatggatgtgggacactctcataagatcattatgcgcgagtataaaacaaagtgggtgcaggagagctcctctaaggacttcgtctgctacaaagaaggcaccgggccgtgtagcgagtccgaagagaagacatgcaaaaccagcggatcttgcagaggcgacatgcagttttgtaaggttgctggctgcgaacacggggaggaggcctccgaagctaaatgtcggtgcagcctggtgcacaagcctggagaggtggtcgtgtcttacggcgggatgcgcgttagacccaaatgttatggattctcccggatgatggccacgcttgaagtgaaccagcctgagcaacgcatcggccagtgcaccgggtgtcatctggaatgcattaatggcggagtcagactcatcacactgaccagcgagctgaagtccgcgacagtgtgtgcctctcacttttgcagctccgctacctctggcaagaaaagcacggagattcagttccattccgggagcctcgttggaaagacagccatccacgtgaaaggcgctctggtcgatgggaccgagttcacatttgaaggatcttgtatgttccccgacggctgcgatgccgtggactgcaccttttgtcgggagttccttaagaacccccaatgctaccctgcgaaaaagtggctgtttatcattatcgtcattctcctggggtatgccggccttatgctgctcaccaatgtgctgaaggctatcggaatttggggctcctgggttatcgccccggtgaaactgatcttcgctattatcaagaaactcatgcgcacagtcagctgtctgatggggaagctgatggatagaggaagacaggtgattcacgaagaaatcggcgagaaccgggaggggaatcaggacgatgttcgcattgaaatggcccggcccagacgcgtgcggcattggatgtactctcctgtcatcctgacgattctcgccatcggactggctgagtcctgcgacgaaatggtgcacgcggatagcaaacttgtgtcttgtagacagggcagcgggaacatgaaggagtgcgttaccacaggccgcgccctgctccccgctgtcaatcctggacaagaggcctgtctgcattttaccgcccccggctccccggacagcaagtgcctgcggatcaaagtgaagagaattaacctcaaatgtaagaaatcttccagctatttcgtgcctgatgctcgcaatcggtgcacatccgtcagacgctgtcggtgggccggggactgccagtctggatgtccccctcactttaccagcaactccttctctgacgattgggcgggcaagatggacagagctgggctgggatttagcggctgctccgatgggtgcggcggagccgcctgtggctgcttcaatgctgccccctcttgtatcttttggcggaagtgggtggaaaaccctcatgggattatctggaaagttagcccctgcgctgcctgggtgccgtccgcggtcattgagcttacgatgcctagcggagaagtgcgcacattccaccccatgtctggcatccccacccaggttttcaagggggtgtccgtcacctacctgggaagcgacatggaggtgtctggcctcacagatctgtgtgaaatcgaggagctgaaatccaagaaacttgccctcgctccttgcaaccaggccggcatgggggttgtgggaaaggtcggcgaaattcaatgtagctctgaggaatccgctagaaccatcaaaaaggacgggtgcatttggaatgccgatctggtgggaatcgagctgcgggtggacgatgcggtctgttatagcaagattacatccgttgaagccgtggctaactacagcgccatcccgacgaccatcggcgggctcagatttgagcgctctcacgacagccagggaaaaatttccggctctcccctggatatcacagctattcggggcagcttctccgtgaattacagagggcttcgcctgtctctcagcgagatcaccgccacatgcaccggagaagtcacgaacgtgtccggctgctattcttgtatgaccggggccaaggttagcattaaactgcattccagcaaaaattctacagctcacgtgagatgcaagggagacgagaccgcgttttccgtcctggaaggcgtgcatagctacacagtttctctttccttcgatcacgccgtggtcgacgagcagtgtcagctcaactgcgggggacacgaaagccaagtgaccctgaagggcaatctgatctttctcgacgttcctaagttcgtggatggctcctatatgcagacgtaccattctacagtccccaccggggctaacatccctagccccacagactggctgaatgccctttttggaaacggcctgtcccggtgggtgctcggggtgatgggagtcctgctgggcgggcttgccctcttctttatgattatgagcctgttcaaactgggaaccaagcaggtttttcgctctagaaccaaactcgcttga

SEQ ID NO: 14882 - RNA, 3222 nt, synthetic construct
  misc_feature 1..3222: note = derived and/or modified CDS sequence (opt5) from SFTSV/FTLSV(2011YSH45)__KF711947.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgaatttcccgacatctgcaaaattgatggaatcgtgtttaatcagtgtgagggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagctgaagtccgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgcgcaccgtctcctgtctcatgggcaagctgatggatagagggagacaggtgattcatgaggaaatcggagagaaccgggagggcaatcaggacgatgttcgcattgaaatggcccggcccagacgcgtgcggcactggatgtatagccctgtcatccttacaattctggccatcgggctcgctgagtcttgcgacgaaatggtgcatgcggatagcaaactggtgtcctgtagacagggaagcggcaacatgaaggagtgcgttacgaccgggcgcgcccttctgcccgctgtcaatcctggccaagaggcctgtctccacttcacagcccccggatctccggactccaagtgcctgaaaatcaaggtgaaacggattaacctggaatgtaagaaaagctcctcttactttgtgcctgatgctagaaatcgctgcaccagcgtccggagatgtcgctgggccggcgactgccagtccgggtgtccccctcatttcacatctaacagcttttccgacgattgggcgggaaagatggaccgggctggcctcgggttctctggatgcagcgatggctgcgggggcgccgcctgtggatgctttaatgctgccccctcctgtatcttctggagaaagtgggtggagaaccctcacggcattatctggaaagttagcccctgcgctgcctgggtgccgtctgcggtcattgaactgaccatgccttccggggaggtgcggacgttccaccccatgagcggaatccccacacaggtttttaagggcgtgtctgtcacctatcttgggtccgacatggaagtgagcggactgaccgatctctgtgagatcgaggaactgaaatctaagaaactggcccttgctccttgcaaccaggccggcatgggcgttgtggggaaggtcggagagattcaatgttccagcgaagagtccgctcgcacaatcaaaaaggacggctgcatttggaatgccgatctcgtggggatcgaactgagagtggacgatgcggtctgttacagcaagattacctctgttgaggccgtggctaactatagcgccatcccgacaacgatcggaggcctgcggttcgagagatcccatgactctcaggggaaaattagcggaagccccctcgatatcaccgctattcgcggctcttttagcgtgaattaccggggcctgagactttccctgtctgaaatcacagctacctgcacaggggaggtcaccaacgtgagcggatgctactcctgtatgacgggcgccaaggttagcattaaactccactcttcccgcaatagcaccgcccatgtgagatgcaagggggacgaaacagcgttctctgtcctggagggagtgcactcctataccgttagcctgtcctttgatcacgccgtggtcgacgaacagtgtcagcttaactgcggcgggcatgagtctcaagtgacactcaaaggaaatctgatcttcctggacgttcctaagtttgtggatggcagctacatgcagacctatcactccacggtccccacaggcgctaacatccctagccccaccgactggctcaatgccctgttcgggaacggactttctcggtgggtgctgggcgtgatgggggtcctcctgggaggcctggcccttttcttcatgattatgtccctctttaagctggggacaaaacaggttttccgcagcagaaccaagctggcttga

SEQ ID NO: 14883 - RNA, 3222 nt, synthetic construct
  misc_feature 1..3222: note = derived and/or modified CDS sequence (opt5) from SFTSV/FTLSV(2011YSH52)__KF711928.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagcttaagagcttctctcagtccgaatttcccgacatctgcaaaattgatggcatcgtgttcaatcagtgtgagggggaaagcctccctcaaccctttgacgtcgcctggatggatgtgggacactctcataagatcattatgcgcgagcacaaaacaaagtgggtgcaggagagctcctctaaggacttcgtctgctataaagaaggcaccgggccgtgtagcgagtccgaagagaagacatgcaaaaccagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacgcttgaagtgagccagcctgagcaacgcatcggccagtgcaccgggtgtcacctggaatgcattaacggcggagtcagactcatcacactgacctccgagctgaagtctgcgacagtgtgtgccagccatttttgctcctctgctaccagcggcaagaaatccacggagattcagttccacagcgggtctctcgttggaaagacagccatccacgtgaaaggcgctctggtcgatgggaccgagttcacatttgaaggatcctgtatgttccccgacggctgcgatgccgtggactgcaccttttgtcgggagttccttaagaatccccaatgctatcctgcgaaaaagtggctgtttatcattatcgtcattctcctggggtacgccggcttcatgcttctgaccaacgtgctcaaggctatcggagtttggggcagctgggtgattgccccggtcaaactggtgtttgctatcatcaagaaactgatgcgcgccgtttcttgtctcatggggaagctgatggatagaggaagacaggtgattcatgaagaaatcggcgagaatcgggaggggaaccaggacgatgtccgcattgaaatggcccggcccagacgcgtgcggcactggatgtattcccctgtgatccttacaattctggctatcggactcgcggagggctgcgacgaaatggttcatgccgatagcaaactggtctcttgtagacaggggagcggcaatatgaaggagtgcgtgacgaccggacgcgctctgctgcccgccgtgaaccctggccaagaggcctgtctccacttcacagctcccgggtccccggacagcaagtgcctgaaaattaaggtcaaacggatcaataagaaatgtaagaagtcttccagctactttgtgcctgatgccagatatcgctgcacctccgttcggagatgtcgctgggcgggagactgccagtctggctgtccccctcatttcacaagcaactccttttctgacgattgggctgggaaaatggaccgggccggactgggcttcagcgggtgctccgatggctgcggaggcgccgcttgtgggtgctttaatgccgctccctcttgtatcttctggagaaagtgggtggaaaaccctcacggaattatctggaaagtcagcccctgcgccgcgtgggtgccgtccgccgttattgagctcaccatgcctagcggcgaagtgcggacgttccaccccatgtctgggatccccacacaggtctttaagggagtgtccgttacctacctgggcagcgacatggaggtgtctggcctttccgatctgtgtgaaattgaggagctcaatagcaaaaagctggctctggccccttgcaaccaggctgggatgggagtcgtgggcaaagtgggggaaatccaatgttcttccgaggaaagcgcccgcaccatcaagaaggacggatgcattagaaacgcggatcttgtcggcatcgaggttcgggtggacgatgccgtgttctattttaaaattacatccgtcgaagctgtggccaattacagcgctatcccgaccacaattgggggactcagattcgagcgctctcatgacagccagggcaagatctccggctctcccctggatatcacggccattcgggggagcttttccgttaactacagaggactgcgcctctctctgagcgagatcaccgccacatgtaccggcgaagtgacaaatgtctccgggtgctattcttgcatgaccggagctaaagtgagcattaagctgcactccagcaaaaactctacggcgcatgttagatgtaagggcgacgagaccgccttctccgtgctggaaggggtccacagctactctgtgtccctcagctttgatcacgctgttgtggacgagcagtgccagctgaattgtggaggccatgaatcccaagtcacactgcggggcaaccttatcttcctcgacgtgcctaagtttgtggatgggtcttatatgcagacctaccacagcacagtccccaccggagccaatattccttcccccacggactggctgaacgccctgttcggcaatgggctcagccgctggatcctgggagttatcggcgtgcttcttgggggactcgctctgtttttcctgattctttctctctttaaactgggcacaaagcagatcttcagatcccggaccaaactggcctga

SEQ ID NO: 14884 - RNA, 3222 nt, synthetic construct
  misc_feature 1..3222: note = derived and/or modified CDS sequence (opt5) from SFTSV/FTLSV(2011YXX9)__KF711924.1__GP
  source 1..3222: mol_type = other RNA
atgatgaaggtgatctggttcagctccctggtctgcctcgttattcagtgttctggcgacagcgggcccatcatttgcgccggacctatccactccaacaaatctgctgccattccgcatctgcttggctacagcgagaagatctgtcaaatcgatagactgattcacgtgtcctcttggctccggaatcatagccagtttcaggggtatgtgggacagcgcggcgggagatcccaagtcagctactatcccgcggaaaactcttactcccggtggagcggactgctttctccttgcgacgctgattggctgggcatgctcgtggttaaaaaggccaaaggctccgacatgatcgtgcccgggcctagctataagggaaaggtcttctttgagcgccccaccttcgatggctacgtggggtggggatgtggctctgggaaatccagaacagaaagcggagagctgtgctcctctgacagcggcacgtccagcggcctgctcccttctgatcgggttctgtggattggggacgtggcctgtcagccgatgacccccatccctgaagagacatttcttgagctgaagtccttcagccagtctgaatttcccgatatttgcaaaatcgacggaattgtcttcaatcagtgggagggcgaaagcctccctcaaccctttgatgtggcttggatggacgtggggcactcccataagatcatcatgcgcgagcacaaaaccaagtgggtccaggagtctagctccaaggatttcgtttgttataaagaaggaacaggcccgtgcagcgagtctgaagagaaggcctgtaaaacctccgggagctgcagaggagacatgcagttttgcaaggtggctggctgtgaacacggcgaggaggcctctgaagcgaaatgccggtgttccctggtgcataagcctggggaggtcgtggttagctacggaggcatgcgcgtgagacccaaatgctacgggttctcccggatgatggccacaatggaagtcaaccctcccgagcagcgcattggacaatgtaccggctgccaccttgaatgtatcaatgggggcgtgagactgattacgctcacctctgagctcaagagcgctacagtttgcgcctcccatttttgttctagcgctacctccggaaagaaaagcacagagatccacttccactctggctccctggtggggaagaccgccattcatgtcaaaggagcgctggtggacggcacggaatttacatttgaggggagctgcatgttccccgatggatgtaacgccgtcgactgcaccttttgccgggagttcctgaagaatcctcagtgttatccggctaaaaagtggctttttatcatcattgtgatcctgctcggctacgccgggctgatgcttctgacaaacgttctcaaggctattggcgtgtggggatcttgggtcatcgcccccgtgaaactgatgttcgccattatgaagaaactgatgcgcaccgtttcctgcctcgtgggcaagctgatggatagagggcggcaggtcatccacgaagaaatcggagagaatggcgaggggaaccatgacgatgtgagaattgaaatggctcgccctcggagagtgcgccactggatgtatagccccgttatccttaccattctggcgatcggactcgccgagggctgtgacgaaatggtccatgctgattctaaactggtgagctgccggcaagggtccggcaatatgaaggagtgtgtgacaacggggagagcccttctgcctagcgtcaaccccggccaggaggcctgcctccactttaccgctccggggtctcctgactccaagtgtctgaaaattaaggtgaaacgcatcaatctgaagtgcaaaaagagctcctcttacttcgttcccgatgcccggaacagatgtacaagcgtgcgccggtgcagatgggcgggagactgtcagtccggctgccctccccactttacctctaatagcttctccgatgactgggctgggaagatggaccgcgccggactcggcttttctgggtgcagcgatggctgtggaggcgccgcttgcgggtgtttcaacgccgctccttcctgcattttctggcggaaatgggtcgaaaacagccatggaatcatctggaaggtgtctccctgtgccgcgtgggttccgtccgccgtgattgagctgacaatgcctagcggcgaagtcagaaccttccaccccatgtctgggatccccacacaggtgttcaaaggagtttccgtgacgtatcttggcagcgacatggaggtctctggcctgaccgatctctgcgaaattgaggagctgaagtccaaaaagctggctcttgccccttgtaatcaagctgggatgggagtggtgggcaaagtcggggaaatccagtgcagctccgaggaaagcgcccggaccattaagaaggacggatgtatctggaacgcggatctcgttggcatcgagctgcgcgtggacgatgccgtgtgctactctaaaattacaagcgtcgaagctgtggccaattattccgctatcccgaccacaattgggggactgagatttgagcggtctcatgacagccagggcaagatctccggctctcccctcgatattacggccatcagagggagcttctccgttaactaccgcggactgcggctttctctgagcgagatcaccgccacatgtaccggcgaagtgacaaatgtctccgggtgctacagctgcatgaccggagctaaagtgtctattaagctccactccagcaaaaactctacggcgcacgttagatgtaagggcgacgagaccgccttttccgtgctggaaggggtccatagctatacagtgtccctgtctttcgatcacgctgttgtggacgagcagtgccaacttaattgtggaggccatgaaagccaggtcaccctcaagggcaacctgatctttctggatgtgcctaaattcgtggacgggtcctacatgcagacatatcacagcaccgtccccacgggagccaatattccttctcccacagactggctcaacgccctgtttggcaatgggctttcccgctggatcctgggagttattggcgtgctcctgggaggactggctcttttctttctcatcatgttcctgtttaagctgggcaccaaacaggtgttcagaagccggacaaagctcgcctga

SEQ ID NO: 14885 - RNA, 3222 nt, synthetic construct
  misc_feature 1..3222: note = derived and/or modified CDS sequence (opt5) from SFTSV/FTLSV(2012YGS10)__KF711937.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgcgcaccgtctcctgtctcatgggcaagctgatggatagagggagacaggtgattcatgaggaaatcggagagaaccgggagggcaatcaggacgatgttcgcattgaaatggcccggcccagacgcgtgcggcactggatgtatagccctgtcatccttacagtgctggccattgggctcgctgagtcttgcgacgaaatggtgcatgcggatagcaaactggtttcctgtagacagggaagcggcaacatgaaggagtgcgtcacgaccgggcgcgcccttctgcccgctgtgaatcctggccaagaggcctgtctccacttcacagcccccggatctccggactccaagtgcctgaaaatcaaggtgaaacggatcaacctgaagtgtaaaaagagctcctcttactttgtccctgatgctagaagccgctgcacctccgtgcggagatgtcgctgggccggcgactgccagtctgggtgtccccctcatttcacaagcaattccttttctgacgattgggcgggaaagatggaccgggctggcctcgggttcagcggatgctccgatggctgcgggggcgccgcctgtggatgctttaacgctgcccccagctgtattttctggagaaaatgggttgaaaatcctcacggcatcatttggaaggtgtctccctgcgctgcctgggtcccgtccgcggtgatcgagctgaccatgcctagcggggaagttcggacgttccaccccatgtctggcattcccacacaggtgtttaaaggagtctccgtgacctatcttgggagcgacatggaggtttctggactgaccgatctctgtgaaatcgaggagctgaagtccaaaaagctggcccttgctccttgcaaccaggccggcatgggcgtggtcgggaaagtgggagaaatccaatgtagctccgaggaaagcgctcgcacaattaagaaggacggctgcatctggaacgccgatctcgtggggattgagctgagagtcgacgatgcggtttgttactctaaaatcaccagcgtggaagccgtggctaattattccgccattccgacaacgatcggaggcctgcggttcgagagatctcatgacagccaggggaagatctccggatctcccctcgatattaccgctatccgcggcagcttttccgtcaactaccggggcctgagactttctctgagcgagattacagctacctgcacaggggaagtgaccaatgtttccggatgctacagctgtatgacgggcgccaaagtgtctatcaagctccactccagcaaaaactctaccgcccatgtccgctgcaagggggacgagacagcgttctccgtgctggaaggagttcacagctataccgtgtccctgtcttttgatcacgccgtcgtggacgagcagtgtcagcttaattgcggcgggcatgaaagccaagttacactcaagggaaacctgattttcctggacgtgcctaaatttgtcgatggctcctacatgcagacctatcacagcacggtgcccacaggcgctaatatcccttctcccaccgactggctcaacgccctgttcgggaatggactttccagatggatcctgggcgtgattggggtcctcctgggaggcctggccctgtttttcatgatcatgagcctctttaagctggggacaaaacaggttttccggtctcgcaccaagctggcttga

SEQ ID NO: 14886 - RNA, 3222 nt, synthetic construct
  misc_feature 1..3222: note = derived and/or modified CDS sequence (opt5) from SFTSV/FTLSV(2012YGS4)__KF711933.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgcgcaccgtctcctgtctcatgggcaagctgatggatagagggagacaggtgattcatgaggaaatcggagagaaccgggagggcaatcaggacgatgttcgcattgaaatggcccggcccagacgcgtgcggcactggatgtatagccctgtcatccttacaattctggccatcgggctcgctgagtcttgcgacgaaatggtgcatgcggatagcaaactggtgtcctgtagacagggaagcggcaacatgaaggagtgcgttacgaccgggcgcgcccttctgcccgctgtcaatcctggccaagaggcctgtctccacttcacagcccccggatctccggactccaagtgcctgaaaatcaaggtgaaacggattaacctgaagtgtaaaaagagctcctcttactttgtgcctgatgctagaagccgctgcacctccgtccggagatgtcgctgggccggcgactgccagtctgggtgtccccctcatttcacaagcaattccttttctgacgattgggcgggaaagatggaccgggctggcctcgggttcagcggatgctccgatggctgcgggggcgccgcctgtggatgctttaacgctgcccccagctgtatcttctggagaaaatgggtggaaaatcctcacggcattatctggaaggtttctccctgcgctgcctgggtgccgtccgcggtcattgagctgaccatgcctagcggggaagtgcggacgttccaccccatgtctggaatccccacacaggtttttaaaggcgtgtccgtcacctatcttgggagcgacatggaggtgtctggactgaccgatctctgtgaaatcgaggagctgaagtccaaaaagctggcccttgctccttgcaaccaggccggcatgggcgttgtggggaaagtcggagaaattcaatgtagctccgaggaaagcgctcgcacaatcaagaaggacggctgcatttggaacgccgatctcgtggggatcgagctgagagtggacgatgcggtctgttactctaaaattaccagcgttgaagccgtggctaattattccgccatcccgacaacgatcggaggcctgcggttcgagagatctcatgacagccaggggaagatttccggaatccccctcgatattaccgctatccgcggctcttttagcgtgaactaccggggcctgagactttccctgtctgagattacagctacctgcacaggggaagtcaccaatgtgagcggatgctactcctgtatgacgggcgccaaagttagcatcaagctccactcttccaaaaacagcaccgcccatgtgcgctgcaagggggacgagacagcgttctctgtcctggaaggagtgcactcctataccgttagcctgtcctttgatcacgccgtggtcgacgagcagtgtcagcttaattgcggcgggcatgaatctcaagtgacactcaagggaaacctgatcttcctggacgttcctaaatttgtggatggcagctacatgcagacctatcactccacggtccccacaggcgctaatattcctagccccaccgactggctcaacgccctgttcgggaatggactttctagatggatcctgggcgtgattggggtgctcctgggaggcctggccctgtttttcatgatcatgtccctctttaagctggggacaaaacaggtcttccggagccgcaccaagctggcttga

SEQ ID NO: 14887 - RNA, 3222 nt, synthetic construct
  misc_feature 1..3222: note = derived and/or modified CDS sequence (opt5) from SFTSV/FTLSV(2012YSC6)__KF711931.1__GP
  source 1..3222: mol_type = other RNA
atgatgaaggtgatctggttcagctccctgatttgctttgtcatccagtgttctggcgggagcggacccattatctgcgccggccctattcactccaacaaatctgctgacatcccgcatctcctggggtacagcgagaagatctgtcaaattgatagacttatccacgtttcctcttggctgcggaatcatagccagttccagggatatgtgggccagcgcgggggaagatcccaagtgagctactatcccgccgaaaactcttactcccggtggagcggcctcctgtctccttgcgacgcggattggcttggcatgctggtcgtgaaaaaggctaaagggtccgacatgattgttcccggacctagctataagggcaaggtgtttttcgagcgccccacctttgatgggtacgtcggatggggctgtgggtctggaaaatccagaacagaaagcggcgagctctgctcctctgacagcggcacgtccagcgggctgctgccttctgatcgggtgctctggatcggagacgttgcctgtcagccgatgacccccattcctgaagagacattcctggagcttaagtcctttagccagtctgaatttcccgatatctgcaaaattgacggcatcgtgtttaatcagtgtgagggggaaagcctgcctcaacccatcgatgtcgcctggatggacgtgggacactcccataagattatcatgcgcgagcacaaaaccaagtgggtgcaggagtctagctccaaggatttcgtctgctataaagaaggcacagggccgtgtagcgagtctgaagagaagacctgcaaaacatccggaagctgcagaggcgacatgcagttttgtaaggttgctggctgcgaacacggggaggaggcctctgaagctaaatgtcggtgctccctcgtgcataagcctggagaggtggtcgtgagctacggcgggatgcgcgttagacccaaatgttacggattctcccggatgatggccaccctggaagtgaaccagcctgagcaacgcattggccagtgcacggggtgtcaccttgaatgcatcaatggcggagtcagactgattaccctcacatctgagctcaagagcgcgaccgtgtgtgcctcccatttttgctctagcgctacatccggcaagaaaagcaccgagatccagttccactctgggtccctggttggaaagacggccatccacgtgaaaggcgctctggtcgacgggacagagttcacctttgaaggaagctgtatgttccccgatggctgcgacgccgtggattgcacattttgtcgggagttcctgaagaacccccaatgctatcctgcgaaaaagtggctttttattatcattgtcatcctgctcgggtacgccggcctgatgcttctgaccaatgtgctcaaggctattggaatctggggctcttgggttatcgccccggtgaaactgattttcgctatcattaagaaactgatgcgcaccgtctcctgtctcatggggaagctgatggacagaggaagacaggtgatccatgaagaaattggcgagaaccgggaggggaatcaggatgacgttcgcatcgaaatggcccggcccagacgcgtgcggcactggatgtatagccctgtcattcttacaatcctggccatcggactcgctgagtcttgcgatgaaatggtgcatgcggacagcaaactggtgtcctgtagacagggcagcgggaacatgaaggagtgcgttacgaccggccgcgcccttctgcccgctgtcaatcctggacaagaggcctgtctccactttacagcccccggctctccggattccaagtgcctgaaaattaaggtgaaacggatcaacctgaagtgtaaaaagagctcctcttacttcgtgcctgacgctagaagccgctgcacctccgtccggagatgtcgctgggccggggattgccagtctggatgtccccctcattttacaagcaattccttctctgacgactgggcgggcaagatggatcgggctgggctcggatttagcggctgctccgacgggtgcggcggagccgcctgtggctgcttcaacgctgcccccagctgtattttctggagaaaatgggtggaaaatcctcacgggatcatttggaaggtttctccctgcgctgcctgggtgccgtccgcggtcatcgagctgaccatgcctagcggagaagtgcggacgttccaccccatgtctggcatccccacacaggttttcaaaggggtgtccgtcacctatcttggaagcgatatggaggtgtctggcctgaccgacctctgtgaaattgaggagctgaagtccaaaaagctggcccttgctccttgcaaccaggccggcatgggggttgtgggaaaagtcggcgaaatccaatgtagctccgaggaaagcgctcgcacaattaagaaggatgggtgcatctggaacgccgacctcgtgggaattgagctgagagtggatgacgcggtctgttactctaaaatcaccagcgttgaagccgtggctaattattccgccatcccgacaacgattggcgggctgcggtttgagagatctcatgatagccagggaaagatctccggctctcccctcgacattaccgctatccgcggcagcttctccgtgaactaccgggggctgagactttctctgagcgagattacagctacctgcacaggagaagtcaccaatgtgtccggctgctacagctgtatgacgggggccaaagtttctatcaagctccactccagcaaaaactctaccgcccatgtgcgctgcaagggagatgagacagcgttttccgtcctggaaggcgtgcacagctataccgtttccctgtctttcgaccacgccgtggtcgatgagcagtgtcagcttaattgcgggggacatgaaagccaagtgacactcaagggcaacctgatctttctggacgttcctaaattcgtggacggctcctacatgcagacctatcacagcacggtccccacaggggctaatattccttctcccaccgattggctcaacgccctgtttggaaatggcctttccagatggatcctgggggtgattggagtgctcctgggcgggctggcccttttctttatgatcatgagcctcttcaagctgggaacaaaacaggtctttcggtctcgcaccaagctggcttga

SEQ ID NO: 14888 - RNA, 3222 nt, synthetic construct
  misc_feature 1..3222: note = derived and/or modified CDS sequence (opt5) from SFTSV/FTLSV(2012YSH10)__KF711940.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctaatcgggtgctctggatcggggacgttgcctgtcagccgatgacccccattcctgaagagacattcctggagcttaagtcctttagccagtctgaatttcccgatatctgcaaaattgacggaatcgtgtttaaccagtgtgagggcgaaagcctgcctcaacccttcgatgtcgcctggatggacgtggggcactcccataagatcattatgcgcgagcacaaaaccaagtgggtgcaggagtctagctccaaggattttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaatcagcctgagcaacgcatcggacagtgcacgggctgtcaccttgaatgcattaacgggggcgtcagactgatcaccctcacatctgagctgaagtctgcgaccgtgtgtgcctcccatttctgctctagcgctatgtccggaaagaaaagcacagagattcagttccactctggctccctggttgggaagaccgccatccacgtgaaaggagctctcgtcgacggcacggaatttacattcgaggggagctgtatgtttcccgatggatgcgacgccgtggattgcaccttctgtcgggaatttctgaagaatccccaatgctatcctgcgaaaaagtggcttttcatcattatcgtcattctgctcggctacgccgggctgatgcttctgacaaacgtgctcaaggctatcggcatttggggatcttgggttatcgccccggtgaaactgatctttgctattatcaagaaactgatgcgcaccgtctcctgtctcatgggcaagctgatggacagagggagacaggtgattcatgaggaaatcggagagaatcgggagggcaaccaggatgacgttcgcattgaaatggcccggcccagacgcgtgcggcactggatgtatagccctgtcatccttaccattctggccatcgggctcgctgagtcttgcgatgaaatggtgcatgcggacagcaaactggtgtcctgtagacagggaagcggcaatatgaaggagtgcgttacaacggggcgcgcccttctgcccgctgtcaaccctggccaagaggcctgtctccacttcaccgcccccggatctccggattccaagtgcctgcggatcaaagtgaagagaattaatctgaaatgtaagaaaagctcctcttactttgtgcctgacgctcgcagccggtgcacatccgtcagacgctgtcggtgggccggcgattgccagtctgggtgtccccctcatttcaccagcaactccttttctgacgactgggcgggaaagatggatagagctggcctcgggttcagcggatgctccgacggctgcgggggcgccgcctgtggatgctttaatgctgcccccagctgtatcttctggcggaagtgggtggaaaaccctcacggcattatctggaaagtttctccctgcgctgcctgggtgccgtccgcggtcattgagctgacaatgcctagcggggaagtgcgcaccttccaccccatgtctggaatccccacgcaggtttttaagggcgtgtccgtcacatatcttgggagcgatatggaggtgtctggactgaccgacctctgtgaaatcgaggagctgaaatccaagaaactggcccttgctccttgcaaccaggccggcatgggcgttgtggggaaggtcggagaaattcaatgtagctccgaggaaagcgctagaaccatcaaaaaggatggctgcatttggaatgccgacctcgtggggatcgagctgcgggtggatgacgcggtctgttactctaagattacaagcgttgaagccgtggctaactattccgccatcccgaccacaatcggaggcctgagattcgagcgctctcatgatagccaggggaaaatttccggatctcccctcgacatcacggctattcggggcagcttttccgtgaattacagaggcctgcgcctttctctgagcgagatcaccgccacatgcaccggggaagtcacaaacgtgtccggatgctacagctgtatgaccggcgccaaggtttctattaaactccactccagcaagaatagcacggctcatgtgagatgcaaaggggatgagaccgcgttctccgtcctggaaggagtgcacagctatacagtttccctgtcttttgaccacgccgtggtcgatgagcagtgtcagcttaactgcggcgggcatgaaagccaagtgaccctcaagggaaatctgatcttcctggacgttcctaagtttgtggacggctcctacatgcagacatatcacagcaccgtccccacgggcgctaacatcccttctcccacagattggctcaatgccctgttcgggaacggactttcccggtgggtgctgggcgtgatgggggtcctcctgggaggcctggcccttttcttcatgattatgagcctctttaaactggggaccaagcaggttttccgctctagaacaaaactggcttga

SEQ ID NO: 14889 - RNA, 3222 nt, synthetic construct
  misc_feature 1..3222: note = derived and/or modified CDS sequence (opt5) from SFTSV/FTLSV(2012YSH104)__KF711943.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctaatcgggtgctctggatcggggacgttgcctgtcagccgatgacccccattcctgaagagacattcctggagcttaagtcctttagccagtctgaatttcccgatatctgcaaaattgacggaatcgtgtttaaccagtgtgagggcgaaagcctgcctcaacccttcgatgtcgcctggatggacgtggggcactcccataagatcattatgcgcgagcacaaaaccaagtgggtgcaggagtctagctccaaggattttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaatcagcctgagcaacgcatcggacagtgcacgggctgtcaccttgaatgcattaacgggggcgtcagactgatcaccctcacatctgagctgaagtccgcgaccgtgtgtgcctcccatttctgctctagcgctacatccggaaagaaaagcaccgagattcagttccactctggctccctggttgggaagacggccatccacgtgaaaggagctctcgtcgacggcacagaatttaccttcgaggggagctgtatgtttcccgatggatgcgacgccgtggattgcacattctgtcggaagtttctgaaaaatccccaatgctatcctgcgaagaagtggcttttcatcattatcgtcattctgctcggctacgccgggctgatgcttctgaccaacgtgctcaaagctatcggcatttggggatcttgggttatcgccccggtgaagctgatctttgctattatcaaaaagctgacccgcacagtctcctgtctcatgggcaaactgatggacagagggagacaggtgattcatgaagagatcggagaaaatcgggagggcaaccaggatgacgttcgcattgagatggcccggcccagacgcgtgcggcactggatgtatagccctgtcatccttacgattctggccatcgggctcgctgaatcttgcgatgagatggtgcatgcggacagcaagctggtgtcctgtagacagggaagcggcaatatgaaggaatgcgttaccacagggcgcgcccttctgcccgctgtcaaccctggccaagaggcctgtctccacttcaccgcccccggatctccggattccaaatgcctgcggatcaaggtgaaaagaattaatctgaagtgtaaaaagagctcctcttactttgtgcctgacgctcgctatcggtgcacaagcgtcagacgctgtcggtgggccggcgattgccagtccgggtgtccccctcatttcacctctaacagcttttccgacgactgggcgggaaagatggatagagctggcctcgggttctctggatgcagcgacggctgcgggggcgccgcctgtggatgctttaatgctgccccctcctgtatcttctggcggaaatgggtggagaaccctcacggcattatctggaaggttagcccctgcgctgcctgggtgccgtctgcggtcattgaactgacgatgccttccggggaggtgcgcacattccaccccatgagcggaatccccacccaggtttttaaaggcgtgtctgtcacctaccttgggtccgatatggaagtgagcggactgacagacctctgtgagatcgaggaactgaagtctaaaaagctggcccttgctccttgcaaccaggccggcatgggcgttgtggggaaagtcggagagattcaatgttccagcgaagagtccgctagaaccatcaagaaggatggctgcatttggaatgccgacctcgtggggatcgaactgcgggtggatgacgcggtctgttatagcaaaattacatctgttgaggccgtggctaactacagcgccatcccgacgaccatcggaggcctgagattcgaacgctcccatgattctcaggggaagattagcggaagccccctcgacatcacagctattcggggctcttttagcgtgaattacagaggcctgcgcctttccctgtctgagatcaccgccacatgcaccggggaggtcacgaacgtgagcggatgctattcctgtatgaccggcgccaaagttagcattaagctccactcttccaaaaatagcacagctcatgtgagatgcaagggggatgaaaccgcgttctctgtcctggagggagtgcactcctacacagttagcctgtcctttgaccacgccgtggtcgatgaacagtgtcagcttaactgcggcgggcatgagtctcaagtgaccctcaagggaaatctgatcttcctggacgttcctaaatttgtggacggcagctatatgcagacgtaccactccacagtccccaccggcgctaacatccctagccccacagattggctcaatgccctgttcgggaacggactttctcggtgggtgctgggcgtgatgggggtcctcctgggaggcctggcccttttcttcatgattatgtccctctttaagctggggaccaaacaggttttccgcagcagaaccaagctggcttga

SEQ ID NO: 14890 - RNA, 3222 nt, synthetic construct
  misc_feature 1..3222: note = derived and/or modified CDS sequence (opt5) from SFTSV/FTLSV(2012YSH105)__KF711944.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctaatcgggtgctctggatcggggacgttgcctgtcagccgatgacccccattcctgaagagacattcctggagcttaagtcctttagccagtctgaatttcccgatatctgcaaaattgacggaatcgtgtttaaccagtgtgagggcgaaagcctgcctcaacccttcgatgtcgcctggatggacgtggggcactcccataagatcattatgcgcgagcacaaaaccaagtgggtgcaggagtctagctccaaggattttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaatcagcctgagcaacgcatcggacagtgcacgggctgtcaccttgaatgcattaacgggggcgtcagactgatcaccctcacatctgagctgaagtctgcgaccgtgtgtgcctcccatttctgctctagcgctacatccggaaagaaaagcaccgagattcagttccactctggctccctggttgggaagacggccatccacgtgaaaggagctctcgtcgacggcacagaatttaccttcgaggggagctgtatgtttcccgatggatgcgacgccgtggattgcacattctgtcgggaatttctgaagaatccccaatgctatcctgcgaaaaagtggcttttcatcattatcgtcattctgctcggctacgccgggctgatgcttctgaccaacgtgctcaaggctatcggcatttggggatcttgggttatcgccccggtgaaactgatctttgctattatcaagaaactgatgcgcaccgtctcctgtctcatgggcaagctgatggacagagggagacaggtgattcatgaggaaatcggagagaatcgggagggcaaccaggatgacgttcgcattgaaatggcccggcccagacgcgtgcggcactggatgtatagccctgtcatccttacaattctggccatcgggctcgctgagtcttgcgatgaaatggtgcatgcggacagcaaactggtgtcctgtagacagggaagcggcaatatgaaggagtgcgttacgaccgggcgcgcccttctgcccgctgtcaaccctggccaagaggcctgtctccacttcacagcccccggatctccggattccaagtgcctgcggatcaaagtgaagagaattaatctgaaatgtaagaaaagctcctcttactttgtgcctgacgctcgcagccggtgcacctccgtcagacgctgtcggtgggccggcgattgccagtctgggtgtccccctcatttcacaagcaactccttttctggagactgggcgggcaagatggacagagctgggctcggattcagcggctgctccgatgggtgcggcggagccgcctgtggctgctttaatgctgcccccagctgtatcttctggcggaagtgggtggaaaaccctcacgggattatctggaaagtttctccctgcgctgcctgggtgccgtccgcggtcattgagctgaccatgcctagcggagaagtgcgcacgttccaccccatgtctggcatccccacacaggtttttaagggggtgtccgtcacctatcttggaagcgacatggaggtgtctggcctgaccgatctctgtgaaatcgaggagctgaaatccaagaaactggcccttgctccttgcaaccaggccggcatgggggttgtgggaaaggtcggcgaaattcaatgtagctccgaggaaagcgctagaacaatcaaaaaggacgggtgcatttggaatgccgatctcgtgggaatcgagctgcgggtggacgatgcggtctgttactctaagattaccagcgttgaagccgtggctaactattccgccatcccgacaacgatcggcgggctgagattcgagcgctctcatgacagccagggaaaaatttccggctctcccctcgatatcaccgctattcggggcagcttttccgtgaattacagagggctgcgcctttctctgagcgagatcacagctacctgcacaggagaagtcaccaacgtgtccggctgctacagctgtatgacgggggccaaggtttctattaaactccactccagcaagaatagcaccgcccatgtgagatgcaaaggagacgagacagcgttctccgtcctggaaggcgtgcacagctataccgtttccctgtcttttgatcacgccgtggtcgacgagcagtgtcagcttaactgcgggggacatgaaagccaagtgacactcaagggcaatctgatcttcctggatgttcctaagtttgtggacggctcctacatgcagacctatcacagcacggtccccacaggggctaacatcccttctcccaccgactggctcaatgccctgttcggaaacggcctttcccggtggattctgggggtgatgggagtgctcctgggcgggctggcccttttcttcatgatcatgagcctctttaaactgggaacaaagcaggtcttccgctctagaaccaaactggcttga

SEQ ID NO: 14891 - RNA, 3222 nt, synthetic construct
  misc_feature 1..3222: note = derived and/or modified CDS sequence (opt5) from SFTSV/FTLSV(2012YSH107)__KF711942.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctaatcgggtgctctggatcggggacgttgcctgtcagccgatgacccccattcctgaagagacattcctggagcttaagtcctttagccagtctgaatttcccgatatctgcaaaattgacggaatcgtgtttaaccagtgtgagggcgaaagcctgcctcaacccttcgatgtcgcctggatggacgtggggcactcccataagatcattatgcgcgagcacaaaaccaagtgggtgcaggagtctagctccaaggattttgtctgctataaagaaggaacaggcccgtgtagcgagtctgaagagaagaccgggaaaacatccggaagctgcagaggcgacatgcagttctgcaaggttgctggctgtgaacacggggaggaggcctctgaagctaaatgccggtgttccctcgtgcataagcctggagaggtggtcgtgagctacggcgggatgcgcgttagacccaaatgctacggattttcccggatgatggccaccctggaagtgaatcagcctgagcaacgcatcggccagtgtacggggtgccaccttgaatgtattaacggcggagtcagactgatcaccctcacatctgagctgaagtccgcgaccgtgtgcgcctcccatttctgttctagcgctacatccggcaagaaaagcaccgagattcagttccactctgggtccctggttggaaagacggccatccacgtgaaaggcgctctcgtcgacgggacagaatttaccttcgagggaagctgcatgtttcccgatggctgtgacgccgtggattgcacattctgccgggaatttctgaagaatccccaatgttatcctgcgaaaaagtggcttttcatcattatcgtcattctgctcgggtacgccggcctgatgcttctgaccaacgtgctcaaggctatcggaatttggggctcttgggttatcgccccggtgaaactgatctttgctattatcaagaaactgatgcgcaccgtctcctgcctcatggggaagctgatggacagaggaagacaggtgattcatgaggaaatcggcgagaatcgggaggggaaccaggatgacgttcgcattgaaatggcccggcccagacgcgtgcggcactggatgtatagccctgtcatccttacaattctggccatcggactcgctgagtcttgtgatgaaatggtgcatgcggacagcaaactggtgtcctgcagacagggcagcgggaatatgaaggagtgtgttacgaccggccgcgcccttctgcccgctgtcaaccctggacaagaggcctgcctccacttcacagcccccggctctccggattccaagtgtctgcggatcaaagtgaagagaattaatctgaaatgcaagaaaagctcctcttactttgtgcctgacgctcgctatcggtgtaccagcgtcagacgctgccggtgggccggggattgtcagtccggatgtccccctcatttcacatctaacagcttttccgacgactgggcgggcaagatggatagagctgggctcggattctctggctgcagcgacgggtgcggcggagccgcctgcggctgttttaatgctgccccctcctgcatcttctggcggaagtgggtggaaaaccctcacgggattatctggaaagttagcccctgtgctgcctgggtgccgtctgcggtcattgagctgaccatgccttccggagaagtgcgcacgttccaccccatgagcggcatccccacacaggtttttaagggggtgtctgtcacctaccttggatccgatatggaggtgagcggcctgaccgacctctgcgaaatcgaggagctgaaatctaagaaactggcccttgctccttgtaaccaggccggcatgggggttgtgggaaaggtcggcgaaattcaatgctccagcgaggaatccgctagaacaatcaaaaaggatgggtgtatttggaatgccgacctcgtgggaatcgagctgcgggtggatgacgcggtctgctatagcaagattacctctgttgaagccgtggctaactacagcgccatcccgacaacgatcggcgggctgagattcgagcgctcccatgattctcagggaaaaattagcggcagccccctcgacatcaccgctattcggggctcttttagcgtgaattacagagggctgcgcctttccctgtctgagatcacagccacctgtacaggagaagtcaccaacgtgagcggctgctattcctgcatgacgggggccaaggttagcattaaactccactcttccaagaatagcaccgctcatgtgagatgtaaaggagatgagacagcgttctctgtcctggaaggcgtgcactcctacaccgttagcctgtcctttgaccacgccgtggtcgatgagcagtgccagcttaactgtgggggacatgaatctcaagtgacactcaagggcaatctgatcttcctggacgttcctaagtttgtggacggcagctatatgcagacctaccactccacggtccccacaggggctaacatccctagccccaccgattggctcaatgccctgttcggaaacggcctttctcggtgggtgctgggggtgatgggagtcctcctgggcgggctggcccttttcttcatgattatgtccctctttaaactgggaacaaagcaggttttccgcagcagaaccaaactggcttga

SEQ ID NO: 14892 - RNA, 3222 nt, synthetic construct
  misc_feature 1..3222: note = derived and/or modified CDS sequence (opt5) from SFTSV/FTLSV(2012YSH14)__KF711938.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattatcgggggcgtcagactgattaccctcacatctgagcttaagagcgcgaccgtgtgtgcctcccatttctgctctagcgctacatccggaaagaaaagcaccgagatccagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaatccccaatgctatcctgcgaaaaagtggcttttcattatcattgtcatcctgctcggctacgccgggctgatgcttctgaccaacgtgctcaaggctattggcatctggggatcttgggttatcgccccggtgaaactgatttttgctatcattaagaaactgatgcgcaccgtctcctgtctcatgggcaagctgatggatagagggagacaggtgatccatgaggaaattggagagaatcgggagggcaaccaggacgatgttcgcatcgaaatggcccggcccagacgcgtgcggcactggatgtatagccctgtcattcttacaatcctggccatcgggctcgctgagtcttgcgacgaaatggtgcatgcggatagcaaactggtgtcctgtagacagggaagcggcaatatgaaggagtgcgttacgaccgggcgcgcccttctgcccgctgtcaaccctggccaagaggcctgtctccacttcacagcccccggatctccggactccaagtgcctgaaaattaaggtgaaacggatcaatctgaagtgtaaaaagagctcctcttactttgtgcctgatgctagaagccgctgcacctccgtccggagatgtcgctgggccggcgactgccagtctgggtgtccccctcatttcacaagcaactccttttctgacgattgggcgggaaagatggaccgggctggcctcgggttcagcggatgctccgatggctgcgggggcgccgcctgtggatgctttaatgctgcccccagctgtattttctggagaaaatgggtggaaaaccctcacggcatcatttggaaggtttctccctgcgctgcctgggtgccgtccgcggtcatcgagctgaccatgcctagcggggaagtgcggacgttccaccccatgtctggaatccccacacaggtttttaaaggcgtgtccgtcacctatcttgggagcgacatggaggtgtctggactgaccgatctctgtgaaattgaggagctgaagtccaaaaagctggcccttgctccttgcaatcaggccggcatgggcgttgtggggaaagtcggagaaatccaatgtagctccgaggaaagcgctcgcacaattaagaaggacggctgcatctggaacgccgatctcgtggggattgagctgagagtggacgatgcggtctgttactctaaaatcaccagcgttgaagccgtggctaactattccgccatcccgacaacgattggaggcctgcggttcgagagatctcatgacagccaggggaagatctccggatctcccctcgatattaccgctatccgcggcagcttttccgtgaattaccggggcctgagactttctctgagcgagattacagctacctgcacaggggaagtcaccaacgtgtccggatgctacagctgtatgacgggcgccaaagtttctatcaagctccactccagcaaaaattctaccgcccatgtgcgctgcaagggggacgagacagcgttctccgtcctggaaggagtgcacagctataccgtttccctgtcttttgatcacgccgtggtcgacgagcagtgtcagcttaactgcggcgggcatgaaagccaagtgacactcaagggaaatctgatcttcctggacgttcctaaatttgtggatggctcctacatgcagacctatcacagcacggtccccacaggcgctaacattccttctcccaccgactggctcaatgccctgttcgggaacggactttccagatggatcctgggcgtgattggggtgctcctgggaggcctggccctgtttttcatgatcatgagcctctttaagctggggacaaaacaggtcttccggtctcgcaccaagctggcttga

SEQ ID NO: 14893 - RNA, 3222 nt, synthetic construct
  misc_feature 1..3222: note = derived and/or modified CDS sequence (opt5) from SFTSV/FTLSV(2012YSH16)__KF711934.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgaatttcccgacatctgcaaaattgatggaatcgtgtttaatcagtgtgagggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagctgaagtccgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgcgcaccgtctcctgtctcatgggcaagctgatggatagagggagacaggtgattcatgaggaaatcggagagaaccgggagggcaatcaggacgatgttcgcattgaaatggcccggcccagacgcgtgcggcactggatgtatagccctgtcatccttacaattctggccatcgggctcgctgagtcttgcgacgaaatggtgcatgcggatagcaaactggtgtcctgtagacagggaagcggcaacatgaaggagtgcgttacgaccgggcgcgcccttctgcccgctgtcaatcctggccaagaggcctgtctccacttcacagcccccggatctccggactccaagtgcctgaaaatcaaggtgaaacggattaacctgaagtgtaaaaagagctcctcttactttgtgcctgatgctagatatcgctgcaccagcgtccggagatgtcgctgggccggcgactgccagtccgggtgtccccctcatttcacatctaatagcttttccgacgattgggcgggaaagatggaccgggctggcctcgggttctctggatgcagcgatggctgcgggggcgccgcctgtggatgctttaacgctgccccctcctgtatcttctggagaaaatgggtggaaaatcctcacggcattatctggaaggttagcccctgcgctgcctgggtgccgtctgcggtcattgagctgaccatgccttccggggaagtgcggacgttccaccccatgagcggaatccccacacaggtttttaaaggcgtgtctgtcacctaccttgggtccgacatggaggtgagcggactgaccgatctctgtgaaatcgaggagctgaagtctaaaaagctggcccttgctccttgcaaccaggccggcatgggcgttgtggggaaagtcggagaaattcaatgttccagcgaggaatccgctcgcacaatcaagaaggacggctgcatttggaacgccgatctcgtggggatcgagctgagagtggacgatgcggtctgttatagcaaaattacctctgttgaagccgtggctaattacagcgccatcccgacaacgatcggaggcctgcggttcgagagatcccatgactctcaggggaagattagcggaagccccctcgatatcaccgctattcgcggctcttttagcgtgaactaccggggcctgagactttccctgtctgagatcacagctacctgcacaggggaagtcaccaatgtgagcggatgctattcctgtatgacgggcgccaaagttagcattaagctccactcttccaaaaacagcaccgcccatgtgcgctgcaagggggacgagacagcgttctctgtcctggaaggagtgcactcctacaccgttagcctgtcctttgatcacgccgtggtcgacgagcagtgtcagcttaattgcggcgggcatgaatctcaagtgacactcaagggaaacctgatcttcctggacgttcctaaatttgtggatggcagctatatgcagacctaccactccacggtccccacaggcgctaatatccctagccccaccgactggctcaacgccctgttcgggaatggactttctagatggattctgggcgtgatcggggtgctcctgggaggcctggcccttttcttcatgattatgtccctctttaagctggggacaaaacaggtcttccggagccgcaccaagctggcttga

SEQ ID NO: 14894 - RNA, 3222 nt, synthetic construct
  misc_feature 1..3222: note = derived and/or modified CDS sequence (opt5) from SFTSV/FTLSV(2012YSH6)__KF711921.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggaatggcctgcttagcccttgcgacgcggattggctgggcatgctcgtcgtgaaaaaggctaaagagtctgacatgattgttcccgggccttcctataagggaaaggtgttctttgaacgccccaccttcgatggctacgtcgggtggggatgtggcagcgggaaatctagaacagagtccggagaactgtgcagctccgactctggcacgagctccggcctgctccctagcgatcgggtgctgtggatcggggacgttgcctgtcagccgatgacccccattcctgaggagacatttcttgaactgaagtctttctcccagagcgagtttcccgatatctgcaaaattgacggaatcgtgttcaaccagtgtgaaggcgagtctctccctcaaccctttgatgtcgcctggatggacgtggggcacagccataagatcattatgcgcgagcacaaaaccaagtgggtgcaggaatcctctagcaaggatttcgtctgctataaagagggaacaggcccgtgttccgaaagcgaggaaaaggcttgcaaaacctctgggtcctgcagaggagacatgcagttttgtaaggttgccggctgcgagcacggcgaggaagctagcgaggccaaatgtcggtgctctctggtgcataagcctggggaagtggtcgtgtcctacggaggcatgcgcgttagacccaaatgttacgggttcagccggatgatggcgacacttgaggtgaatcctcccgaacagcgcatcggacaatgcaccggctgtcacctggagtgcattaacgggggcgtcagactcatcacgctgacctccgagctgcggtctgccacagtgtgtgctagccatttttgctcctctgccaccagcggaaagaagtccacagaaattcacttccacagcggctctctcgttgggaaaaccgctatccatgtgaagggagccctggtcgacggcacggagttcacatttgaagggtcctgtatgttccccgatggatgcgacgcggtggattgcaccttttgtcgcgagttccttaaaaatcctcagtgctatccggccaagaaatggctgtttatcattatcgtcattctcctgggctacgctgggcttatgctggtgacaaacgttctcaaggccatcggcgtgtggggaagctgggtcattgctcccgtgaagctgatgttcgccatcatcaaaaagctgatgagaaccgtttcttgtctcgtgggcaaactgatggaccgggggagacaggtcattcacgaagagatcggagagaatggcgaagggaaccaagatgacgtgcgcattgagatggcccggcctagacgcgtgcggcattggatgtattcccccgttatccttaccattctggctatcggactcgcggaaggctgcgatgagatggtccacgccgacagcaagctggtgtcttgtagacaggggagcggcaatatgaaagagtgcattacaacgggacgcgctctgctgcctgccgtgaaccccggccaggaagcctgtctccattttaccgctccggggtcccctgatagcaagtgcctgaagatcaaagtcaagcggatcaatctgaaatgtaagaaatcttccagctacttcgtgcccgacgccagatcccgctgcacatctgttcggagatgtcgctgggcgggagattgccagagcggctgccctccccactttacctccaactctttcagcgacgactgggctgggaagatggatcgggccggactcggcttttccgggtgttctgacggctgcggaggcgccgcttgtgggtgcttcaatgccgctcctagctgtatcttttggagaaagtgggtggagaacccccacggaattatttggaaagtctccccgtgcgccgcgtgggtgcctagcgccgttatcgaactgacaatgccctctggcgaggtgcggaccttccatcccatgtccgggattcctacgcaagtcttcaagggagtgagcgttacatatcttggctctgatatggaagtgtccggcctgaccgacctctgtgagatcgaggaactgaaaagcaagaaactggctcttgccccgtgcaaccaggctgggatgggagtcgtgggcaaggtgggggagatccagtgttcttccgaagagagcgcccgcaccattaaaaaggatggatgcatctggaatgcggacctcgtcggcattgaactgagagttgatgacgccgtgtgttactccaagatcacaagcgtggaggctgtcgccaactattctgctattcccaccacaatcgggggactgcggtttgagagaagccacgattcccagggcaaaatctctggcagccctctcgacattacggccatccgcgggtccttctctgtgaattaccggggactgagacttagcctgtccgaaattaccgccacatgcaccggcgaggttacaaacgtgtctgggtgctacagctgtatgaccggagctaaggtctccatcaaactccatagctctaaaaattccacggcgcacgtgcgctgcaagggcgatgaaaccgcctttagcgttctggagggggtgcactcttatattgtctccctgagcttcgaccatgctgtggttgatgaacaatgtcagcttaactgcggaggccacgagtcccaggtgacactcaagggcaatctgatctttctggacgtccccaagttcgtggacgggtcttacatgcagacctatcatagcacagtgcctaccggagccaacatcccctcccctacggattggctcaatgccctgtttggcaacgggcttagcagatggattctgggagtcatcggcgttctccttgggggactggctcttttctttctcattatgttcctgctgaaactcggcacaaagcaagtgtttcggtctcgcaccaaactggcctga

SEQ ID NO: 14895 - RNA, 3222 nt, synthetic construct
  misc_feature 1..3222: note = derived and/or modified CDS sequence (opt5) from SFTSV/FTLSV(2012YSH86)__KF711939.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgtcacgggttttcccggatgatggccaccctggaagtgaaccagcctgagcaacgcatcggacagtgcacgggctgtcatcttgaatgcattaatgggggcgtcagactgatcaccctcacatctgagcttaagagcgcgaccgtgtgtgcctcccacttctgctctagcgctacatccggaaagaaaagcaccgagattcagttccactctggctccctggttgggaagacggccatccatgtgaaaggagctctcgtcgatggcacagaatttaccttcgaggggagctgtatgtttcccgacggatgcgatgccgtggactgcacattctgtcgggaatttctgaagaacccccaatgctaccctgcgaaaaagtggcttttcatcattatcgtcattctgctcggctatgccgggctgatgcttctgaccaatgtgctcaaggctatcggcatttggggatcttgggttatcgccccggtgaaactgatgtttgctatcattaagaaactgatgcgcaccgtctcctgtctcatgggcaagctgatggatagagggagacaggtgatccacgaggaaattggagagaaccgggagggcaatcaggacgatgttcgcatcgaaatggcccggcccagacgcgtgcggcattggatgtacagccctgtcattcttacaatcctggccattgggctcgctgagtcttgcgacgaaatggtgcacgcggatagcaaactggtgtcctgtagacagggaagcggcaacatgaaggagtgcgttacgaccgggcgcgcccttctgcccgctgtcaatcctggccaagaggcctgtctccatttcacagcccccggatctccggactccaagtgcctgaaaatcaaggtgaaacggatcaacctgaagtgtaaaaagagctcctcttattttgtgcctgatgctagaagccgctgcacctccgtccggagatgtcgctgggccggcgactgccagtctgggtgtccccctcacttcacaagcaattccttttctgacgattgggcgggaaagatggaccgggctggcctcgggttcagcggatgctccgatggctgcgggggcgccgcctgtggatgctttaacgctgcccccagctgtattttctggagaaaatgggtggaaaatcctcacggcatcatttggaaggtttctccctgcgctgcctgggtgccgtccgcggtcatcgagctgaccatgcctagcggggaagtgcggacgttccatcccatgtctggcattcccacacaggtttttaaaggagtgtccgtcacctaccttgggagcgacatggaggtgtctggactgaccgatctctgtgaaatcgaggagctgaagtccaaaaagctggcccttgctccttgcaaccaggccggcatgggcgttgtggggaaagtcggagaaatccaatgtagctccgaggaaagcgctcgcacaattaagaaggacggctgcatctggaacgccgatctcgtggggattgagctgagagtggacgatgcggtctgttattctaaaatcaccagcgttgaagccgtggctaattactccgccattccgacaacgatcggaggcctgcggttcgagagatctcacgacagccaggggaagatctccggatctcccctcgatattaccgctatccgcggcagcttttccgtgaactatcggggcctgagactttctctgagcgagattacagctacctgcacaggggaagtcaccaatgtgtccggatgctacagctgtatgacgggcgccaaagtttctatcaagctccattccagcaaaaactctaccgcccacgtgcgctgcaagggggacgagacagcgttctccgtcctggaaggagtgcacagctacaccgtttccctgtcttttgatcatgccgtggtcgacgagcagtgtcagcttaattgcggcgggcacgaaagccaagtgacactcaagggaaacctgattttcctggacgttcctaaatttgtggatggctcctatatgcagacctaccatagcacggtccccacaggcgctaatatcccttctcccaccgactggctcaacgccctgttcgggaatggactttccagatggatcctgggcgtgattggggtgctcctgggaggcctggccctgtttttcatgatcatgagcctctttaagctggggacaaaacaggtcctgcggtctcgcaccaagctcgcttga

SEQ ID NO: 14896 - RNA, 3222 nt, synthetic construct
  misc_feature 1..3222: note = derived and/or modified CDS sequence (opt5) from SFTSV/FTLSV(2012YSH89)__KF711935.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgcgcaccgtctcctgtctcatgggcaagctgatggatagagggagacaggtgattcatgaggaaatcggagagaaccgggagggcaatcaggacgatgttcgcattgaaatggcccggcccagacgcgtgcggcactggatgtatagccctgtcatccttacaattctggccatcgggctcgctgagtcttgcgacgaaatggtgcatgcggatagcaaactggtgtcctgtagacagggaagcggcaacatgaaggagtgcgttacgaccgggcgcgcccttctgcccgctgtcaatcctggccaagaggcctgtctccacttcacagcccccggatctccggactccaagtgcctgaaaatcaaggtgaaacggattaacctgaagtgtaaaaagagctcctcttactttgtgcctgatgctagaagccgctgcacctccgtccggagatgtcgctgggccggcgactgccagtctgggtgtccccctcatttcacaagcaattccttttctgacgattgggcgggaaagatggaccgggctggcctcgggttcagcggatgctccgatggctgcgggggcgccgcctgtggatgctttaacgctgcccccagctgtatcttctggagaaaatgggtggaaaatcctcacggcattatctggaaggtttctccctgcgctgcctgggtgccgtccgcggtcattgagctgaccatgcctagcggggaagtgcggacgttccaccccatgtctggaatccccacacaggtttttaaaggcgtgtccgtcacctatcttgggagcgacatggaggtgtctggactgaccgatctctgtgaaatcgaggagctgaagtccaaaaagctggcccttgctccttgcaaccaggccggcatgggcgttgtggggaaagtcggagaaattcaatgtagctccgaggaaagcgctcgcacaatcaagaaggacggctgcatttggaacgccgatctcgtggggatcgagctgagagtggacgatgcggtctgttactctaaaattaccagcgttgaagccgtggctaattattccgccatcccgacaacgatcggaggcctgcggttcgagagatctcatgacagccaggggaagatttccggatctcccctcgatatcaccgctattcgcggcagcttttccgtgaactaccggggcctgagactttctctgagcgagatcacagctacctgcacaggggaagtcaccaatgtgtccggatgctacagctgtatgacgggcgccaaagtttctattaagctccactccagcaaaaactctaccgcccatgtgcgctgcaagggggacgaggcggccttctccgtcctggaaggagtgcacagctatacagtttccctgtcttttgatcacgctgtggtcgacgagcagtgtcagcttaattgcggcgggcatgaaagccaagtgaccctcaagggaaacctgatcttcctggacgttcctaaatttgtggatggctcctacatgcagacatatcacagcaccgtccccacgggcgccaatatcccttctcccacagactggctcaacgccctgttcgggaatggactttccagatggattctgggcgtgatcggggtgctcctgggaggcctggctctgtttttcatgattatgagcctctttaagctggggaccaaacaggtcttccggtctcgcacaaagctggcctga

SEQ ID NO: 14897 - RNA, 3222 nt, synthetic construct
  misc_feature 1..3222: note = derived and/or modified CDS sequence (opt5) from SFTSV/FTLSV(2012YSH9)__KF711919.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccgggtgagctactatcccgccgaaaactcttactcccgctggagcggcctgctttctccttgcgacgcggattggctgggcatgctcgtcgtgaaaaaggctaaagagtccgacatgattgttcccgggcctagctataagggaaaggtgttctttgaaagacccaccttcgatggctacgtcgggtggggatgtggctctgggaaatcccggacagagagcggagaactgtgctcctctgacagcggcacgtccagcggcctgctcccttctgatcgcgtgctgtggatcggggacgttgcctgtcaaccgatgacccccattcctgaggagacatttcttgaactgaagtccttcagccagtctgagtttcccgatatctgcaaaattgacggaatcgtgttcaatcagtgtgaaggcgagagcctccctcagccctttgatgtcgcctggatggacgtggggcactcccataagatcattatgagagagcacaaaaccaagtgggtgcaagaatctagctccaaggatttcgtctgctataaagagggaacaggcccgtgtagcgaatctgaggaaaaggcttgcaaaacctccgggagctgccggggagacatgcagttttgtaaggttgccggctgcgagcacggcgaggaggcttctgaagccaaatgtcgctgctccctggtgcataagcctggggaagtggtcgtgagctacggaggcatgagagttcggcccaaatgttacgggttctcccgcatgatggcgacacttgaggtgaacagacctgaacagcggatcggacagtgcaccggctgtcacctggagtgcattaatgggggcgtccgcctcatcacgctgacctctgagctgagaagcgccacagtgtgtgcttcccatttttgctctagcgccacctccggaaagaagaacacagaaattcacttccacagcggctctctcgttgggaaaaccgctatccatgtgaagggagccctggtcgacggcacggagttcacatttgaagggtcctgtatgttccccgatggatgcgacgcggtggattgcaccttttgtcgggagttccttaaaaatccccaatgctatcctgccaagaaatggctgtttatcattatcgtcattctcctgggctacgctgggcttatgctgctcacaaacgtgctgaaggccatcggcgtttggggaagctgggtgattgctccggtcaagctgatgttcgccatcatcaaaaagctcatgagaaccgtgtcttgtctggttggcaaacttatggaccgcgggagacaggtgattcacgaagagatcggagagaatggcgaagggaaccaggatgacgtcagaattgagatggcccgcccccggagagtgcgccattggatgtattcccctgtgatcctgaccattctcgctatcggactggcggaaggctgcgatgagatggttcacgccgacagcaagctggtctcttgtcggcaagggagcggcaatatgaaagagtgcattacaacgggacgggctctgctccccgccgtgaaccctggccaggaagcctgtctgcattttaccgctcccgggtccccggatagcaagtgcctgaagatcaaagtgaagcgcatcaatctcaaatgtaagaaatcttccagctacttcgtccctgacgcccggtccagatgcacatctgtgcgccggtgtagatgggcgggagattgccagagcggctgtccccctcactttacctccaactctttcagcgacgactgggctgggaagatggatcgggccggactgggcttttccgggtgctctgacggctgcggaggcgccgcttgtgggtgcttcaatgccgctcccagctgtatcttttggcgcaagtgggttgagaaccctcacggaattatttggaaagtgtccccctgcgccgcgtgggtcccgagcgccgtgatcgaacttacaatgccttctggcgaggttagaaccttccatcccatgtccgggattcccacacaggtgttcaagggagtcagcgtgacgtatctgggctctgatatggaagtttccggcctcaccgacctgtgtgagatcgaggaactgaaaagcaagaaacttgctctcgccccttgcaaccaagctgggatgggagtggtcggcaaggtgggggagatccagtgttcttccgaagagagcgcccggaccattaaaaaggatggatgcatctggaatgcggacctggtgggcattgaactgagagtcgatgacgccgtttgttactccaagatcacaagcgtggaggctgtggccaactattctgctattccgaccacaatcgggggactccgctttgagcggagccacgattcccagggcaaaatctctggcagccccctggacattacggccatcagagggtccttctctgtcaattaccgcggacttagactgagcctctccgaaattaccgccacatgcaccggcgaggtgacaaacgtttctgggtgctacagctgtatgaccggagctaaggtgtccatcaaactgcatagctctaaaaattccacggcgcacgtccggtgcaagggcgatgaaaccgcctttagcgtgctggagggggttcactcttatattgtgtcccttagcttcgaccatgctgtcgtggatgaacagtgtcaactcaactgcggaggccacgagtcccaggttacactgaagggcaatctgatctttctcgacgtgcctaagttcgtcgacgggtcttacatgcagacctatcatagcacagtgcccaccggagccaacatcccttcccccacggattggctgaatgccctttttggcaacgggctgagccgctggattctcggagtgatcggcgtcctgcttgggggacttgctctcttctttctgattatgttcctgctcaaactgggcacaaagcaggtttttagatctcggaccaaacttgcctga

SEQ ID NO: 14898 - RNA, 3222 nt, synthetic construct
  misc_feature 1..3222: note = derived and/or modified CDS sequence (opt5) from SFTSV/FTLSV(2012YSH91)__KF711920.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcacgaggagacatttcttgaactgaagtccttcagccagtctgagtttcctgatatctgcaaaattgacggaatcgtgttcaatcagtgtgaaggcgagagcctcccccaaccttttgatgtcgcctggatggacgtggggcattcccacaagatcattatgcgcgagcacaaaaccaagtgggtgcaggaatctagctccaaggatttcgtctgctataaagagggaacaggcccctgtagcgaatctgaggaaaaggcttgcaaaacctccgggagctgcagaggagacatgcagttttgtaaggttgccggctgcgagcatggcgagaaggcttctgaaacaaagtgtcggtgctccctggtgcacaaaccgggggaggtggtcgtgagctacggaggcatgcgcgttagacctaagtgttacgggatctcccggatgatggccacccttgaagtgaatccccctgagcagcgcattggacaatgcacgggctgtcatctggaatgcatcaacgggggcgtcagactcattaccctgacatctgagctgcggagcgcgaccgtgtgtgcctcccacttctgctctagcgcttccagcggaaagaaatctacagagatccactttcattccggcagcctcgttgggaagaccgccatccacgtgaaaggagctctggtcgacggcacggagttcacattcgaagggtcttgtatgtttcccgatggatgcgacgccgtggattgcaccttctgtcgcgaatttcttaagaacccccagtgctatcctgcgaaaaagtggctgttcattatcattgtcatcctcctgggctacgccgggcttatgctgctcacaaatgtgctgaaggctattggcgtttggggatcctgggtgatcgccccggtcaaactgatgtttgctatcattaagaaactcatgagaaccgtgagctgtctggttggcaaacttatggaccgggggagacaggtgatccatgaggaaattggagagaacggcgaggggaatcaagatgacgtccgcatcgaaatggcccggcccagacgcgtgcggcactggatgtattctcctgtgattctgaccatcctcgccattggactggctgagggctgcgatgaaatggttcatgcggacagcaaacttgtctcctgtagacaggggagcggcaacatgaaggagtgcatcacaacgggacgcgccctgctccccgctgtgaatcctggccaggaggcctgtctgcacttcaccgcccccgggtctccggattccaagtgcctgaaaatcaaggtgaaacggattaacatcaagtgtaaaaagagctcctcttactttgtcagagacgctcgcagccggtgcacatccgtgagacgctgtcggtgggccggagattgccagtctggctgccctccccacttcaccagcaattccttttctgacgactgggcggggaagatggatagagctggactcggcttcagcgggtgttccgacggctgcggaggcgccgcctgtgggtgctttaacgctgcccctagctgtattttctggcggaaatgggttgaaaatccccatggaatcatttggaaggtgtctccttgcgctgcctgggtcccctccgcggtgatcgagctgacaatgccgagcggcgaagttcgcacctttcaccctatgtctgggatccccacgcaagtgttcaaaggagtctccgtgacatatcttggcagcgatatggaggtttctggcctgaccgacctctgtgaaattgaggagctgaagtccaaaaagctggcccttgctccctgcaaccaggccgggatgggagtggtcggcaaagtgggggaaaagcagtgtagctccgaggaaagcgctagaaccatcaagaaagatggatgcatttggaacgccgacctcgtgggcatcgagctgcgggtcgatgacgcggtttgttactctaagattacaagcgtggaagccgtggctaattattccgccatccctaccacaatcgggggactgagattcgagcgctctcatgatagccagggcaaaatttccggctctccgctcgacatcacggctattcgggggagcttttccgtcaactacagaggactgcgcctttctctgagcgagatcaccgccacatgcaccggcgaagtgacaaatgtttccgggtgctacagctgtatgaccggagccaaggtgtctattaaactccactccagcaagaactctacggctcacgtcagatgcaagggcgatgagaccgcgttctccgtgctggaaggggttcatagctatatcgtgtccctgtcttttgaccacgccgtcgtggatgagcaatgtcagcttaattgcggaggccatgaaagccaggttacactcaaaggcaacctgatcttcctggacgtgcccaagtttgtcgacgggtcctacatgcagacctatcacagcacagtgcctaccggagctaatattccctctcctacggattggctcaacgccctgttcggcaatgggctttcccggtggatcctgggagtgattggcgtcctccttgggggactggccctgtttttcctcatcatgtttctgctgaaactcggcacaaagcaagttttccgcagcagaaccaaactggcttga

SEQ ID NO: 14899 - RNA, 3222 nt, synthetic construct
  misc_feature 1..3222: note = derived and/or modified CDS sequence (opt5) from SFTSV/FTLSV(2012YSH92)__KF711941.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactctcactcccggtggagcggactcctgtctccttgcgatgcggactggcttggcatgctggtcgtgaaaaaggctaaaggctccgatatgattgttcccgggcctagctacaagggaaaggtgtttttcgagcgccccacctttgacggctatgtcgggtggggatgtggctctgggaaatccagaacagaaagcggagagctctgctcctctgatagcggcacgtccagcggcctgctgccttctaatcgggtgctctggatcggggacgttgcctgtcagccgatgacccccattcctgaagagacattcctggagcttaagtcctttagccagtctgaatttcccgatatctgcaaaattgacggaatcgtgtttaaccagtgtgagggcgaaagcctgcctcaacccttcgatgtcgcctggatggacgtggggcattcccacaagatcattatgcgcgagcacaaaaccaagtgggtgcaggagtctagctccaaggattttgtctgctacaaagaaggaacaggcccgtgtagcgagtctgaagagaagacctgcaaaacatccgggagctgcagaggagacatgcagttctgtaaggttgctggctgcgaacatggcgaggaggcctctgaagctaaatgtcggtgctccctcgtgcacaagcctggggaggtggtcgtgagctatggaggcatgcgcgttagacccaaatgttacgggttttcccggatgatggccaccctggaagtgaatcagcctgagcaacgcatcggacagtgcacgggctgtcatcttgaatgcattaacgggggcgtcagactgatcaccctcacatctgagctgaagtctgcgaccgtgtgtgcctcccacttctgctctagcgctacatccggaaagaaaagcaccgagattcagttccactctggctccctggttgggaagacggccatccatgtgaaaggagctctcgtcgacggcacagaatttaccttcgaggggagctgtatgtttcccgatggatgcgacgccgtggattgcacattctgtcgggaatttctgaagaatccccaatgctaccctgcgaaaaagtggcttttcatcattatcgtcattctgctcggctatgccgggctgatgcttctgaccaacgtgctcaaggctatcggcatttggggatcttgggttatcgccccggtgaaactgatctttgctattatcaagaaactgatgcgcaccgtctcctgtctcatgggcaagctgatggacagagggagacaggtgattcacgaggaaatcggagagaatcgggagggcaaccaggatgacgttcgcattgaaatggcccggcccagacgcgtgcggcattggatgtacagccctgtcatccttacaattctggccatcgggctcgctgagtcttgcgatgaaatggtgcacgcggacagcaaactggtgtcctgtagacagggaagcggcaatatgaaggagtgcgttacgaccgggcgcgcccttctgcccgctgtcaaccctggccaagaggcctgtctccatttcacagcccccggatctccggattccaagtgcctgcggatcaaagtgaagagaattaatctgaaatgtaagaaaagctcctcttattttgtgcctgacgctcgcagccggtgcacctccgtcagacgctgtcggtgggccggcgattgccagtctgggtgtccccctcacttcacaagcaactccttttctgacgactgggcgggaaagatggatagagctggcctcgggttcagcggatgctccgacggctgcgggggcgccgcctgtggatgctttaatgctgcccccagctgtatcttctggcggaagtgggtggaaaaccctcacggcattatctggaaagtttctccctgcgctgcctgggtgccgtccgcggtcattgagctgaccatgcctagcggggaagtgcgcacgttccatcccatgtctggaatccccacacaggtttttaagggcgtgtccgtcacctaccttgggagcgatatggaggtgtctggactgaccgacctctgtgaaatcgaggagctgaaatccaagaaactggcccttgctccttgcaaccaggccggcatgggcgttgtggggaaggtcggagaaattcaatgtagctccgaggaaagcgctagaacaatcaaaaaggatggctgcatttggaatgccgacctcgtggggatcgagctgcgggtggatgacgcggtctgttattctaagattaccagcgttgaagccgtggctaactactccgccatcccgacaacgatcggaggcctgagattcgagcgctctcacgatagccaggggaaaatttccggatctcccctcgacatcaccgctattcggggcagcttttccgtgaattatagaggcctgcgcctttctctgagcgagatcacagctacctgcacaggggaagtcaccaacgtgtccggatgctacagctgtatgacgggcgccaaggtttctattaaactccattccagcaagaatagcaccgcccacgtgagatgcaaaggggatgagacagcgttctccgtcctggaaggagtgcacagctacaccgtttccctgtcttttgaccatgccgtggtcgatgagcagtgtcagcttaactgcggcgggcacgaaagccaagtgacactcaagggaaatctgatcttcctggacgttcctaagtttgtggacggctcctatatgcagacctaccatagcacggtccccacaggcgctaacatcccttctcccaccgattggctcaatgccctgttcgggaacggactttcccggtgggtgctgggcgtgatgggggtcctcctgggaggcctggcccttttcttcatgattatgagcctctttaaactggggacaaagcaggttttccgctctagaaccaaactggcttga

SEQ ID NO: 14900 - RNA, 3222 nt, synthetic construct
  misc_feature 1..3222: note = derived and/or modified CDS sequence (opt5) from SFTSV/FTLSV(2012YSH93)__KF711946.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctaatcgggtgctctggatcggggacgttgcctgtcagccgatgacccccattcctgaagagacattcctggagcttaagtcctttagccagtctgaatttcccgatatctgcaaaattgacggaatcgtgtttaaccagtgtgagggcgaaagcctgcctcaacccttcgatgtcgcctggatggacgtggggcactcccataagatcattatgcgcgagcacaaaaccaagtgggtgcaggagtctagctccaaggattttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaatcagcctgagcaacgcatcggacagtgcacgggctgtcaccttgaatgcattaacgggggcgtcagactgatcaccctcacatctgagctgaagtccgcgaccgtgtgtgcctcccatttctgctctagcgctacatccggaaagaaaagcaccgagattcagttccactctggctccctggttgggaagacggccatccacgtgaaaggagctctcgtcgacggcacagaatttaccttcgaggggagctgtatgtttcccgatggatgcgacgccgtggattgcacattctgtcgggaatttctgaagaatccccaatgctatcctgcgaaaaagtggcttttcatcattatcgtcattctgctcggctacgccgggctgatgcttctgaccaacgtgctcaaggctatcggcatttggggatcttgggttatcgccccggtgaaactgatctttgctattatcaagaaactgacccgcacagtctcctgtctcatgggcaagctgatggacagagggagacaggtgattcatgaggaaatcggagagaatcgggagggcaaccaggatgacgttcgcattgaaatggcccggcccagacgcgtgcggcactggatgtatagccctgtcatccttacgattctggccatcgggctcgctgagtcttgcgatgaaatggtgcatgcggacagcaaactggtgtcctgtagacagggaagcggcaatatgaaggagtgcgttaccacagggcgcgcccttctgcccgctgtcaaccctggccaagaggcctgtctccacttcaccgcccccggatctccggattccaagtgcctgaaaatcaaggtgaaacggattaatctgaagtgtaaaaagagctcctcttactttgtgcctgacgctagatatcgctgcacaagcgtccggagatgtcgctgggccggcgattgccagtccgggtgtccccctcatttcacctctaacagcttttccgacgactgggcgggaaagatggatcgggctggcctcgggttctctggatgcagcgacggctgcgggggcgccgcctgtggatgctttaatgctgccccctcctgtatcttctggagaaaatgggtggaaaaccctcacggcattatctggaaggttagcccctgcgctgcctgggtgccgtctgcggtcattgagctgacgatgccttccggggaagtgcggacattccaccccatgagcggaatccccacccaggtttttaaaggcgtgtctgtcacctaccttgggtccgatatggaggtgagcggactgacagacctctgtgaaatcgaggagctgaagtctaaaaagctggcccttgctccttgcaaccaggccggcatgggcgttgtggggaaagtcggagaaattcaatgttccagcgaggaatccgctcgcaccatcaagaaggatggctgcatttggaatgccgacctcgtggggatcgagctgagagtggatgacgcggtctgttatagcaaaattacatctgttgaagccgtggctaactacagcgccatcccgacgaccatcggaggcctgcggttcgagagatcccatgattctcaggggaagattagcggaagccccctcgacatcacagctattcgcggctcttttagcgtgaattaccggggcctgagactttccctgtctgagatcaccgccacatgcaccggggaagtcacgaacgtgagcggatgctattcctgtatgaccggcgccaaagttagcattaagctccactcttccaaaaatagcacagctcatgtgcgctgcaagggggatgagaccgcgttctctgtcctggaaggagtgcactcctacacagttagcctgtcctttgaccacgccgtggtcgatgagcagtgtcagcttaactgcggcgggcatgaatctcaagtgaccctcaagggaaatctgatcttcctggacgttcctaaatttgtggacggcagctatatgcagacgtaccactccacagtccccaccggcgctaacatccctagccccacagattggctcaatgccctgttcgggaacggactttctagatgggtgctgggcgtgatgggggtcctcctgggaggcctggcccttttcttcatgattatgtccctctttaagctggggaccaaacaggttttccggagccgcaccaagctggcttga

SEQ ID NO: 14901 - RNA, 3222 nt, synthetic construct
  misc_feature 1..3222: note = derived and/or modified CDS sequence (opt5) from SFTSV/FTLSV(YGS1)__KF356537.1__GP
  source 1..3222: mol_type = other RNA
atgatgaaggtgatctggttcagctccctggtctgcctcgttattcagtgttctggcgacagcgggcccatcatttgcgccggacctatccactccaacaaatctgctgccattccgcatctgcttggctacagcgagaagatctgtcaaatcgatagactgattcacgtgtcctcttggctccggaatcatagccagtttcaggggtatgtgggacagcgcggcgggagatcccaagtcagctactatcccgcggaaaactcttactcccggtggagcggactgctttctccttgcgacgctgattggctgggcatgctcgtggttaaaaaggccaaaggctccgacatgatcgtgcccgggcctagctataagggaaaggtcttctttgagcgccccaccttcgatggctacgtggggtggggatgtggctctgggaaatccagaacagaaagcggagagctgtgctcctctgacagcggcacgtccagcggcctgctcccttctgatcgggttctgtggattggggacgtggcctgtcagccgatgacccccatccctgaagagacatttcttgagctgaagtccttcagccagtctgaatttcccgatatttgcaaaatcgacggaattgtcttcaatcagtgtgagggcgaaagcctccctcaaccctttgatgtggcttggatggacgtggggcactcccataagatcatcatgcgcgagcacaaaaccaagtgggtccaggagtctagctccaaggatttcgtttgctataaagaaggaacaggcccgtgtagcgagtctgaagagaaggcctgcaaaacctccgggagctgcagaggagacatgcagttttgtaaggtggctggctgcgaacacggcgaggaggcctctgaagcgaaatgtcggtgctccctggtgcataagcctggggaggtcgtggttagctacggaggcatgcgcgtgagacccaaatgttacgggttctcccggatgatggccacaatggaagtcaaccctcccgagcagcgcattggacaatgcaccggctgtcaccttgaatgcatcaatgggggcgtgagactgattacgctcacctctgagctcaagagcgctacagtttgtgcctcccatttttgctctagcgctacctccggaaagaaaagcacagagatccacttccactctggctccctggtggggaagaccgccattcatgtcaaaggagcgctggtggacggcacggaatttacatttgaggggagctgtatgttccccgatggatgcaacgccgtcgactgcaccttttgtcgggagttcctgaagaatcctcagtgctatccggctaaaaagtggctttttatcatcattgtgatcctgctcggctacgccgggctgatgcttctgacaaacgttctcaaggctattggcgtgtggggatcttgggtcatcgcccccgtgaaactgatgttcgccattatgaagaaactgatgcgcaccgtttcctgtctcgtgggcaagctgatggatagagggcggcaggtcatccacgaagaaatcggagagaatggcgaggggaaccatgacgatgtgagaattgaaatggctcgccctcggagagtgcgccactggatgtatagccccgttatccttaccattctggcgatcggactcgccgagggctgcgacgaaatggtccatgctgattctaaactggtgagctgtcggcaagggtccggcaatatgaaggagtgcgtgacaacggggagagcccttctgcctagcgtcaaccccggccaggaggcctgtctccactttaccgctccggggtctcctgactccaagtgcctgaaaattaaggtgaaacgcatcaatctgaagtgtaaaaagagctcctcttacttcgttcccgatgcccggagcagatgcacatccgtgcgccggtgtagatgggcgggagactgccagtctggctgccctccccactttaccagcaactccttctctgatgactgggctgggaagatggaccgcgccggactcggctttagcgggtgttccgatggctgcggaggcgccgcttgtgggtgcttcaatgccgctcctagctgtattttctggcggaaatgggtcgaaaactctcatggaatcatctggaaggtgtccccctgcgccgcgtgggttccgagcgccgtgattgagctgacaatgccttctggcgaagtcagaaccttccaccccatgtccgggatccccacacaggtgttcaaaggagttagcgtgacgtatcttggctctgacatggaggtctccggcctgaccgatctctgtgaaattgaggagcttaagagcaaaaagctggctctggccccttgcaaccaagctgggatgggagtggtgggcaaagtcggggaaatccagtgttccagcgaggaatctgcccggaccattaagaaggacggatgcatctggaatgcggatctcgttggcatcgagctgcgcgtggacgatgccgtgtgttacagcaaaattacatccgtcgaagctgtggccaactattctgctatcccgaccacaattgggggactgagatttgagcggagccatgactcccagggcaagatctctggcagccccctcgatattacggccatcagagggtccttctctgttaattaccgcggactgcggcttagcctgtccgagatcaccgccacatgcaccggcgaagtgacaaacgtcagcgggtgctactcttgtatgaccggagctaaagtgtccattaagctccacagctctaaaaattccacggcgcacgttagatgcaagggcgacgagaccgcctttagcgtgctggaaggggtccattcctatacagtgtctctgagcttcgatcacgctgttgtggacgagcagtgtcaacttaactgcggaggccatgaatcccaggtcaccctcaagggcaatctgatctttctggatgtgcctaaattcgtggacgggagctacatgcagacatatcactctaccgtccccacgggagccaacattccttcccccacagactggctcaatgccctgtttggcaacgggcttagccgctggatcctgggagttattggcgtgctcctgggaggactggctcttttctttctcatcatgttcctgtttaagctgggcaccaaacaggtgttcagatctcggacaaagctcgcctga

SEQ ID NO: 14902 - RNA, 3222 nt, synthetic construct
  misc_feature 1..3222: note = derived and/or modified CDS sequence (opt5) from SFTSV/FTLSV(YNY1)__KF356538.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagctcaagagcgcgaccgtgtgtgcctcccatttctgctctagcgctacatccggaaagaaaagcaccgagattcagttccactctggctccctggttgggaagacggccatccacgtgaaaggagctctggtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgtttggctacgccgggctcatgctgcttaccaatgtgctgaaggctatcggcatttggggatcttgggttatcgccccggtgaaactcatcttcgctattatcaagaaactgatgcgcaccgtctcctgtctgatgggcaagctcatggatagagggagacaggtgattcatgaggaaatcggagagaaccgggagggcaatcaggacgatgttcgcattgaaatggcccggcccagacgcgtgcggcactggatgtatagccctgtcatcctgacaattcttgccatcgggctggctgagtcttgcgacgaaatggtgcatgcggatagcaaactcgtgtcctgtagacagggaagcggcaacatgaaggagtgcgttacgaccgggcgcgccctgcttcccgctgtcaatcctggccaagaggcctgtctgcactttacagcccccggatctccggactccaagtgcctcaaaatcaaggtgaaacggattaacctgaagtgtaaaaagagctcctcttacttcgtgcctgatgctagaagccgctgcacctccgtccggagatgtcgctgggccggcgactgccagtctgggtgtccccctcattttacaagcaattccttctctgacgattgggcgggaaagatggaccgggctggcctggggtttagcggatgctccgatggctgcgggggcgccgcctgtggatgcttcaacgctgcccccagctgtatcttctggagaaaatgggtggaaaatcctcacggcattatctggaaggtttctccctgcgctgcctgggtgccgtccgcggtcattgagctcaccatgcctagcggggaagtgcggacgtttcaccccatgtctggaatccccacacaggttttcaaaggcgtgtccgtcacctatctggggagcgacatggaggtgtctggacttaccgatctgtgtgaaatcgaggagctcaagtccaaaaagctggccctggctccttgcaaccaggccggcatgggcgttgtggggaaagtcggagaaattcaatgtagctccgaggaaagcgctcgcacaatcaagaaggacggctgcatttggaacgccgatcttgtggggatcgagctcagagtggacgatgcggtctgttactctaaaattaccagcgttgaagccgtggctaattattccgccatcccgacaacgatcggaggcctgcggtttgagagatctcatgacagccaggggaagatttccggatctcccctggatatcaccgctattcgcggcagcttctccgtgaactaccggggcctcagactgtctcttagcgagatcacagctacctgcacaggggaagtcaccaatgtgtccggatgctacagctgtatgacgggcgccaaagtttctattaagctgcactccagcaaaaactctaccgcccatgtgcgctgcaagggggacgagacagcgttttccgtcctcgaaggagtgcacagctataccgtttccctgtctttcgatcacgccgtggtcgacgagcagtgtcagctgaattgcggcgggcatgaaagccaagtgacacttaagggaaacctcatctttctggacgttcctaaattcgtggatggctcctacatgcagacctatcacagcacggtccccacaggcgctaatatcccttctcccaccgactggctgaacgccctctttgggaatggactgtccagatggattcttggcgtgatgggggtgctgctcggaggcctggccctgttctttatgatcatgagccttttcaagctcgggacaaaacaggtctttcggtctcgcaccaagctggcttga

SEQ ID NO: 14903 - RNA, 3222 nt, synthetic construct
  misc_feature 1..3222: note = derived and/or modified CDS sequence (opt5) from SFTSV/FTLSV(YPQ133)__KF356530.1__GP
  source 1..3222: mol_type = other RNA
atgatgaaggtgatctggttcagctccctgatttgctttgtcatccagtgttctggcgacagctcccccattatctgcgccgggcctattcactctaacaaaagcgctgatatcccgcatctcctgggatactccgagaagatctgtcaaattgacagacttatccacgtttctagctggctgcggaatcattcccagttccagggctatgtggggcagcgcggaggcagaagccaagtgtcttactatcccgccgaaaactcctacagccggtggtctgggctcctgtccccttgcgatgcggactggcttggaatgctggtcgtgaaaaaggctaaaggcagcgatatgattgttcccggcccttcttataaggggaaggtgtttttcgagcgccccacctttgacggatacgtcggctgggggtgtggatccggcaaaagcagaacagaatccggggagctctgctctagcgattccggaacgagctctggcctgctgccttccgaccgggtgctctggatcggcgatgttgcctgtcagccgatgacccccattcctgaagagacattcctggagcttaagagcttttctcagagcgagttccccgacatctgcaaaattgatgggatcgtgtttaatcagtgtgaaggagaatccctgcctcaacccttcgacgtcgcctggatggatgtgggccactctcagaagatcattatgcgcgagcataaaaccaagtgggtgcaggagagctccagcaaggactttgtctgctataaagaagggacaggaccgtgttctgagtccgaagagaagacctgcaaaacaagcggctcttgcagaggggacatgcagttctgtaaggttgctggatgcgaacacggcgaggaggcctccgaagctaaatgtcggtgcagcctcgtgcacaagcctggcgaggtggtcgtgtcctacgggggaatgcgcgttagacccaaatgttacggcttttctcggatgatggccaccctggaagtgaaccaacctgagcagcgcatcgggcagtgcacgggatgtcatcttgaatgcattaatggcggggtcagactgatcaccctcacaagcgagctgaagtccgcgaccgtgtgtgcctctcacttctgcagctccgctacaagcggcaagaaatctaccgagattcaattccattccggaagcctggttggcaagacggccatccacgtgaaaggggctctcgtcgatggaacagaatttaccttcgagggctcttgtatgtttcccgacgggtgcgatgccgtggactgcacattctgtcgggaatttctgaagaacccccagtgctatcctgcgaaaaagtggcttttcatcattatcgtcattctgctcggatacgccggcctgatgcttctgaccaatgtgctcaaggctatcgggatttggggctcctgggttatcgccccggtgaaactgatctttgctattatcaagaaactgatgcgcaccgtcagctgtctcatgggaaagctgatggatagaggcagacaggtgattcacgaggaaatcggggagaaccgggagggaaatcaggacgatgttcgcattgaaatggcccggcccagacgcgtgcggcattggatgtattctcctgtcatccttacaattctggccatcggcctcgctgagagctgcgacgaaatggtgcacgcggattccaaactggtgagctgtagacaagggtctggaaacatgaaggagtgcgttacgaccggccgcgcccttctgcccgctgtcaatcctgggcaggaggcctgtctccatttcacagcccccggctccccggacagcaagtgcctgaaaatcaaggtgaaacggattaacctgaagtgtaaaaagtcctctagctactttgtgcctgatgctagatcccgctgcacctctgtccggagatgtcgctgggccggagactgccagagcggctgtccccctcacttcacatccaattcttttagcgacgattgggcggggaagatggaccgggctggactcggcttctccgggtgcagcgatggatgcggcggggccgcctgtggctgctttaacgctgccccctcttgtatcttctggagaaaatgggtggaaaatcctcatggagttatttggaaggtgtccccctgcgctgcctgggtcccgagcgcggtgatcgagctgaccatgccttctggcgaagttcggacgttccaccccatgtccgggattcccacacaggtgtttaaaggagtcagcgtgacctatcttggctctgacatggaggtttccgggctgaccgatctctgtgaaatcgaggagcttaagagcaaaaagctggcccttgctccttgcaaccaagccggaatgggcgtggtcggcaaagtgggggaaatccagtgttccagcgaggaatctgctcgcacaattaagaaggacggatgcatctggaacgccgatctcgtgggcattgagctgagagtcgacgatgcggtttgttacagcaaaatcacctccgtggaagccgtggctaattattctgccattccgacaacgatcgggggactgcggttcgagagaagccacgactcccagggcaagatctctgggagccccctcgatattaccgctatccgcggatccttttctgtcaactaccggggcctgagacttagcctgtccgagattacagctacctgcacaggcgaagtgaccaatgttagcgggtgctactcttgtatgacgggagccaaagtgtccatcaagctccatagctctaaaaactccaccgcccacgtccgctgcaagggcgacgagacagcgttcagcgtgctggaaggggttcattcctataccgtgtctctgagctttgatcacgccgtcgtggacgagcagtgtcaacttaattgcggaggccacgaatcccaggttacactcaaggggaacctgattttcctggacgtgcctaaatttgtcgatggaagctacatgcagacctatcattctacggtgcccacaggcgctaatatcccttcccccaccgactggctcaacgccctgttcggcaatgggcttagcagatggatcctgggagtgatgggcgtcctcctcgggggactggccctgtttttcatgattatgtctctgtttaagctgggcacaaaacaggttttccggagccgcaccaagctggcttga

SEQ ID NO: 14904 - RNA, 3222 nt, synthetic construct
  misc_feature 1..3222: note = derived and/or modified CDS sequence (opt5) from SFTSV/FTLSV(YPQ2)__KF356531.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagctgaagtccgcgaccgtgtgtgcctcccatttctgctctagcgctacatccggaaagaaaagcaccgagattcagttccactctggctccctggttgggaagatcgccatccacgtgaaaggagctctcgtcgatggcacggaatttacattcgaggggagctgtatgtttcccgacggatgcgatgccgtggactgcaccttctgtcgggaatttctgaagaacccccaatgctatcctgcgaaaaagtggcttttcattatcattgtcatcctgctcggctacgccgggctgatgcttctgacaaatgtgctcaaggctattggcatctggggatcttgggttatcgccccggtgaaactgatttttgctatcattaagaaactgatgcgcaccgtctcctgtctcatgggcaagctgatggatagagggagacaggtgatccatgaggaaattggagagaaccgggagggcaatcaggacgatgttcgcatcgaaatggcccggcccagacgcgtgcggcactggatgtatagccctgtcattcttaccatcctggccatcgggctcgctgagtcttgcgacgaaatggtgcatgcggatagcaaactggtgtcctgtagacagggaagcggcaacatgaaggagtgcgttacaacggggcgcgcccttctgcccgctgtcaatcctggccaagaggcctgtctccacttcaccgcccccggatctccggactccaagtgcctgaaaattaaggtgaaacggatcaacctgaagtgtaaaaagagctcctcttactttgtgcctatggctagattccgctgcacaagcgtccggagatgtcgctgggccggcgattgccagtccgggtgtccccctcattttacctctaatagcttctccgacgactgggcgggaaagatggatcgggctggcctcgggttttctggatgcagcgacggctgcgggggcgccgcctgtggatgcttcaacgctgccccctcctgtattttctggagaaaatgggtggaaaatcctcacggcatcatttggaaggttagcccctgcgctgcctgggtgccgtctgcggtcatcgagctgacaatgccttccggggaagtgcggacctttcaccccatgagcggaatccccacgcaggttttcaaaggcgtgtctgtcacatatcttgggtccgatatggaggtgagcggactgaccgacctctgtgaaattgaggagctgaagtctaaaaagctggcccttgctccttgcaaccaggccggcatgggcgttgtggggaaagtcggagaaatccaatgttccagcgaggaatccgctcgcaccattaagaaggatggctgcatctggaacgccgacctcgtggggattgagctgagagtggatgacgcggtctgttacagcaaaatcacatctgttgaagccgtggctaattatagcgccatcccgaccacaattggaggcctgcggtttgagagatcccatgattctcaggtgaagatcagcgggagccccctcgacattacggctatgcgcggatctttcagcgtcaactaccggggcctgagactttccctgtctgagatcaccgccacatgcaccggcgaagtgacaaatgttagcgggtgctactcctgtatgaccggagccaaagtgagcattaagctccactcttccaaaaacagcacggctcatgtccgctgcaagggcgatgagaccgcgttttctgtgctggaaggggttcactcctatacagtgagcctgtccttcgaccacgccgtcgtggatgagcagtgtcagcttaattgcggaggccatgaatctcaagttaccctcaaggggaacctgatctttctggacgtgcctaaattcgtcgacggaagctacatgcagacatatcactccaccgtgcccacgggcgctaatatccctagccccacagattggctcaacgccctgtttggcaatgggctttctagatggattctgggagtgatgggcgtcctccttgggggactggccctgttctttatgatcatgtccctcttcaagctgggcaccaaacaggtttttcggagccgcacaaagctggcttga

SEQ ID NO: 14905 - RNA, 3222 nt, synthetic construct
  misc_feature 1..3222: note = derived and/or modified CDS sequence (opt5) from SFTSV/FTLSV(YPQ5)__KF356532.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccgggtgagctactatcccgccgaaaactcttactcccgctggagcggactcctgtctccttgcgatgcggactggcttggcatgctggtcgtgaaaaaggctaaaggctccgatatgattgttcccgggcctagctataagggaaaggtgtttttcgagagacccacctttgacggctacgtcgggtggggatgtggctctgggaaatcccggacagaaagcggagagctctgctcctctgatagcggcacgtccagcggcctgctgccttctgaccgcgtgctctggatcggggatgttgcctgtcaaccgatgacccccattcctgaagagacattcctggagcttaagtcctttagccagtctgaatttcccgacatctgcaaaattgatggaatcgtgtttaatcagtgtgagggcgaaagcctgcctcagcccttcgacgtcgcctggatggatgtggggcactcccataagatcattatgagagagcacaaaaccaagtgggtgcaagagtctagctccaaggactttgtctgctataaagaaggaacaggcccgtgtagcgagtctgaagagaagacctgcaaaacatccgggagctgccggggagacatgcagttctgtaaggttgctggctgcgaacacggcgaggaggcctctgaagctaaatgtcgctgctccctcgtgcataagcctggggaggtggtcgtgagctacggaggcatgagagttcggcccaaatgttacgggttttcccgcatgatggccaccctggaagtgaaccagcctgagcagagaatcggacaatgcacgggctgtcaccttgaatgcattaatgggggcgtccggctgatcaccctcacatctgagctgaagtccgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgcgaatttctgaagaacccccagtgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgagaaccgtctcctgtctcatgggcaagctgatggatcgggggagacaagtgattcatgaggaaatcggagagaaccgcgagggcaatcaggacgatgttcggattgaaatggccagaccccgccgggtgagacactggatgtatagccctgtcatccttacaattctggccatcgggctcgctgagtcttgcgacgaaatggtgcatgcggatagcaaactggtgtcctgtcgccagggaagcggcaacatgaaggagtgcgttacgaccgggcgggcccttctgcccgctgtcaatcctggccaggaggcctgtctccacttcacagcccccggatctccggactccaagtgcctgaaaatcaaggtgaaaagaattaacctgaagtgtaaaaagagctcctcttactttgtgcctgtcgctcgctatcggtgcaccagcgtgagacgctgtcggtgggccggcgattgccaatccgggtgtccccctcatttcacatctaatagcttttccaacgactgggcgggaaagatggacagagctggcctcgggttctctggatgcagcgatggctgcgggggcgccgcctgtggatgctttaatgctgccccctcctgtatcttctggcggaaatgggttgaaaaccctcacggcattatctggaaggtgagcccctgcgctgcctgggtcccgtctgcggtgattgagctgaccatgccttccggggaagttcgcacgttccaccccatgagcggaatccccacacaggtgtttaaaggcgtctctgtgacctaccttgggtcctatatggaggttagcggactgaccgacctctgtgaaatcgaggagctgagatctaagaaactggcccttgctccttgcaaccaggccggcatgggcgtggtcgggaaggtgggagaaattcagtgttccagcgaggaatccgctcggacaatcaaaaaggatggctgcatttggaatgccgacctcgtggggatcgagctgagagtcgatgacgcggtttgttacagcaagattacctctgtggaagccgtggctaactacagcgccatcccgacaacgatcggaggcctgcgcttcgagcggtcccatgattctcaagggaaaattagcggaagccccctcgacatcaccgctattagaggctcttttagcgtcaattatcgcggcctgagactttccctgtctgagatcacagctacctgcacaggggaagtgaccaacgttagcggatgctactcctgtatgacgggcgccaaggtgagcattaaactccactcttccaagaatagcaccgcccatgtccggtgcaaaggggatgagacagcgttctctgtgctggaaggagttcactcctataccgtgagcctgtcctttgaccacgccgtcgtggatgagcagtgtcagcttaactgcggcgggcatgaatctcaggttacactcaagggaaatctgatcttcctggacgtgcctaagtttgtcgatggcagctacatgcaaacctatcactccacggtgcccacaggcgctaacatccctagccccaccgactggctcaatgccctgttcgggaacggactttctcgctggattctgggcgtgatgggggtcctcctgggaggcctggcccttttcttcatgatcatgtccctctttaaactggggacaaagcaggttttcagaagccggaccaaactggcttga

SEQ ID NO: 14906 - RNA, 3222 nt, synthetic construct
  misc_feature 1..3222: note = derived and/or modified CDS sequence (opt5) from SFTSV/FTLSV(YSC19)__KF356536.1__GP
  source 1..3222: mol_type = other RNA
atgatgaaggtgatctggttcagctccctggtctgcctcgttattcagtgttctggcgacagcgggcccatcatttgcgccggacctatccactccaacaaatctgctgccattccgcatctgcttggctacagcgagaagatctgtcaaatcgatagactgattcacgtgtcctcttggctccggaatcatagccagtttcaggggtatgtgggacagcgcggcgggagatcccaagtcagctactatcccgcggaaaactcttactcccggtggagcggactgctttctccttgcgacgctgattggctgggcatgctcgtggttaaaaaggccaaaggctccgacatgatcgtgcccgggcctagctataagggaaaggtcttctttgagcgccccaccttcgatggctacgtggggtggggatgtggctctgggaaatccagaacagaaagcggagagctgtgctcctctgacagcggcacgtccagcggcctgctcccttctgatcgggttctgtggattggggacgtggcctgtcagccgatgacccccatccctgaagagacatttcttgagctgaagtccttcagccagtctgaatttcccgatatttgcaaaatcgacggaattgtcttcaatcagtgtgagggcgaaagcctccctcaaccctttgatgtggcttggatggacgtggggcactcccataagatcatcatgcgcgagcacaaaaccaagtgggtccaggagtctagctccaaggatttcgtttgctataaagaaggaacaggcccgtgtagcgagtctgaagagaaggcctgcaaaacctccgggagctgcagaggagacatgcagttttgtaaggtggctggctgcgaacacggcgaggaggcctctgaagcgaaatgtcggtgctccctggtgcataagcctggggaggtcgtggttagctacggaggcatgcgcgtgagacccaaatgttacgggttctcccggatgatggccacaatggaagtcaaccctcccgagcagcgcattggacaatgcaccggctgtcaccttgaatgcatcaatgggggcgtgagactgattacgctcacctctgagctcaagagcgctacagtttgtgcctcccatttttgctctagcgctacctccggaaagaaaagcacagagatccacttccactctggctccctggtggggaagaccgccattcatgtcaaaggagcgctggtggacggcacggagttcacatttgaagggagctgtatgttccccgatggatgcaacgccgtcgactgcaccttttgtcgggagttcctgaagaatcctcagtgctatccggctaaaaagtggctttttatcatcattgtgatcctgctcggctacgccgggctgatgcttctgacaaacgttctcaaggctattggcgtgtggggatcttgggtcatcgcccccgtgaaactgatgttcgccattatgaagaaactgatgcgcaccgtttcctgtctcgtgggcaagctgatggatagagggcggcaggtcatccacgaagaaatcggagagaatggcgaggggaaccatgacgatgtgagaattgaaatggctcgccctcggagagtgcgccactggatgtatagccccgttatccttaccattctggcgatcggactcgccgagggctgcgacgaaatggtccatgctgattctaaactggtgagctgtcggcaagggtccggcaatatgaaggagtgcgtgacaacggggagagcccttctgcctagcgtcaaccccggccaggaggcctgtctccactttaccgctccggggtctcctgactccaagtgcctgaaaattaaggtgaaacgcatcaatctgaagtgtaaaaagagctcctcttacttcgttcccattgcccggaacagatgcacaagcgtgcgccggtgtagatgggcgggagattgccagtccggctgccctccccactttacctctaatagcttctccgacgattgggctgggaagatggaccgcgccggactcggcttttctgggtgtagcgacggctgcggaggcgccgcttgtgggtgcttcaacgccgctccttcctgtatcttttggcggaaatgggtcgaaaacagccatggaatcatttggaaggtgtctccctgcgccgcgtgggttccgtccgccgtgatcgagctgacaatgcctagcggcgaagtcagaaccttccaccccatgtctgggattcccacacaggtgttcaaaggagtttccgtgacgtatcttggcagcgatatggaggtctctggcctgaccgacctctgtgaaatcgaggagctgaagtccaaaaagctggctcttgccccttgcaatcaagctgggatgggagtggtgggcaaagtcggggaaattcagtgtagctccgaggaaagcgcccggaccatcaagaaggatggatgcatctggaacgcggacctcgttggcattgagctgcgcgtggatgacgccgtgtgttactctaaaatcacaagcgtcgaagctgtggccaattattccgctattccgaccacaatcgggggactgagatttgagcggtctcatgatagccagggcaagatttccggctctcccctcgacatcacggccatcagagggagcttctccgttaactaccgcggactgcggctttctctgagcgagattaccgccacatgcaccggcgaagtgacaaatgtctccgggtgctacagctgtatgaccggagctaaagtgtctatcaagctccactccagcaaaaactctacggcgcacgttagatgcaagggcgatgagaccgccttttccgtgctggaaggggtccatagctatacagtgtccctgtctttcgaccacgctgttgtggatgagcagtgtcaacttaattgcggaggccatgaaagccaggtcaccctcaagggcaacctgatttttctggacgtgcctaaattcgtggatgggtcctacatgcagacatatcacagcaccgtccccacgggagccaatatcccttctcccacagactggctcaacgccctgtttggcaatgggctttcccgctggattctgggagttatcggcgtgctcctgggaggactggctcttttctttctcatcatgttcctgtttaagctgggcaccaaacaggtgttcagaagccggacaaagctcgcctga

SEQ ID NO: 14907 - RNA, 3222 nt, synthetic construct
  misc_feature 1..3222: note = derived and/or modified CDS sequence (opt5) from SFTSV/FTLSV(YSC3)__KF356535.1__GP
  source 1..3222: mol_type = other RNA
atgatgaaggtgatctggttcagctccctggtctgcctcgttattcagtgttctggcgacagcgggcccatcatttgcgccggacctatccactccaacaaatctgctgccattccgcatctgcttggctacagcgagaagatctgtcaaatcgatagactgattcacgtgtcctcttggctccggaatcatagccagtttcaggggtatgtgggacagcgcggcgggagatcccaagtcagctactatcccgcggaaaactcttactcccggtggagcggactgctttctccttgcgacgctgattggctgggcatgctcgtggttaaaaaggccaaaggctccgacatgatcgtgcccgggcctagctataagggaaaggtcttctttgagcgccccaccttcgatggctacgtggggtggggatgtggctctgggaaatccagaacagaaagcggagagctgtgctcctctgacagcggcacgtccagcggcctgctcccttctgatcgggttctgtggattggggacgtggcctgtcagccgatgacccccatccctgaagagacatttcttgagctgaagtccttcagccagtctgaatttcccgatatttgcaaaatcgacggaattgtcttcaatcagtgtgagggcgaaagcctccctcaaccctttgatgtggcttggatggacgtggggcactcccataagatcatcatgcgcgagcacaaaaccaagtgggtccaggagtctagctccaaggatttcgtttgctataaagaaggaacaggcccgtgtagcgagtctgaagagaagacctgcaaaacatccgggagctgcagaggagacatgcagttttgtaaggtggccggctgcgaacacggcgaggaggcttctgaagccaaatgtcggtgctccctggtgcataagcctggggaggtcgtggttagctacggaggcatgcgcgtgagacccaaatgttacgggttctcccggatgatggcgacccttgaagtcaaccagcctgagcaacgcattggacagtgcacgggctgtcacctggaatgcatcaatgggggcgtgagactcattaccctgacatctgagcttaagagcgccaccgtttgtgcttcccatttttgctctagcgccacatccggaaagaaaagcaccgagatccagttccactctggctccctcgtggggaagacggctattcacgtcaaaggagccctggtggacggcacagagttcacctttgaagggagctgtatgttccccgatggatgcgacgcggtcgattgcacattttgtcgggagttccttaagaacccccaatgctatcctgccaaaaagtggctgtttatcatcattgtgatcctcctgggctacgctgggcttatgctgctcaccaatgttctgaaggccattggcatctggggatcttgggtgattgctccggtcaaactgatcttcgccatcattaagaaactcatgcgcaccgtgtcctgtctgatgggcaagctgatggacagagggcggcaggttatccatgaagaaattggagagaacagagagggcaatcaggatgacgtgcgcatcgaaatggcccggcccagacgcattcggcactggatgtatagccctgtcatcctgacaattctcgctatcgggctggcggagtcttgcgatgaaatggtgcatgccgacagcaaacttgtgtcctgtagacagggaagcggcaacatgaaggagtgcgttacgaccgggcgcgctctgctccccgccgtcaatcctggccaagaggcctgtctgcactttacagctcccggatctccggattccaagtgcctgaaaatcaaggtgaaacggattaacctcaagtgtaaaaagagctcctcttacttcgtgcctgacgccagaagccgctgcacctccgtccggagatgtcgctgggcgggcgattgccagtctgggtgtccccctcattttacaagcaattccttctctgacgactgggctggaaagatggatcgggccggcctggggtttagcggatgctccgacggctgcgggggcgccgcttgtggatgcttcaacgccgctcccagctgtatcttttggagaaaatgggtggaaaatcctcacggcattatctggaaggtttctccctgcgccgcgtgggtgccgtccgccgtcattgagcttaccatgcctagcggggaagtgcggacgttccaccccatgtctggaatccccacacaggttttcaaaggcgtgtccgtcacctatctggggagcgatatggaggtgtctggactcaccgacctgtgtgaaatcgaggagctgaagtccaaaaagctcgctcttgccccttgcaaccaggctggcatgggcgttgtggggaaagtcggagaaattcaatgtagctccgaggaaagcgcccgcacaatcaagaaggatggctgcatttggaacgcggacctggtggggatcgagctgagagtggatgacgccgtctgttactctaaaattaccagcgttgaagctgtggccaattattccgctatcccgacaacgatcggaggcctccggtttgagagatcttacgatagccaggggaagatttccggatctcccctggacatcaccgccattcgcggcagcttctccgtgaactaccggggccttagactgtctctcagcgagatcacagctacctgcacaggggaagtcaccaatgtgtccggatgctatagctgtatgacgggcgccaaagtttctattaagctgcattccagcaaaaactctaccgcgcacgtgcgctgcaagggggatgagacagccttttccgtcctggaaggagtgcatagctacaccgtttccctttctttcgaccacgctgtggtcgatgagcagtgtcagctcaattgcggcgggcacgaaagccaagtgacactgaagggaaacctgatctttctcgacgttcctaaattcgtggacggctcctatatgcagacctaccatagcacggtccccacaggcgccaatatcccttctcccaccgattggctgaacgccctttttgggaatggactgtccagatggattctcggcgtgatcggggtgctgctgggaggccttgctctcttctttatgattatgagcctgttcaagctggggacaaaacaggtctttcggtctcgcaccaagctcgcctga

SEQ ID NO: 14908 - RNA, 3222 nt, synthetic construct
  misc_feature 1..3222: note = derived and/or modified CDS sequence (opt5) from SFTSV/FTLSV(YSH39)__KF356529.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcatggagctgaagtcctttagccagtctgagttccccgacatctgcaaaattgatggaatcgtgtttaatcagtgtgaaggcgaaagccttcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctggtgcataagcctggggaggtggtcgtgagctacggaggcatgcgcatcagacccaaatgttacgggttttcccggatgatggccaccctcgaagttaaccagcctgagcaacgcattggacagtgcacgggctgtcacctggaatgcatcaatgggggcgtgagacttattaccctgacatctgagctcaagagcgcgaccgtctgtgcctcccatttctgctctagcgctacatccggaaagaaaagcaccgagatccagttccactctggctccctggtggggaagacggccatccacgttaaaggagctctggtggatggcacagaatttaccttcgaggggagctgtatgtttcccgacggatgcgatgccgtcgactgcacattctgtcgggaatttctcaagaacccccaatgctatcctgcgaaaaagtggctgttcattatcattgtgatccttctgggccatgccgggctcatgctgcttaccaatgtcctgaaggctattggcatctggggatcttgggtgatcgccccggttaaactcatttttgctatcattaagaaactgatgcgcaccgtgtcctgtctgatgggcaagctcatggatagagggcggcaggtcatccacgaggaaattggagagaacagagagggcaatcaggacgatgtgcgcatcgaaatggcccggcccagacgcgttcggcattggatgtacagccctgtgattctgacaatccttgccatcgggctggctgagtcttgcgacgaaatggtccacgcggatagcaaactcgtgtcctgtagacagggaagcggcaacatgaaggagtgcgtgacgaccgggcgcgccctgcttcccgctgttaatcctggccaagaggcctgtctgcatttcacagcccccggatctccggactccaagtgcctcaaaattaaggtcaaacggatcaacctgaagtgtaaaaagagctcctcttattttgtgcctgatgctagaagccgctgcacctccgtgcggagatgtcgctgggccggcgactgccagtctgggtgtccccctcacttcacaagcaattccttttctgacgattgggcgggaaagatggaccgggctggcctggggttcagcggatgctccgatggctgcgggggcgccgcctgtggatgctttaacgctgcccccagctgtattttctggagaaaatgggtcgaaaatcctcacggcatcatttggaaggtgtctccctgcgctgcctgggttccgtccgcggtgatcgagctcaccatgcctagcggggaagtccggacgttccatcccatgtctggaatccccacacaggtgtttaaaggcgtttccgtgacctacctggggagcgacatggaggtctctggacttaccgatctgtgtgaaattgaggagctcaagtccaaaaagctggccctggctccttgcaaccaggccggcatgggcgtggttgggaaagtgggagaaatccaatgtagctccgaggaaagcgctcgcacaattaagaaggacggctgcatctggaacgccgatcttgtcgggattgagctcagagtggacgatgcggtgtgttattctaaaatcaccagcgtcgaagccgttgctaattactccgccatcccgacaacgattggaggcctgcggttcgagagatctcacgacagccaggggaagatctccggatctcccctggatattaccgctatccgcggcagcttttccgtgaactatcggggcctcagactgtctcttagcgagattacagctacctgcacaggggaagtgaccaatgtctccggatgctacagctgtatgacgggcgccaaagtgtctatcaagctgcattccagcaaaaactctaccgcccacgttcgctgcaagggggacgagacagcgttctccgtgctcgaaggagtccacagctacaccgtgtccctgtcttttgatcatgccgttgtggacgagcagtgtcagctgaattgcggcgggcacgaaagccaagtcacacttaagggaaacctcatcttcctggacgtgcctaaatttgttgatggctcctatatgcagacctaccatagcacggtgcccacaggcgctaatattccttctcccaccgactggctgaacgccctcttcgggaatggactgtccagatggatccttggcgtcattggggtgctgctcggaggcctggccctgtttttcatgatcatgagcctttttaagctcgggacaaaacaggtgttccggtctcgcaccaagctggcttga

SEQ ID NO: 14909 - RNA, 3222 nt, synthetic construct
  misc_feature 1..3222: note = derived and/or modified CDS sequence (opt5) from SFTSV/FTLSV(YSHX002)__KF356540.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggaatggcctgcttagcccttgcgacgcggattggctgggcatgctcgtcgtgaaaaaggctaaagagtctgacatgattgttcccgggccttcctataagggaaaggtgttctttgaacgccccaccttcgatggctacgtcgggtggggatgtggcagcgggaaatctagaacagagtccggagaactgtgcagctccgactctggcacgagctccggcctgctccctagcgatcgggtgctgtggatcggggacgttgcctgtcagccgatgacccccattcctgaggagacatttcttgaactgaagtctttctcccagagcgagtttcccgatatctgcaaaattgacggaatcgtgttcaaccagtgtgaaggcgagtctctccctcaaccctttgatgtcgcctggatggacgtggggcacagccataagatcattatgcgcgagcacaaaaccaagtgggtgcaggaatcctctagcaaggatttcgtctgctataaagagggaacaggcccgtgttccgaaagcgaggaaaaggcttgcaaaacctctgggtcctgcagaggagacatgcagttttgtaaggttgccggctgcgagcacggcgaggaagctagcgaggccaaatgtcggtgctctctggtgcataagcctggggaagtggtcgtgtcctacggaggcatgcgcgttagacccaaatgttacgggttcagccggatgatggcgacacttgaggtgaatcctcccgaacagcgcatcggacaatgcaccggctgtcacctggagtgcattaacgggggcgtcagactcatcacgctgacctccgagctgcggtctgccacagtgtgtgctagccatttttgctcctctgccaccagcggaaagaagtccacagaaattcacttccacagcggctctctcgttgggaaaaccgctatccatgtgaagggagccctggtcgacggcacggagttcacatttgaagggtcctgtatgttccccgatggatgcgacgcggtggattgcaccttttgtcgcgagttccttaaaaatcctcagtgctatccggccaagaaatggctgtttatcattatcgtcattctcctgggctacgctgggcttatgctggtgacaaacgttctcaaggccatcggcgtgtggggaagctgggtcattgctcccgtgaagctgatgttcgccatcatcaaaaagctgatgagaaccgtttcttgtctcgtgggcaaactgatggaccgggggagacaggtcattcacgaagagatcggagagaatggcgaagggaaccaagatgacgtgcgcattgagatggcccggcctagacgcgtgcggcattggatgtattcccccgttatccttaccattctggctatcggactcgcggaaggctgcgatgagatggtccacgccgacagcaagctggtgtcttgtagacaggggagcggcaatatgaaagagtgcattacaacgggacgcgctctgctgcctgccgtgaaccccggccaggaagcctgtctccattttaccgctccggggtcccctgatagcaagtgcctgaagatcaaagtcaagcggatcaatctgaaatgtaagaaatcttccagctacttcgtgcccgacgccagatcccgctgcacatctgttcggagatgtcgctgggcgggagattgccagagcggctgccctccccactttacctccaactctttcagcgacgactgggctgggaagatggatcgggccggactcggcttttccgggtgttctgacggctgcggaggcgccgcttgtgggtgcttcaatgccgctcctagctgtatcttttggagaaagtgggtggagaacccccacggaattatttggaaagtctccccgtgcgccgcgtgggtgcctagcgccgttatcgaactgacaatgccctctggcgaggtgcggaccttccatcccatgtccgggattcctacgcaagtcttcaagggagtgagcgttacatatcttggctctgatatggaagtgtccggcctgaccgacctctgtgagatcgaggaactgaaaagcaagaaactggctcttgccccgtgcaaccaggctgggatgggagtcgtgggcaaggtgggggagaaacagtgttcttccgaagagagcgcccgcaccatcaagaaggatggatgcatttggaatgcggacctcgtcggcatcgaactgagagttgatgacgccgtgtgttactccaaaattacaagcgtggaggctgtcgccaactattctgctatccccaccacaattgggggactgcggtttgagagaagccacgattcccagggcaagatctctggcagccctctcgacatcacggccattcgcgggtccttctctgtgaattaccggggactgagacttagcctgtccgaaatcaccgccacatgcaccggcgaggttacaaacgtgtctgggtgctacagctgtatgaccggagctaaagtctccattaagctccatagctctaaaaattccacggcgcacgtgcgctgcaagggcgatgaaaccgcctttagcgttctggagggggtgcactcttatatcgtctccctgagcttcgaccatgctgtggttgatgaacaatgtcagcttaactgcggaggccacgagtcccaggtgacactcaagggcaatctgatttttctggacgtccccaaattcgtggacgggtcttacatgcagacctatcatagcacagtgcctaccggagccaacatcccctcccctacggattggctcaatgccctgtttggcaacgggcttagcagatggatcctgggagtcattggcgttctccttgggggactggctcttttctttctcatcatgttcctgctgaagctcggcacaaaacaagtgtttcggtctcgcaccaagctggcctga

SEQ ID NO: 14910 - RNA, 3222 nt, synthetic construct
  misc_feature 1..3222: note = derived and/or modified CDS sequence (opt5) from SFTSV/FTLSV(YXX2)__KF356534.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagcttaagagcttctctcagtccgaatttcccgacatctgcaaaattgatggcatcgtgttcaatcagtgtgagggggaaagcctccctcaaccctttgacgtcgcctggatggatgtgggacactctcataagatcattatgcgcgagcacaaaacaaagtgggtgcaggagagctcctctaaggacttcgtctgctataaagaaggcaccgggccgtgtagcgagtccgaagagaagacatgcaaaaccagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacgcttgaagtgagccagcctgagcaacgcatcggccagtgcaccgggtgtcacctggaatgcattaacggcggagtcagactcatcacactgacctccgagctgaagtctgcgacagtgtgtgccagccatttttgctcctctgctaccagcggcaagaaatccacggagattcagttccacagcgggtctctcgttggaaagacagccatccacgtgaaaggcgctctggtcgatgggaccgagttcacatttgaaggatcctgtatgttccccgacggctgcgatgccgtggactgcaccttttgtcgggagttccttaagaatccccaatgctatcctgcgaaaaagtggctgtttatcattatcgtcattctcctggggtacgccggccttatgctgctcaccaacgtgctgaaggctatcggagtttggggcagctgggtgattgccccggtcaaactggtgttcgctatcatcaagaaactcatgcgcgccgtttcttgtctgatggggaagctgatggatagaggaagacaggtgattcatgaagaaatcggcgagaatcgggaggggaaccaggacgatgtccgcattgaaatggcccggcccagacgcgtgcggcactggatgtattcccctgtgatcctgacaattctcgctatcggactggcggagggctgcgacgaaatggttcatgccgatagcaaacttgtctcttgtagacaggggagcggcaatatgaaggagtgcgtgacgaccggacgcgctctgctccccgccgtgaaccctggccaagaggcctgtctgcactttacagctcccgggtccccggacagcaagtgcctgaaaattaaggtcaaacggatcaatctcaagtgtaaaaagtcttccagctacttcgtgcctgatgccagatcccgctgcacctctgttcggagatgtcgctgggcgggagactgccagagcggctgtccccctcattttacatccaactctttcagcgacgattgggctgggaagatggaccgggccggactgggcttttccgggtgctctgatggctgcggaggcgccgcttgtgggtgcttcaatgccgctcccagctgtatcttttggagaaaatgggtggaaaaccctcacggaattatctggaaggtctccccctgcgccgcgtgggtgccgagcgccgttattgagcttaccatgccttctggcgaagtgcggacgttccaccccatgtccgggatccccacacaggtcttcaaaggagtgagcgttacctatctgggctctgacatggaggtgtccggcctcaccgatctgtgtgaaattgaggagcttaagagcaaaaagctggctctcgccccttgcaatcaggctgggatgggagtcgtgggcaaagtgggggaaatccaatgttcttccgaggaaagcgcccgcacaatcaagaaggacggatgcatttggaacgcggatctggtcggcatcgagctgagagttgacgatgccgtgtgttactccaaaattaccagcgtggaagctgtcgccaactattctgctatcccgacaacgattgggggactccggtttgagagaagccatgactcccagggcaagatctctggcagccccctggatatcaccgccattcgcgggtccttctctgtgaattaccggggacttagactgagcctctccgagatcacagctacctgcacaggcgaagttaccaacgtgtctgggtgctacagctgtatgacgggagccaaagtctccattaagctgcacagctctaaaaattccaccgcgcatgtgcgctgcaagggcgacgagacagcctttagcgttctggaaggggtgcactcttattccgtcagcctttccttcgattacgctgtggttgacgagcagtgtcagctcaactgcggaggccacgaatctcaagtgaccctgagaggcaatctgatctttctcgacgtccctaagttcgtggatgggagctatatgcagacataccattccaccgtgcccacgggagccaacattcctagccccacagactggctgaatgccctttttggcaacgggctgtctcggtggatcctcggagtcatcggcgttctgcttgggggactggctctcttctttctgattatgtccctgttcaaactcggcaccaagcagatctttcgcagcagaacaaaactggcctga

SEQ ID NO: 14911 - RNA, 3222 nt, synthetic construct
  misc_feature 1..3222: note = derived and/or modified CDS sequence (opt5) from SFTSV/Huaiyangshan virus(2010-FQM)__HQ419236.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagctcaagagcttctctcagtccgaatttcccgacatctgcaaaattgatggcatcgtgttcaatcagtgtgagggggaaagcctccctcaaccctttgacgtcgcctggatggatgtgggacactctcataagatcattatgcgcgagcacaaaacaaagtgggtgcaggagagctcctctaaggacttcgtctgctataaagaaggcaccgggccgtgtagcgagtccgaagagaaggcttgcaaagccagcggatcttgcagaggcgacatgcagttttgtaaggttgctggctgcgaacacggggaggaggcctccgaagcgaaatgtcggtgcagcctggtgcataagcctggagaggtggtcgtgtcttacggcgggatgcgcgttagacccaaatgttacggattctcccggatgatggccacacttgaagtgagccagcctgagcaacgcatcggccagtgcaccgggtgtcacctggaatgcattaacggcggagtcagactcatcacgctgacctccgagctgaagtctgctacagtgtgtgccagccatttttgctcctctgctaccagcggcaagaaatccacagagattcagttccacagcgggtctctcgttggaaagaccgccatccacgtgaaaggcgcgctggtcgatgggacggagttcacatttgaaggatcctgtatgttccccgacggctgcgatgccgtggactgcaccttttgtcgggagttccttaagaatccccaatgctatcctgctaaaaagtggctgtttatcattatcgtcattctcctggggtacgccggccttatgctgctcacaaacgtgctgaaggctatcggagtttggggcagctgggtgattgccccggtcaaactggtgttcgccatcatcaagaaactcatgcgcgctgtttcttgtctgatggggaagctgatggatagaggaagacaggtgattcatgaagaaatcggcgagaatcgggaggggaaccaggacgatgtccgcattgaaatggcgcggcccagacgcgtgcggcactggatgtattcccctgtgatcctgaccattctcgccatcggactggctgagggctgcgacgaaatggttcatgccgatagcaaacttgtctcttgtagacaggggagcggcaatatgaaggagtgcgtgaccacaggacgcgccctgctccccgctgtgaaccctggccaagaggcctgtctgcactttacggcgcccgggtccccggacagcaagtgcctgaaaattaaggtcaaacggatcaatctcaagtgtaaaaagtcttccagctacttcgtgcctgatgctagatcccgctgcacctctgttcggagatgtcgctgggccggagactgccagagcggctgtccccctcattttacatccaactctttcagcgacgattgggccgggaagatggaccgggctggactgggcttttccgggtgctctgatggctgcggaggcgccgcttgtgggtgcttcaatgccgcgcccagctgtatcttttggagaaaatgggtggaaaaccctcacggaattatctggaaggtctccccctgcgccgcttgggtgccgagcgccgttattgagcttaccatgccttctggcgaagtgcggacattccaccccatgtccgggatccccacccaggtcttcaaaggagtgagcgttacgtatctgggctctgacatggaggtgtccggcctcacagatctgtgtgaaattgaggagcttaagagcaaaaagctggctctcgccccttgcaatcaggcggggatgggagtcgtgggcaaagtgggggaaatccaatgttcttccgaggaaagcgcccgcaccatcaagaaggacggatgcatttggaacgctgatctggtcggcatcgagctgagagttgacgatgccgtgtgttactccaaaattaccagcgtggaagctgtcgccaactattctgccatcccgacaaccattgggggactccggtttgagagaagccatgactcccagggcaagatctctggcagccccctggatatcacagctattcgcgggtccttctctgtgaattaccggggacttagactgagcctctccgagatcacggcgacctgcacaggcgaagttaccaacgtgtctgggtgctacagctgtatgacaggagccaaagtctccattaagctgcacagctctaaaaattccaccgctcatgtgcgctgcaagggcgacgagacggcctttagcgttctggaaggggtgcactcttattccgtcagcctttccttcgatcacgccgtggttgacgagcagtgtcagctcaactgcggaggccatgaatctcaagtgaccctgagaggcaatctgatctttctcgacgtccctaagttcgtggatgggagctacatgcagacatatcactccaccgtgcccacaggagctaacattcctagccccaccgactggctgaatgccctttttggcaacgggctgtctcggtggatcctcggagtcatcggcgttctgcttgggggacttgcgctgttctttctgattatgttcctgtttaaactcggcacgaagcagatcttccgctccagaacaaaactggcttga

SEQ ID NO: 14912 - RNA, 3222 nt, synthetic construct
  misc_feature 1..3222: note = derived and/or modified CDS sequence (opt5) from SFTSV/Huaiyangshan virus(2010-LZR)__HQ419237.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagcttaagagcttctctcagtccgaatttcccgacatctgcaaaattgatggcatcgtgttcaatcagtgtgagggggaaagcctccctcaaccctttgacgtcgcctggatggatgtgggacactctcataagatcattatgcgcgagcacaaaacaaagtgggtgcaggagagctcctctaaggacttcgtctgctataaagaaggcaccgggccgtgtagcgagtccgaagagaagacatgcaaaaccagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacgcttgaagtgagccagcctgagcaacgcatcggccagtgcaccgggtgtcacctggaatgcattaacggcggagtcagactcatcacactgacctccgagctgaagtctgcgacagtgtgtgccagccatttttgctcctctgctaccagcggcaagaaatccacggagattcagttccacagcgggtctctcgttggaaagacagccatccacgtgaaaggcgctctggtcgatgggaccgagttcacatttgaaggatcctgtatgttccccgacggctgcgatgccgtggactgcaccttttgtcgggagttccttaagaatccccaatgctatcctgcgaaaaagtggctgtttatcattatcgtcattctcctggggtacgccggccttatgctgctcaccaacgtgctgaaggctatcggagtttggggcagctgggtgattgccccggtcaaactggtgttcgctatcatcaagaaactcatgcgcgccgtttcttgtctgatggggaagctgatggatagaggaagacaggtgattcatgaagaaatcggcgagaatcgggaggggaaccaggacgatgtccgcattgaaatggcccggcccagacgcgtgcggcactggatgtattcccctgtgatcctgacaattctcgctatcggactggcggagggctgcgacgaaatggttcatgccgatagcaaacttgtctcttgtagacaggggagcggcaatatgaaggagtgcgtgacgaccggacgcgctctgctccccgccgtgaaccctggccaagaggcctgtctgcactttacagctcccgggtccccggacagcaagtgcctgaaaattaaggtcaaacggatcaatctcaagtgtaaaaagtcttccagctacttcgtgcctgatgccagatcccgctgcacctctgttcggagatgtcgctgggcgggagactgccagagcggctgtccccctcattttacatccaactctttcagcgacgattgggctgggaagatggaccgggccggactgggcttttccgggtgctctgatggctgcggaggcgccgcttgtgggtgcttcaatgccgctcccagctgtatcttttggagaaaatgggtggaaaaccctcacggaattatctggaaggtctccccctgcgccgcgtggattccgagcgccgtgatcgagcttaccatgccttctggcgaagttcggacgttccaccccatgtccgggattcccacacaggtgttcaaaggagtcagcgtgacctatctgggctctgacatggaggtttccggcctcaccgatctgtgtgaaatcgaggagcttaagagcaaaaagctggctctcgccccttgcaatcaggctgggatgggagtggtcggcaaagtgggggaaatccaatgttcttccgaggaaagcgcccgcacaattaagaaggacggatgcatctggaacgcggatctggtgggcattgagctgagagtcgacgatgccgtttgttactccaaaatcaccagcgtggaagctgtggccaactattctgctattccgacaacgatcgggggactccggtttgagagaagccatgactcccagggcaagatctctggcagccccctggatattaccgccatccgcgggtccttctctgtcaattaccggggacttagactgagcctctccgagattacagctacctgcacaggcgaagtgaccaacgtttctgggtgctacagctgtatgacgggagccaaagtgtccatcaagctgcacagctctaaaaattccaccgcgcatgtccgctgcaagggcgacgagacagcctttagcgtgctggaaggggttcactcttattccgtgagcctttccttcgatcacgctgtcgtggacgagcagtgtcagctcaactgcggaggccatgaatctcaagttaccctgagaggcaatctgatttttctcgacgtgcctaagttcgtcgatgggagctacatgcagacatatcactccaccgtgcccacgggagccaacatccctagccccacagactggctgaatgccctttttggcaacgggctgtctcggtggatcctcggagtgattggcgtcctgcttgggggactggctctcttctttctgatcatgtccctgttcaaactcggcaccaagcagatttttcgcagcagaacaaaactggcctga

SEQ ID NO: 14913 - RNA, 3222 nt, synthetic construct
  misc_feature 1..3222: note = derived and/or modified CDS sequence (opt5) from SFTSV/Huaiyangshan virus(2010-T112)__HQ419238.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgaatttcccgacatctgcaaaattgatggaatcgtgtttaatcagtgtgagggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgtccaacgcatcggacagtgcacgggctgtcaccttgagtgcattaatgggggcgtgagactgatcaccctcacatctgaactgaagtccgcgaccgtttgtgcctcccatttctgctctagcgctacatccggaaagaaaagcaccgagattcagttccactctggctccctggtggggaagacggccatccacgtcaaaggagctctcgtggatggcacagagtttaccttcgaagggagctgtatgtttcccgacggatgcgatgccgtcgactgcacattctgtcgggagtttctgaagaacccccaatgctatcctgcgaaaaagtggcttttcatcattatcgtgattctgctcggctacgccgggctgatgcttctgaccaatgttctcaaggctatcggcatttggggatcttgggtgatcgccccggtcaaactgatctttgctattatcaagaaactgatgcgcaccgtgtcctgtctcatgggcaagctgatggatagagggcggcaggttattcatgaagagatcggagaaaacagagagggcaatcaggacgatgtgcgcattgagatggcccggcccagacgcgtccggcactggatgtatgcccctgtgatccttacaattctggctatggggctcgcggaaagctgcgacgagatggtgcatgccgattctaaactggttagctgtagacagggatccggcaacatgaaggaatgcgtcacgaccgggcgcgcccttctgcccgccgtgaatcctggccaagaggcctgtctccacttcacagctcccggaagcccggactctaagtgcctgaaaatcaaggtgaaacggatcaacctgaagtgtaaaaagtccagctcctactttgtccctgatgccagatctcgctgcaccagcgtgcggagatgtcgctgggcgggcgactgccagtccgggtgtccccctcatttcacatctaatagcttttccgacgattgggctggaaagatggaccgggccggcctcgggttctctggatgcagcgatggctgcgggggcgccgcttgtggatgctttaacgccgctccctcctgtattttctggagaaaatgggttgagaatcctcacggcatcatttggaaggtgagcccctgcgtcgcctgggtgccgtctgcggttatcgaactgaccatgccttccggggaggtgcggacgttccaccccatgagcggcattcccacacaggtctttaaaggagtgtctgttacctatcttgggtccgacatggaagtgagcggactgaccgatctctgtgagatcgaggaactgaagtctaaaaagctggcccttgctccttgcaaccaggccggcatgggcgtcgtggggaaagtgggagagatccaatgttccagcgaagagtccgctcgcacaattaagaaggacggctgcatctggaacgccgatctcgtcgggattgaactgagagttgacgatgcggtgtgttacagcaaaatcacctctgtggaggccgtcgctaattatagcgccattccgacaacgatcggaggcctgcggttcgaaagatcccatgactctcaggggaagatcagcggaagccccctcgatattaccgctatccgcggctcttttagcgtgaactaccggggcctgagactttccctgtctgagattacagctacctgcacaggggaggttaccaatgtgagcggatgctactcctgtatgacgggcgccaaagtcagcatcaagctccactcttccaaaaacagcaccgctcatgtgcgctgcaagggggacgaaacagcgttctctgttctggagggagtgcactcctataccgtcagcctgtcctttgatcacgccgtggttgacgaacagtgtcagcttaattgcggcgggcatgagtctcaagtgacactcaagggaaacctgattttcctggacgtccctaaatttgtggatggcagctacatgcagacctatcactccacggtgcccacaggcgctaatatccctagccccaccgactggctcaacgccctgttcgggaatggactttctagatggatcctgggcgtcattggggttctcctgggaggcctggcccttttcttcatgatcatgtccctctttaagctggggacaaaacaggtgttccggagccgcaccaagctggcttga

SEQ ID NO: 14914 - RNA, 3222 nt, synthetic construct
  misc_feature 1..3222: note = derived and/or modified CDS sequence (opt5) from SFTSV/Huaiyangshan virus(2010-WJ)__HQ419229.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggaaaacgcggcgggagatcccaggtgagctactatctcgccgaaaactcttactcccggtggagcggactgctttctccctgcgatgcggactggctgggcatgctcgtcgtgaagaaagctaagggctccgatatgattgttcctgggcccagctataagggaaaagtgtttttcgagcgccctacctttgacggctacgtcgggtggggatgtggctctgggaagtccagaacagaaagcggagagctgtgctcctctgatagcggcacgtccagcggcctgctcccctctgaccgggtgctgtggatcggggatgttgcctgtcaacctatgaccccgattcccgaagagacattccttgagctgaaatcctttagccagtctgagttccctgacatctgcaagattgatggaatcgtgtttaatcagtgtgaaggcgaaagcctcccccagcctttcgacgtcgcctggatggatgtggggcactcccataaaatcattatgcgcgagcacaagaccaagtgggtgcaagagtctagctccaaagactttgtctgctataaggaaggaacaggcccctgtagcgagtctgaagagaaaacctgcaagacatccgggagctgcagaggagacatgcagttctgtaaagttgctggctgcgaacacggcgaggaggcctctgaagctaagtgtcggtgctccctggtgcataaaccgggggaggtggtcgtgagctacggaggcatgcgcgttagacctaagtgttacgggttttcccggatgatggccacccttgaagtgaaccagcccgagcagcgcatcggacaatgcacgggctgtcacctggaatgcattaatgggggcgtcagactcatcaccctgacatctgagcttaagagcgcgaccgtgtgtgcctcccatttctgctctagcgctacatccggcaaaaagagcaccgagattcagttccactctggatccctcgttgggaaaacggccatccacgtgaagggagctctggtcgatggcacagaatttaccttcgaggggagctgtatgtttcctgacggatgcgatgccgtggactgcacattctgtcgggaatttcttaaaaacccccagtgctatcccgcgaagaagtggctgttcatcattatcgtcattctcctgggctacgccgggcttatgctgctcaccaatgtgctgaaagctatcggcatttggggatcttgggttatcgcccctgtgaagctgatctttgctattatcaaaaagctcatgcgcaccgtctcctgtctgatgggcaaacttatggatagagggcggcaagtgattcatgaggaaatcggagagaacagagagggcaatcaggacgatgttcgcattgaaatggcccggccgagacgcgtgcggcactggatgtatagccccgtcatcctgacaattctcgccatcgggctggctgagtcttgcgacgaaatggtgcatgcggatagcaagctggtgtcctgtagacagggaagcggcaacatgaaggagtgcgttacgaccgggcgcgccctgctccctgctgtcaatcccggccaggaggcctgtctgcacttcacagcccctggatctcccgactccaaatgcctgaagatcaaagtgaagcggattaacctcaaatgtaagaagtcctcctcttactttgtgccggatgctagaagccgctgcacctccgtccggagatgtcgctgggccggcgactgccaatctgggtgccctccccatttcacacctaatagcttttccgacgattgggcgggaaaaatggaccgggctggcctggggttctctggatgtagcgatggctgcgggggcgccgcctgtggatgctttaacgctgccccctcctgtatcttctggagaaagtgggtggaaaatcctcacggcattatctggaaagttagcccctgcgctgcctgggtgccgtctgcggtcattgagcttaccatgccttccggggaagtgcggacgttccaccccatgagcggaatccccacacaggtttttaagggcgtgtctgtcacctatctggggtccgacatggaggtgagcggactcaccgatctgtgtgaaatcgaggagctgaaatctaagaaacttgccctcgctccttgcaaccaggccggcatgggcgttgtggggaaggtcggagaaattcagtgttccagcgaggaatccgctcgcacaatcaagaaagacggctgcatttggaacgccgatctggtggggatcgagctgagagtggacgatgcggtctgttacagcaagattacctctgttgaagccgtggctaattatagcgccatcccgacaacgatcggaggcctccggttcgagagatcccatgactctcaagggaaaattagcggaagccccctggatatcaccgctattcgcggctcttttagcgtgaactaccggggccttagactgtccctctctgagatcacagctacctgcacaggggaagtcaccaatgtgagcggatgctactcctgtatgacgggcgccaaggttagcattaaactgcactcttccaagaacagcaccgcccatgtgcgctgcaagggggacgagacagcgttctctgtcctggaaggagtgcactcctataccgttagcctttcctttgatcacgccgtggtcgacgagcagtgtcagctcaattgcggcgggcatgaatctcaggtgacactgaaaggaaacctgatcttcctcgacgttcctaagtttgtggatggcagctacatgcaaacctatcactccacggtccccacaggcgctaatatccctagccccaccgactggctgaacgcccttttcgggaatggactgtctagatggattctcggcgtgatcggggtgctgctgggaggccttgccctctttttcatgattatgtccctgtttaaactggggacaaagcaggtcttccggagccgcaccaaactcgcttga

SEQ ID NO: 14915 - RNA, 3222 nt, synthetic construct
  misc_feature 1..3222: note = derived and/or modified CDS sequence (opt5) from SFTSV/Huaiyangshan virus(2010-WJQ)__HQ419230.1__GP
  source 1..3222: mol_type = other RNA
atgatgaaggtgatctggttcagctccctgatttgcctcgtcatccagtgtggcggggacaccggacccattatctgcgccggccctacacactctaacaaaagcgctgatattccgcatctgcttgggtactccgagaagatctgtcaaatcgacagactgattcacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgatcgttcccggaccttcttataagggcaaggtgttctttgagcgccccacgttcgacgggtacgtcggatggggctgtgggtccggaaaaagcagaaccgaatctggcgagctgtgctccagcgattccggcacatctagcgggctgctcccttccgaccgggtgctgtggattggagatgttgcctgtcagccgatgacccccatccctgaagagacatttcttgagcttaagagcttctctcagtccgaatttcccgacatttgcaaaatcgatggcattgtgttcaatcagtgtgagggggaaagcctccctcaaccctttgacgtcgcctggatggatgtgggacactctcataagatcatcatgcgcgagcacaaaaccaagtgggtgcaggagagctcctctaaggacttcgtctgctataaagaaggcacagggccgtgtagcgagtccgaagagaagacctgcaaaacgagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacccttgaagtgagccagcctgagcaacgcattggccagtgcacagggtgtcacctggaatgcatcaacggcggagtcagactcattaccctgacatccgagctgaagtctgcgaccgtgtgtgccagccatttttgctcctctgctacgagcggcaagaaatccacagagatccagttccacagcgggtctctcgttggaaagaccgccattcacgtgaaaggcgctctggtcgatgggacagagttcacctttgaaggatcctgtatgttccccgacggctgcgatgccgtggactgcaccttttgtcgggagttccttaagaatccccaatgctatcctgcgaaaaagtggctgtttatcatcattgtcatcctcctggggtacgccggccttatgctgctcacaaacgtgctgaaggctattggagtttggggcagctgggtgatcgccccggtcaaactggtgttcgctattatcaagaaactcatgcgcgccgtttcttgtctgatggggaagctgatggatagaggaagacaggtgatccatgaagaaattggcgagaatcgggaggggaaccaggacgatgtccgcatcgaaatggcccggcccagacgcgtgcggcactggatgtattcccctgtgattctgacgatcctcgctattggactggcggagggctgcgacgaaatggttcatgccgatagcaaacttgtctcttgtagacaggggagcggcaatatgaaggagtgcgtgaccacaggacgcgctctgctccccgccgtgaaccctggccaagaggcctgtctgcactttaccgctcccgggtccccggacagcaagtgcctgaaaatcaaggtcaaacggattaatctcaagtgtaaaaagtcttccagctacttcgtgcctgatgccagatccggatgcacatctgttcgccggtgtagatgggcgggcgactgccagagcgggtgtccccctcattttacctccaactctttcagcgacgattgggctggaaagatggaccgcgccggcctggggttttccggctgctctgatggatgcggcggggccgcttgtggatgcttcaatgccgctcccagctgtatcttttggcggaaatgggtggaaaaccctcacggcatcatttggaaggtctccccctgcgccgcgtgggtgccgagcgccgttatcgagcttacgatgccttctggggaagtgagaacattccaccccatgtccggcattcccacccaggtcttcaaaggagtgagcgttacctatctgggctctgacatggaggtgtccgggctcacagatctgtgtgaaatcgaggagcttaagagcaaaaagctggctctcgccccttgcaatcaggctggaatgggcgtcgtggggaaagtgggagaaattcaatgttcttccgaggaaagcgcccggaccatcaagaaggacggctgcatctggaacgcggatctggtcgggattgagctgcgcgttgacgatgccgtgtgttactccaaaatcacaagcgtggaagctgtcgccaactattctgctattccgacgaccatcggaggcctcagatttgagcggagccatgactcccagggcaagatttctgggagccccctggatatcacagccatcagaggatccttctctgtgaattaccgcggccttcggctgagcctctccgagattaccgccacatgcaccggggaagttacgaacgtgtctggatgctacagctgtatgaccggcgctaaagtctccatcaagctgcacagctctaaaaattccacagcgcatgtgagatgcaagggggacgagaccgcctttagcgttctggaaggagtgcactcttattccgtcagcctttccttcgatcacgctgtggttgacgagcagtgtcagctcaactgcggcggccatgaatctcaagtgacactgcgcgggaatctgatttttctcgacgtccctaagttcgtggatggaagctacatgcagacctatcactccacggtgcccacaggcgccaacatccctagccccaccgactggctgaatgccctttttgggaacggactgtctagatggattctcggcgtcatcggggttctgctgggaggccttgctctcttctttctgatcatgtccctgttcaaactcggcacaaagcagatttttcggagccgcaccaaactggcctga

SEQ ID NO: 14916 - RNA, 3222 nt, synthetic construct
  misc_feature 1..3222: note = derived and/or modified CDS sequence (opt5) from SFTSV/Huaiyangshan virus(2010-WSQ)__HQ419235.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatgtcgcctggatggacgtggggcactcccataagatcattatgcgcgagcacaaaaccaagtgggtgcaggaatctagctccaaggatttcgtctgctataaagagggaacaggcccgtgtagcgaatctgaggaaagagcttgcaagacctccgggagctgccggggagacatgcagttttgtaaagttgccggctgcgagcacggcgaggaggcttctgaagccaagtgtcgctgctccctggtgcataaacctggggaagtggtcgtgagctacggaggcatgagagttcggcccaagtgttacgggttctcccgcatgatggcgacacttgaggtgaaccctcccgaacagagaatcggacaatgcaccggctgtcacctggagtgcattaatgggggcgtccggctcatcacgctgacctctgagctgcgcagcgccacagtgtgtgcttcccatttttgctctagcgccacctccggcaaaaagagcacagaaattcacttccactctggatccctcatcgggaagaccgctatccatgttaaaggagccctggtggacggcacggagttcacatttgaagggagctgtatgttccccgatggatgcgacgcggtcgattgcaccttttgtagagagttccttaagaaccctcagtgctatccggccaaaaagtggctgtttattatcattgtgatcctcctgggctacgctgggcttatgctgctcacaaatgtcctgaaagccattggcgtgtggggatcttgggttatcgctcccgtgaagctgatgttcgccatcattaagaaactcatgcggaccgtctcctgtctggtgggcaagctgatggacagagggcgccaggttatccacgaagagattggagagaacggcgaagggaatcaagatgacgtgcggatcgagatggccagacctcgccgggtcagacattggatgtatagccccgtgattcttaccatcctcgctattggactggcggaagattgcgacgagatggtgcacgccgattctaaacttgttagctgtcgccagggctccgggaacatgaaggagtgcatcacaacgggccgggctctgctccctgccgtcaatcccggacaggaagcctgtctgcattttaccgctccgggcagccctgactctaaatgcctgaagatcaaggtgaaaagaattaacctcaagtgtaaaaagtccagctcctacttcgtgcccgatgcccgctctcggtgcacaagcgtcagacgctgtcggtgggcgggggactgccagtccggatgccctccccactttacctctaatagcttctccgacgattgggctggcaaaatggacagagccgggctgggattttctggctgtagcgatgggtgcggcggagccgcttgtggctgcttcaacgccgctccttcctgtatcttttggcggaagtgggtggagaatccccacgggattatctggaaggttagcccgtgcgccgcgtgggtgccttctgccgtcattgaacttacaatgccctccggagaggtgcgcaccttccatcccatgagcggcatccctacgcaagttttcaaaggggtgtctgtcacatatctgggatccgacatggaagtgagcggcctcaccgatctgtgtgagatcgaggaactgaagtctaaaaagctcgctcttgccccgtgcaaccaggctggcatgggggttgtgggaaaagtcggcgagattcagtgttccagcgaagagtccgccagaaccatcaagaaagacgggtgcatttggaacgcggatctggtgggaatcgaactgcgggtggacgatgccgtctgttacagcaagattacatctgttgaggctgtggccaattatagcgctatccccaccacaatcggcgggctcagatttgagaagtcccacgactctcagggaaaaattagcggctcccctctggatatcacggccattcgcggctctttcagcgtgaactaccgggggcttagactgtccctctctgaaatcaccgccacatgcaccggagaggtcacaaatgtgagcggctgctactcctgtatgaccggggctaaggttagcattaaactgcattcttccaagaacagcacggcgcacgtgcgctgcaaaggagacgaaaccgccttttctgtcctggagggcgtgcactcctatatcgttagcctttccttcgatcatgctgtggtcgacgaacaatgtcagctcaattgcgggggacacgagtctcaggtgacactgaagggcaacctgatctttctcgacgttcccaagttcgtggatggcagctacatgcagacctatcattccacagtccctaccggggccaatattcccagccctacggactggctgaacgccctttttggaaatggcctgtctagatggatcctcggggtgattggagtgctgctgggcgggcttgctctcttctttctgatcatgttcctgctcaaactgggaacaaagcaagtctttcggtcccgcaccaaacttgcctga

SEQ ID NO: 14917 - RNA, 3222 nt, synthetic construct
  misc_feature 1..3222: note = derived and/or modified CDS sequence (opt5) from SFTSV/Huaiyangshan virus(2010-WWG)__HQ419231.1__GP
  source 1..3222: mol_type = other RNA
atgatgaaggtgatctggttcagcaccctgatttgctttgtcatccagtgttccggcgactctgggcccattatctgcgccggacctattcacagcaacaaatccgctgatatcccgcatctcctgggctactctgagaagatctgtcaaattgacagacttatccacgttagctcctggctgcggaatcattctcagttccaggggtatgtgggacagcgcggcgggagaagccaagtgtcctactatcccgccgaaaacagctactctcggtggtccggactcctgagcccttgcgatgcggactggcttggcatgctggtcgtgaaaaaggctaaaggctctgatatgattgttcccgggccttcctataagggaaaggtgtttttcgagcgccccacatttgacggctacgtcgggtggggatgtggcagcgggaaatctagaacggaatccggagagctctgcagctccgattctggcaccagctccggcctgctgcctagcgaccgggtgctctggatcggggatgttgcctgtcagccgatgacacccattcctgaagagaccttcctggagcttaagtctttttcccagagcgagttccccgacatctgcaaaattgatggaatcgtgtttaatcagtgtgagggcgaatctctgcctcaacccttcgacgtcgcctggatggatgtggggcacagccataagatcattatgcgcgagcacaaaacaaagtgggtgcaggagtcctctagcaaggactttgtctgctataaagaaggaaccggcccgtgttccgagagcgaagagaagacatgcaaaacctctgggtcctgcagaggagacatgcagttctgtaaggttgctggctgcgaacacggcgaggaggccagcgaagctaaatgtcggtgctctctcgtgcataagcctggggaggtggtcgtgtcctacggaggcatgcgcgttagacccaaatgttacgggtttcctcggatgatggccacgctggaagtgaaccagcccgagcaacgcatcggacagtgcaccggctgtcaccttgaatgcattaatgggggcgtcagactgatcacactcaccagcgagctgcggtccgcgacagtgtgtgcctctcatttctgcagctccgctacctctggaaagaaaagcacggagattcagttccactccggcagcctggttgggaagacagccatccacgtgaagggagctctcgtcgatggcaccgaatttacattcgaggggtcttgtatgtttcccgacggatgcgatgccgtggactgcaccttctgtcgcgaatttctgaaaaaccctcaatgctatccggcgaagaaatggcttctgatcattatcgtcattctcctgggctacgccgggcttatgctgctcaccaatgtgctgaaggctatcggcatttggggatcctgggttatcgcccccgtgaagctgatcttcgctattatcaaaaagctcatgagagccgtcagctgtctgatgggcaaacttatggatcgggggagacaggtgattcatgagggaatcggcgaaaaccgcgaggggaatcaggacgatgttcggattgagatggccagacctcgccgggtgagacactggatgtattctcccgtcatcctgacaattctcgctatcggactggcggaatcctgcgacgagatggtgcatgccgatagcaaacttgtgtcttgtcgccagggcagcgggaacatgaaggaatgcgttacgaccggccgggctctgctccctgccgtcaatcccggacaagaggcctgtctgcactttacagctccgggctcccctgacagcaagtgcctgaagatcaaagtgaagagaattaacctcaaatgtaagaaatcttccagctacttcgtgcccgatgcccgctcccggtgcacctctgtcagacgctgtcggtgggcgggggactgccagagcggatgccctccccattttacatccaattctttcagcgacgattgggctggcaagatggacagagccgggctgggattttccggctgttctgatgggtgcggcggagccgcttgtggctgcttcaacgccgctcctagctgtatcttttggcggaagtgggtggagaatccccacgggattatctggaaagtttccccgtgcgccgcgtgggtgcctagcgccgtcattgaacttaccatgccctctggagaggtgcgcacgttccaccccatgtccggcatccctacacaggttttcaagggggtgagcgtcacctatctgggatctgacatggaagtgtccggcctcaccgatctgtgtgagatcgaagaactgaaaagcaagaaacttgctctcgccccgtgcaaccaggctggcatgggggttgtgggaaaggtcggcgagattcaatgttcttccgaagagagcgccagaacaatcaaaaaggacgggtgcatttggaacgcggatctggtgggaatcgaactgcgggtggacgatgccgtctgttactccaagattaccagcgttgaggctgtggccaattattctgctatccccacaacgatcggcgggctcagatttgaacgcagccatgactcccagggaaaaatttctggcagccctctggatatcaccgccattcggggctccttctctgtgaactacagagggcttcgcctgagcctctccgagatcacagctacctgcacaggagaggtcaccaatgtgtctggctgctacagctgtatgacgggggccaaggtttccattaaactgcacagctctaagaactccaccgcgcatgtgagatgcaaaggagacgaaacagcctttagcgtcctggagggcgtgcactcttataccgtttcccttagcttcgatcacgctgtggtcgacgaacagtgtcagctcaattgcgggggacatgagtcccaagtgacactgaagggcaacctgatctttctcgacgttcccaagttcgtggatggctcttacatgcagacctatcacagcacggtccctacaggggccaatatcccctcccctaccgactggctgaacgccctttttggaaatggcctgagccggtggattctcggggtgatcggagtgctgctgggcgggcttgctctcttctttatgattatgtctctgttcaaactgggaacaaagcaggtctttcgctccagaaccaaactcgcctga

SEQ ID NO: 14918 - RNA, 3222 nt, synthetic construct
  misc_feature 1..3222: note = derived and/or modified CDS sequence (opt5) from SFTSV/Huaiyangshan virus(2010-WWX)__HQ419232.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcttctggaatgcattaatgggggcgtcagactcatcaccctgacatctgagcttaagagcgcgaccgtgtgtgcctcccacttctgctctagcgctacatccggaaagaaaagcaccgagattcagttccattctggctccctcgttgggaagacggccatccacgtgaaaggagctctgatcgatggcacagaatttaccttcgaggggagctgtatgtttcccgacggatgcgatgccgtcgactgcacattctgtcgggaatttcttaagaacccccaatgctatcctgcgaaaaagtggctgttcattatcattgtgatcctcctgggctacgccgggcttatgctgctcaccaatgtcctgaaggctattggcatctggggatcttgggtgatcgccccggttaaactgatttttgctatcattaagaaactcatgcgcaccgtgtcctgtctgatgggcaagctgatggatagagggcggcaggtcatccacgaggaaattggagagaacagagagggcaatcaggacgatgtgcgcatcgaaatggcccggcccagacgcgttcggcattggatgtatagccctgtgattctgacaatcctcgccatcgggctggctgagtcttgcgacgaaatggtccacgcggatagcaaacttgtgtcctgtagacagggaagcggcaacatgaaggagtgcgtgacgaccgggcgcgccctgctccccgctgttaatcctggccaagaggcctgtctgcatttcacagcccccggatctccggactccaagtgcctgaaaattaaggtcaaacggatcaacctcaagtgtaaaaagagctcctcttactttgtgcctgatgctagaagccgctgcacctccgtgcggagatgtcgctgggccggcgactgccagtctgggtgtccccctcacttcacaagcaattccttttctgacgattgggcgggaaagatggaccgggctggcctggggttcagcggatgctccgatggctgcgggggcgccgcctgtggatgctttaacgctgcccccagctgtattttctggagaaaatgggtcgaaaatcctcatggcatcatttggaaggtgtctccctgcgctgcctgggttccgtccgcggtgatcgagcttaccatgcctagcggggaagtccggacgttccaccccatgtctggaatccccacacaggtgtttaaaggcgtttccgtgacctatctggggagcgacatggaggtctctggactcaccgatctgtgtgaaattgaggagctgaagtccaaaaagctcgcccttgctccttgcaaccaggccggcatgggcgtggttgggaaagtgggagaaatccaatgtagctccgaggaaagcgctcgcacaattaagaaggacggctgcatctggaacgccgatctggtcgggattgagctgagagtggacgatgcggtgtgttactctaaaatcaccagcgtcgaagccgttgctaattattccgccatcccgacaacgattggaggcctccggttcgagagatctcacgacagccaggggaagatctccggatctcccctggatattaccgctatccgcggcagcttttccgtgaactaccggggccttagactgtctctcagcgagattacagctacctgcacaggggaagtgaccaatgtctccggatgctacagctgtatgacgggcgccaaagtgtctatcaagctgcattccagcaaaaactctaccgcccacgttcgctgcaagggggacgagacagcgttctccgtgctggaaggagtccatagctataccgtgtccctttcttttgatcacgccgttgtggacgagcagtgtcagctcaattgcggcgggcacgaaagccaagtcacactgaagggaaacctgatcttcctcgacgtgcctaaatttgttgatggctcctacatgcagacctatcatagcacggtgcccacaggcgctaatattccttctcccaccgactggctgaacgcccttttcgggaatggactgtccagatggatcctcggcgtcattggggtgctgctgggaggccttgccctctttttcatgatcatgagcctgtttaagctggggacaaaacaggtgttccggtctcgcaccaagctcgcttga

SEQ ID NO: 14919 - RNA, 3222 nt, synthetic construct
  misc_feature 1..3222: note = derived and/or modified CDS sequence (opt5) from SFTSV/Huaiyangshan virus(2010-ZGQ)__HQ419233.1__GP
  source 1..3222: mol_type = other RNA
atgatgaaggtgatctggttcagctccctgatttgcctcgtcatccagtgtggcggggacaccggacccattatctgcgccggccctacacactctaacaaaagcgctgatattccgcatctgcttgggtactccgagaagatctgtcaaatcgacagactgattcacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgatcgttcccggaccttcttataagggcaaggtgttctttgagcgccccacgttcgacgggtacgtcggatggggctgtgggtccggaaaaagcagaaccgaatctggcgagctgtgctccagcgattccggcacatctagcgggctgctcccttccgaccgggtgctgtggattggagatgttgcctgtcagccgatgacccccatccctgaagagacatttcttgagcttaagagcttctctcagtccgaatttcccgacatttgcaaaatcgatggcattgtgttcaatcagtgtgagggggaaagcctccctcaaccctttgacgtcgcctggatggatgtgggacactctcataagatcatcatgcgcgagcacaaaaccaagtgggtgcaggagagctcctctaaggacttcgtctgctataaagaaggcacagggccgtgtagcgagtccgaagagaagacctgcaaaacgagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacccttgaagtgagccagcctgagcaacgcattggccagtgcacagggtgtcacctggaatgcatcaacggcggagtcagactcattaccctgacatccgagctgaagtctgcgaccgtgtgtgccagccatttttgctcctctgctacgagcggcaagaaatccacagagatccagttccacagcgggtctctcgttggaaagaccgccattcacgtgaaaggcgctctggtcgatgggacagaatttacctttgagggatcctgtatgttccccgacggctgcgatgccgtggactgcaccttttgtcgggagttccttaagaatccccaatgctatcctgcgaaaaagtggctgtttatcatcgtcgtgattctcctggggtacgccggccttatgctgctcacaaacgttctgaaggctatcggagtgtggggcagctgggtcattgccccggtgaaactggttttcgctatcattaagaaactcatgcgcgccgtgtcttgtctgatggggaagctgatggatagaggacggcaggtcatccatgaagaaatcggcgagaatagagaggggaaccaggacgatgtgcgcattgaaatggcccggcccagacgcgtgcggcactggatgtattcccctgttatcctgacgattctcgctatcggactggcggagggctgcgacgaaatggtccatgccgatagcaaacttgtgtcttgtagacaggggagcggcaatatgaaggagtgcgtgaccacaggacgcgctctgctccccgccgtcaaccctggccaagaggcctgtctgcactttaccgctcccgggtccccggacagcaagtgcctgaaaattaaggtgaaacggatcaatctcaagtgtaaaaagtcttccagctacttcgttcctgatgccagatcccgctgcacatctgtgcggagatgtcgctgggcgggagactgccagagcggctgtccccctcattttacctccaactctttcagcgacgattgggctgggaagatggaccgggccggactgggcttttccgggtgctctgatggctgcggaggcgccgcttgtgggtgcttcaatgccgctcccagctgtattttctggagaaaatgggtcgaaaaccctcacggaatcatctggaaggtgtccccctgcgccgcgtgggttccgagcgccgtgattgagcttacgatgccttctggcgaagtccggacattccaccccatgtccgggatccccacccaggtgttcaaaggagttagcgtgacctatctgggctctgacatggaggtctccggcctcacagatctgtgtgaaattgaggagcttaagagcaaaaagctggctctcgccccttgcaatcaggctgggatgggagtggtgggcaaagtcggggaaatccaatgttcttccgaggaaagcgcccgcaccattaagaaggacggatgcatctggaacgcggatctggttggcatcgagctgagagtggacgatgccgtgtgttactccaaaattacaagcgtcgaagctgtggccaactattctgctatcccgacgaccattgggggactccggtttgagagaagccatgactcccagggcaagatctctggcagccccctggatattacagccatccgcgggtccttctctgttaattaccggggacttagactgagcctctccgagatcaccgccacatgcaccggcgaagtgacgaacgtctctgggtgctacagctgtatgaccggagctaaagtgtccattaagctgcacagctctaaaaattccacagcgcatgttcgctgcaagggcgacgagaccgcctttagcgtgctggaaggggtccactcttattccgtgagcctttccttcgatcacgctgttgtggacgagcagtgtcagctcaactgcggaggccatgaatctcaagtcacactgagaggcaatctgatctttctcgacgtgcctaagttcgtggatgggagctacatgcagacctatcactccacggtccccacaggagccaacattcctagccccaccgactggctgaatgccctttttggcaacgggctgtctcggtggatcctcggagttattggcgtgctgcttgggggactggctctcttctttctgatcatgtccctgttcaaactcggcacaaagcagatctttcgcagcagaaccaaactggcctga

SEQ ID NO: 14920 - RNA, 3222 nt, synthetic construct
  misc_feature 1..3222: note = derived and/or modified CDS sequence (opt5) from SFTSV/Huaiyangshan virus(M-HZM)__JF951393.1__GP
  source 1..3222: mol_type = other RNA
atgatgaaggtgatctggttcagctccctgacctgcctcgtcattcagtgttctggcgacagcgggcccatcatttgcgccggacctatccactccaacaaatctgctggcattccgcatctgcttgggtacagcgagaagatctgtcaaatcgatagactgattcacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgatcgttcccgggcctagctataagggaaaggtgttctttgaacgccccacattcgatggctacgtcgggtggggatgtggctctgggaaatccagaacggagagcggagaactgtgctcctctgacagcggcacctccagcggcctgctcccttctgatcgggtgctgtggattggggacgttgcctgtcagccgatgacacccatccctgaggagacctttcttgaactgaagtccttcagccagtctgagtttcccgatatttgcaaaatcgacggaattgtgttcaatcagtgtgaaggcgagagcctccctcaaccctttgatgtcgcctggatggacgtggggcactcccataagatcatcatgcgcgagcacaaaacaaagtgggtgcaggaatctagctccaaggatttcgtctgctataaagagggaaccggcccgtgtagcgaatctgaggaaaaggcttgcaaaacatccgggagctgcagaggagacatgcagttttgtaaggttgccggctgcgagcacggcgaggaagcctctgaggccaaatgtcggtgctccctggtgcataagcctggggaagtggtcgtgagctacggaggcatgcgcgttagacccaaatgttacgggttctcccggatgatggcgacccttgaggtgaaccctcccgaacagcgcattggacaatgcacgggctgtcacctggagtgcatcaatgggggcgtcagactcattaccctgacatctgagctgcggagcgccaccgtgtgtgcttcccatttttgctctagcgccacatccggaaagaagaacaccgaaatccacttccacagcggctctctcgttgggaaaacggctattcatgtgaagggagccctggtcgacggcacagagttcacctttgaagggtcctgtatgttccccgatggatgcgacgcggtggattgcacattttgtcgcgagttccttaaaaatcctcagtgctatccggccaagaaatggctgtttatcatcattgtcatcctcctgggctacgctgggcttatgctgctcaccaacgtgctgaaggccattggcgtttggggaagctgggtgatcgctcccgtcaagctgatgttcgccattatcaaaaagctcatgagaaccgtgtcttgtctggttggcaaacttatggaccgggggagacaggtgatccacgaagagattggagagaatggcgaagggaaccaagatgacgtccgcatcgagatggcccggcctagacgcgtgcggcattggatgtattcccccgtgattctgacaatcctcgctattggactggcggaaggctgcgatgagatggttcacgccgacagcaaacttgtctcttgtagacaggggagcggcaatatgaaggagtgcatcacgaccggacgcgctctgctccctgccgtgaaccccggccaggaagcctgtctgcattttacagctccggggtcccctgatagcaagtgcctgaagattaaagtgaagcggatcaatctcaaatgtaagaaatcttccagctacttcgtccccgacgccagatcccgctgcacctctgtgcggagatgtcgctgggcgggagattgccagagcggctgccctccccactttacatccaactctttcagcgacgactgggctgggaagatggatcgggccggactgggcttttccgggtgttctgacggctgcggaggcgccgcttgtgggtgcttcaatgccgctcctagctgtatcttttggagaaagtgggttgagaacccccacggaattatctggaaagtgtccccgtgcgccgcgtgggtccctagcgccgtgattgaacttaccatgccctctggcgaggttcggacgttccatcccatgtccgggatccctacacaagtgttcaagggagtcagcgtgacctatctgggctctgatatggaagtttccggcctcaccgacctgtgtgagattgaggaactgaaaagcaagaaacttgctctcgccccgtgcaaccaggctgggatgggagtggtcggcaaggtgggggagatccagtgttcttccgaagagagcgcccgcacaatcaaaaaggatggatgcatttggaatgcggacctggtgggcatcgaactgagagtcgatgacgccgtttgttactccaagattaccagcgtggaggctgtggccaactattctgctatccccacaacgattgggggactccggtttgagagaagccacgattcccagggcaaaatctctggcagccctctggacatcaccgccattcgcgggtccttctctgtcaatcttcggggactgagactcagcctgtccgaaatcacagctacctgcacaggcgaggtgaccaacgtttctgggtgctacagctgtatgacgggagctaaggtgtccattaaactgcatagctctaaaaattccaccgcgcacgtccgctgcaagggcgatgaaacagcctttagcgtgcttgagggggttcactcttacatcgtgtccctcagcttcgaccatgctgtcgtggatgaacaatgtcagctgaactgcggaggccacgagtcccaggttaccctgaagggcaatctcatttttctggacgtgcccaagttcgtcgacgggtcttatatgcagacataccatagcaccgtgcctacgggagccaacatcccctcccctacagattggcttaatgccctgtttggcaacgggctcagcagatggatcctgggagtgattggcgtcctgcttgggggactcgctctgttctttctgatcatgttcctcctgaaacttggcaccaagcaagtttttcggtctcgcacaaaactggcctga

SEQ ID NO: 14921 - RNA, 3222 nt, synthetic construct
  misc_feature 1..3222: note = derived and/or modified CDS sequence (opt5) from SFTSV/Phlebovirus(AH15/China/2010 strain AH15)__HQ141593.1__GP
  source 1..3222: mol_type = other RNA
atgatgaaggtgatctggttctttagcctgatttgcctcgtcatccagtgtggcggggacaccggacccattatctgcgccggccctattcactccaacaaatctgctgatatcccgcatctgcttgggtacagcgagaagatctgtcaaattgacagactgatccacgtttcctcttggctccggaatcatagccagttccagggatatgtgggccagcgcgggggaagatcccaagtgtcttactatcccgccgaaaacagctactcccggtggagcggcctgctttctccttgcgatgcggactggctgggcatgctcgtcgtgaaaaaggctaaagggtccgatatgattgttcccggacctagctataagggcaaggtgtttttcgagcgccccacatttgacgggtacgtcggatggggctgtgggtctggaaaatccagaacggaaagcggcgagctgtgctcctccgatagcggcacctcctctgggctgctccctagcgaccgggtgctgtggatcggagatgttgcctgtcagccgatgacacccattcctgaagagaccttccttgagctgaagtcctttagccagtctgagttccccgacatctgcaaaattgatggcatcgtgtttaatcagtgtgaaggggaatccctccctcaacccttcgacgtcgcctggatgggagtgggccacagccataagatcattatgcgcgagcacaaaacaaagtgggtgcaggagtctagctccaaggattttgtctgctataaagaagggaccggaccgtgttctgagagcgaagagaagacatgcaaaacctccggcagctgcagaggcgacatgcagttctgtaaggttgctgggtgcgaacacggagaggaggcctctgaagctaaatgtcggtgctccctggtgcataagcctggcgaggtggtcgtgagctacgggggaatgcgcgttagacccaaatgttacggcttttctcggatgatggccacgcttgaagtgaacgagcctgaacagcgcatcgggcaatgcaccggctgtcacctggagtgcattaatggaggcgtcagactcatcacactgacctccgagcttaagagcgcgacagtgtgtgcctcccatttctgctctagcgctacctccgggaagaaatctacggaaattcagttccacagcggatccctcgttggcaagacagccatccacgtgaaaggggctctggtcgacggaaccgagtttacattcgaaggcagctgtatgtttcccgatgggtgcgacgccgtggattgcaccttctgtcgggagtttcttaagaacccccagtgctatcctgcgaaaaagtggctgttcatcattatcgtcattctcctgggctacgccggacttatgctgctcaccaatgtgctgaaggctatcggcgtttgggggtcttgggtgattgccccggtcaaactggtgtttgctatcatcaagaaactcatgcgcgccgtttcctgtctgatgggaaagctgatggacagaggccggcaagtgattcatgaagagatcggggagaacagagaaggaaatcaggatgacgtccgcattgagatggcccggcccagacgcgtgcggcactggatgtatagccctgtgatcctgacaattctcgctatgggcctggcggaagggtgcgatgagatggttcatgccgactctaaacttgtctcctgtagacagggcagcggaaacatgaaggagtgcgtgacgaccggccgcgctctgctccccgccgtgaatcctgggcaggaagcctgtctgcacttcacagctcccggatctccggatagcaagtgcctgaaaatcaaggtcaaacggattaacctcaagtgtaaaaagtccagctcttactttgtgcctgacgccagatcccgctgcaccagcgttcggagatgtcgctgggcgggcgattgccaatccgggtgtccccctcatttcacatctaatagcttttccgacgactgggctggaaagatggatcgggccggcctggggttctctggctgcagcgacggatgcggcggggccgcttgtggatgctttaacgccgctccctcctgtatcttctggagaaaatgggtggagaatcctcacggcatcatttggaaggtctctccctgcgccgcgtgggtgccgagcgccgttatcgaacttaccatgccttccggggaggtgcggacgttccaccccatgagcggcattcccacacaggtctttaaaggagtgtctgttacctatctgggctccgatatggaagtgagcgggctcaccgacctgtgtgagatcgaggaactgaagtctaaaaagctcgctcttgccccttgcaaccaggctggaatgggcgtcgtggggaaagtgggagagattcagtgttccagcgaagagtctgcccgcacaatcaagaaggatggctgcatctggaacgcggacctggtcgggattgaactgagagttgatgacgccgtgtgttactccaaaatcaccagcgtggaggctgtcgccaattattccgctattccgacaacgatcggaggcctccggttcgagagaagccatgattctcaaggcaagattagcgggtctcccctggacatcaccgccatccgcggatcttttagcattaactaccggggccttagactgtccctcacagaaatcaccgccacatgcaccggggaggtgacgaatgtttctggatgctacagctgtatgaccggcgctaaagtgtccattaagctgcactctagcaaaaactccacagcgcatgtccgctgcaagggggatgaaaccgccttcagcgtgctggagggagttcactcttattccgtgagcctttcttttgaccacgctgtcgtggatgaacagtgtcagctcaattgcggcggccatgagtcccaggttacactgagagggaacctgatcttcctcgacgtgcctaagtttgtcgacggaagctacatgcaaacctatcactccacggtgcccacaggcgccaatattccttctcccaccgattggctgaacgcccttttcgggaatggactgagccggtggatcctcggcgtgatcggggtcctgctgggaggccttgctctctttttcctgattatgtccctgtttaaactcggcacaaagcaggttttccgcagcagaaccaaactggcctga

SEQ ID NO: 14922 - RNA, 3222 nt, synthetic construct
  misc_feature 1..3222: note = derived and/or modified CDS sequence (opt5) from SFTSV/Phlebovirus(HN6/China/2010 strain HN6)__HQ141596.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaacccccaatgctatcctgcgaaaaagtggcttttcatcattatcgtcattctgctcggctacgccgggctgatgcttctgaccaatgtgctcaaggctatcggcatttggggatcttgggttatcgccccggtgaaactgatctttgctattatcaagaaactgatgcgcaccgtctcctgtctcgtgggcaagctgatggatagagggcggcaggttattcatgaggaaatcggagagaacagagagggcaatcaggacgatgtgcgcattgaaatggcccggcccagacgcgtccggcactggatgtatagccctgtgatccttacaattctggccatcgggctcgctgagtcttgcgacgaaatggtgcatgcggatagcaaactggtttcctgtagacagggaagcggcaacatgaaggagtgcgtcacgaccgggcgcgcccttctgcccgctgtgaatcctggccaagaggcctgtctccacttcacagcccccggatctccggactccaagtgcctgaaaatcaaggtgaaacggattaacctgaagtgtaaaaagagctcctcttactttgtccctgatgctagaagccgctgcacctccgtgcggagatgtcgctgggccggcgactgccagtctgggtgtccccctcatttcacaagcaattccttttctgacgattgggcgggaaagatggaccgggctggcctcgggttcagcggatgctccgatggctgcgggggcgccgcctgtggatgctttaacgctgcccccagctgtatcttctggagaaaatgggttgaaaatcctcacggcattatctggaaggtgtctccctgcgctgcctgggtcccgtccgcggtgattgagctgaccatgcctagcggggaaatgcggacgttccaccccatgtctggaatccccacacaggtttttaaaggcgtgtccgtcacctatcttgggagcgacatggaggtgtctggactgaccgatctctgtgaaatcgaggagctgaagtccaaaaagctggcccttgctccttgcaaccaggccggcatgggcgttgtggggaaagtcggagaaattcaatgtagctccgaggaaagcgctcgcacaatcaagaaggacggctgcatttggaacgccgatctcgtggggatcgagctgagagtggacgatgcggtctgttactctaaaattaccagcgttgaagccgtggctaattattccgccatcccgacaacgatcggaggcctgcggttcgagagatctcatgacagccaggggaagatttccggatctcccctcgatatcaccgctattcgcggcagcttttccgtgaactaccggggcctgagactttctctgagcgagatcacagctacctgcacaggggaagtcaccaatgtgtccggatgctacagctgtatgacgggcgccaccgtttctattaaactccactccagcaagaactctacagcccatgtgcgctgcaaaggggacgagaccgcgttctccgtcctggaaggagtgcacagctatacagtttccctgtcttttgatcacgccgtggtcgacgagcagtgtcagcttaattgcggcgggcatgaaagccaagtgaccctcaagggaaacctgatcttcctggacgttcctaagtttgtggatggctcctacatgcagacgtatcacagcacagtccccaccggcgctaatatcccttctcccacagactggctcaacgccctgttcgggaatggactttccagatggattctgggcgtgatcggggtgctcctgggaggcctggccctgtttttcatgattatgagcctctttaaactggggaccaagcaggtcttccggtctcgcaccaaactggcttga

SEQ ID NO: 14923 - RNA, 3222 nt, synthetic construct
  misc_feature 1..3222: note = derived and/or modified CDS sequence (opt5) from SFTSV/Phlebovirus(JN1/China/2010)__JN258706.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccaatatctgcaaaattgatggaatcgtgttcaaccagtgtgaaggcgagagcctccctcaaccctttgacgtcgcctggatggatgtggggcactcccataagatcattatgcgcgagcacaaaaccaagtgggtgcaggaatctagctccaaggacttcgtctgctataaagagggaacaggcccgtgtagcgaatctgaggaaaaggcttgcaaaacctccgggagctgcagaggagatatgcagttttgtaaggttgccggctgcgagcacggcgaggaagctagcgaggccaaatgtcggtgctccctggtgcataagcctggggaagtggtcgtgagctacggaggcatgcgcgttagacccaaatgttacgggttctcccggatgatggcgacacttgaggtgaatcctcccgaacagcgcatcggacaatgcaccggctgtcacctggagtgcattaacgggggcgtcagactcgtgacgctgacctctgagctgcggagcgccacagtttgtgcttcccatttttgctctagcgccacctccggaaagaagtctacagaaatccacttccactctggctccctcgtggggaaaaccgctattcatgtcaagggagccctggtggacggcacggagttcacatttgaagggagctgtatgttccccgacggatgcgatgcggtcgactgcaccttttgtcgcgagttccttaaaaatcctcagtgctatccggccaagaaatggctgtttatcatcattgtgatcctcctgggctacgctgggcttatgctgctcacaaacgttctgaaggccattggcgtgtggggatcttgggtcatcgctcccgtgaagctgatgttcgccattatcaaaaagctcatgagaaccgtttcctgtctggtgggcaaacttatggatcgggggagacaggtcatccacgaagagattggagagaatggcgaagggaaccaagacgatgtgcgcatcgagatggcccggcctagacgcgtgcggcattggatgtatagccccgttattctgaccatcctcgctattggactggcggaaggctgcgacgagatggtccacgccgattctaagctggtgagctgtagacaggggtccggcaatatgaaagagtgcatcacaacgggacgcgctctgctccctgccgtgaaccccggccaggaagcctgtctgcattttaccgctccggggagccctgactctaagtgcctgaagattaaagtcaagcggatcaatctcaaatgtaagaaatccagctcctacttcgtgcccgatgccagatctcgctgcacaagcgttcggagatgtcgctgggcgggagactgccagtccggctgccctccccactttacctctaacagcttctccgatgactgggctgggaagatggaccgggccggactgggcttttctgggtgtagcgatggctgcggaggcgccgcttgtgggtgcttcaatgccgctccttcctgtatcttttggagaaagtgggtggagaacccccacggaattatctggaaagtcagcccgtgcgccgcgtgggtgccttctgccgttattgaacttacaatgccctccggcgaggtgcggaccttccatcccatgagcgggatccctacgcaagtcttcaagggagtgtctgttacatatctgggctccgacatggaagtgagcggcctcaccgatctgtgtgagattgaggaactgaaatctaagaaacttgctctcgccccgtgcaaccaggctgggatgggagtcgtgggcaaggtgggggagatccagtgttccagcgaagagtccgcccgcaccatcaaaaaggacggatgcatttggaatgcggatctggtcggcatcgaactgagagttgacgatgccgtgtgttacagcaagattacatctgtggaggctgtcgccaactatagcgctatccccaccacaattgggggactccggtttgagagatcccacgactctcagggcaaaatcagcggctcccctctggatatcacggccattcgcgggtctttcagcgtgaattaccggggacttagactgtccctctctgaaatcaccgccacatgcaccggcgaggttacaaacgtgagcgggtgctactcctgtatgaccggagctaaggtcagcattaaactgcattcttccaagaatagcacggcgcacgtgcgctgcaaaggcgacgaaaccgccttttctgttctgaagggggtgcactcctatatcgtcagcctttccttcgatcatgctgtggttgacgagcaatgtcagctcaactgcggaggccacgaatctcaggtgacactgaagggcaatctgatttttctcgatgtccccatcttcgtggacgggagctacatgcagacctatcattccacagtgcctaccggagccaacatccccagccctacggactggctgaatgccctttttggcaacgggctgtctagatggattctcggagtcatcggcgttctgcttgggggacttgctctcttctttctgattatgttcctgctcaaactgggcacaaagcaagtgtttcggtcccgcaccaaacttgcctga

SEQ ID NO: 14924 - RNA, 3222 nt, synthetic construct
  misc_feature 1..3222: note = derived and/or modified CDS sequence (opt5) from SFTSV/Phlebovirus(JS2010-014)__JQ317170.1__GP
  source 1..3222: mol_type = other RNA
atgatgaaggtgatctggttcagctacctgatttgctttgtcatccagtgttccggcgactctgggcccattatctgggccggacctattcacagcaacaaatccgctgatatcccgcatctcctgggctattctgagaagatctgccaaattgacagacttatccacgttagctcctggctgcggaatcattctcagttccaggggtacgtgggacagcgcggcgggagaagccaagtgtcctattaccccgccgaaaacagctattctcggtggtccggactcctgagcccttgtgatgcggactggcttggcatgctggtcgtgaaaaaggctaaaggctctgatatgattgttcccgggccttcctacaagggaaaggtgtttttcgagcgccccacctttgacggctatgtcgggtggggatgcggcagcgggaaatctagaacagaatccggagagctctgtagctccgattctggcacgagctccggcctgctgcctagcgaccgggtgctctggatcggggatgttgcctgccagccgatgacccccattcctgaagagacattcctggagcttaagtctttttcccagagcgagttccccgacatctgtaaaattgatggaatcgtgtttaatcagtgcgagggcgaatctctgcctcaacccttcgacgtcgcctggatggatgtggggcacagccataagatcattatgcgcgagcacaaaaccaagtgggtgcaggagtcctctagcaaggactttgtctgttacaaagaaggaacaggcccgtgctccgagagcgaagagaagacctgtaaaacatctgggtcctgcagaggagacatgcagttctgcaaggttgctggctgtgaacacggcgaggaggccagcgaagctaaatgccggtgttctctcgtgcataagcctggggaggtggtcgtgtcctacggaggcatgcgcatcagacccaaatgctatgggtttagccggatgatggccaccctggaagtttcccagcctgagcaacgccttggacagtgtacgggctgccacctggaatgtattaacgggggcgtgagactcatcaccctgacatctgagcttaagagcgcgaccgtctgcgcctcccatttctgttctagcgctacatccggaaagaaaagcaccgagattcagttccactctggctccctcgtggggaagacggccatccacgttaaaggagctctggtggatggcacagaatttaccttcgaggggagctgcatgtttcccgacggatgtgatgccgtcgactgcacattctgccgggaatttcttaagaatccccaatgttaccctgcgaaaaagtggctgttcatcattatcgtgattctcctgggctatgccgggcttatgctgctcaccaacgtcctgaaggctatcggcatttggggatcttgggtgatcgccccggttaaactgatgtttgctatcattaagaaactcatgcgcaccgtgtcctgcctgatgagaaagctgatggatcggggcagacaggtcatccatgaggaaattggggagaatcgcgtgggaaaccaggacgatgttcggatcgagatggccagaccccgccgggtgagacactggatgtacagccctgtcattctgacaatcctcgccattggcctggctgaatcttgtgacgagatggtgcatgcggatagcaaacttgtgtcctgccgccaggggagcggaaatatgaaggaatgtgttacgaccggccgggccctgctccccgctgtcaaccctgggcaagaggcctgcctgcacttcacagcccccggctctccggactccaagtgtctgaaaatcaaggtgaaaagaatcaatctcaagtgcaaaaagagctcctcttattttgtgcctgatgctcgcagccggtgtacctccgtcagacgctgccggtgggccggagactgtcagtctggctgtccccctcatttcacaagcaactccttttctgacgattgggcggggaagatggacagagctggactgggcttcagcgggtgctccgatggatgcggcggggccgcctgcggctgttttaatgctgcccccagctgcattttctggcggaaatgggtggagaaccctcacggaatcatttggaaggtttctccctgtgctgcctgggtgccgtccgcggtcatcgaacttaccatgcctagcggcgaggtgcgcacgttccaccccatgtctgggattcccacacaggtttttaaaggagtgtccgtcacctacctgggcagcgacatggaagtgtctgggctcaccgatctgtgcgagatcgaagaactgaagtccaaaaagctggccctcgctccttgtaatcaggccggaatgggcgttgtgggcaaagtcggggagatccaatgcagctccgaagagagcgctagaacaattaagaaggacggatgtatctggaacgccgatctggtgggcattgaactgcgggtggacgatgcggtctgctattctaaaatcaccagcgttgaggccgtggctaactactccgccattccgacaacgatcgggggactcagattcgaacgctctcatgacagccagggcaagatctccgggtctcccctggatattaccgctatccggggcagcttttccgtgaattacagaggacttcgcctgtctctcagcgagattacagccacctgtacaggcgaggtcaccaacgtgtccgggtgctatagctgcatgacgggagccaaagtttctatcaagctgcactccagcaaaaattctaccgctcatgtgagatgtaagggcgacgaaacagcgttctccgtcctggagggggtgcacagctacaccgtttccctttcttttgatcacgccgtggtcgacgaacagtgccagctcaactgtggaggccatgagagccaagtgacactgaaggggaatctgattttcctcgacgttcctaaatttgtggatggatcctatatgcagacctaccacagcacggtccccacaggcgctaacatcccttctcccaccgactggctgaatgcccttttcggcaacgggctgtcccggtggatcctcggagtgattggcgtgctgcttgggggacttgccctctttttcatgatcatgagcctgtttaagctgggcacaaaacaggtcttccgctctagaaccaagctcgcttga

SEQ ID NO: 14925 - RNA, 3222 nt, synthetic construct
  misc_feature 1..3222: note = derived and/or modified CDS sequence (opt5) from SFTSV/Phlebovirus(JS2010-015)__JQ317173.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccagcctgagcaacgcatcggacagtgcacgggctgtcaccttgaatgcattaatgggggcgtcagactgatcaccctcacatctgagctcaagagcgcgaccgtgtgtgcctcccatttctgctctagcgctacatccggaaagaaaagcaccgagattcagttccactctggctccctggttgggaagacggccatccacgtgaaaggagctctggtcgatggcacagaatttaccttcgaggggagctgtatgtttcccgacggatgcaacgccgtggattgcacattctgtcgggaatttctgaagaatccccaatgctatcctgcgaaaaagtggcttttcatcattatcgtcattctgctcggctacgccgggctgatgcttctgaccaacgtgctcaaggctatcggcatttggggatcttgggttatcgccccggtgaaactgatgtttgctatcattaagaaactgatgcgcaccgtctcctgtctcatgggcaagctgatggacagagggagacaggtgatccatgaggaaattggagagaatcgggagggcaaccaggatgacgttcgcatcgaaatggcccggcccagacgcgtgcggcactggatgtatagccctgtcattcttacattcctggccatcgggctcgctgagtcttgcgatgaaatggtgcatgcggacagcaaactggtgtcctgtagacagggaagcggcaatatgaaggagtgcgttacgaccgggcgcgcccttctgcccgctgtcaaccctggccaagaggcctgtctccactttacagcccccggatctccggattccaagtgcctgaaaattaaggtgaaacggatcaatctgaagtgtaaaaagagctcctcttacttcgtgcctgacgctagaagccgctgcacctccgtccggagatgtcgctgggccggcgattgccagtctgggtgtccccctcattttacaagcaactccttctctgacgactgggcgggaaagatggatcgggctggcctcgggtttagcggatgctccgacggctgcgggggcgccgcctgtggatgcttcaatgctgcccccagctgtatcttctggagaaaatgggtggaaaaccctcacggcattatctggaaggtttctccctgcgctgcctgggtgccgtccgcggtcattgagctgaccatgcctagcggggaagtgcggacgtttcaccccatgtctggaatccccacacaggttttcaaaggcgtgtccgtcacctatcttgggagcgatatggaggtgtctggactgaccgacctctgtgaaattgaggagctgaagtccaaaaagctggcccttgctccttgcaaccaggccggcatgggcgttgtggggaaagtcggagaaatccaatgtagctccgaggaaagcgctcgcacaatcaagaaggatggctgcatttggaatgccgacctcgtggggatcgagctgagagtggatgacgcggtctgttactctaaaattaccagcgttgaagccgtggctaactattccgccatcccgacaacgattggaggcctgcggtttgagagatctcatgatagccaggggaagatctccggatctcccctcgacatcaccgctattcgcggcagcttctccgtgaattaccggggcctgagactttctctgagcgagatcacagctacctgcacaggggaagtcaccaacgtgtccggatgctacagctgtatgacgggcgccaaagtttctattaagctccactccagcaaaaattctaccgcccatgtgcgctgcaagggggatgagacagcgttttccgtcctggaaggagtgcacagctataccgtttccctgtctttcgaccacgccgtggtcgatgagcagtgtcagcttaactgcggcgggcatgaaagccaagtgacactcaagggaaatctgatctttctggacgttcctaaattcgtggacggctcctacatgcagacctatcacagcacggtccccacaggcgctaacattccttctcccaccgattggctcaatgccctgtttgggaacggactttccagatggatcctgggcgtgatcggggtgctcctgggaggcctggcccttttctttatgattatgagcctcttcaagctggggacaaaacaggtctttcggtctcgcaccaagctggcttga

SEQ ID NO: 14926 - RNA, 3222 nt, synthetic construct
  misc_feature 1..3222: note = derived and/or modified CDS sequence (opt5) from SFTSV/Phlebovirus(JS2010-019)__JQ317179.1__GP
  source 1..3222: mol_type = other RNA
atgatgaaggtgatctggttcagctccctgacctgctttgtcattcagtgttctggcgacagcgggcccatcatttgcgccggacctatccactccaacaaatctgctgatattccgcatctcctgggctacagcgagaagatctgtcaaatcgacagacttattcacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgatcgttcccgggcctagctataagggaaaggtgtttttcgagcgccccacatttgacggctacgtcgggtggggatgtggctctgggaaatccagaacggaaagcggagagctctgctcctctgatagcggcacctccagcggcctgctgccttctgaccgggtgctctggattggggatgttgcctgtcagccgatgacacccatccctgaagagaccttcctggagcttaagtcctttagccagtctgagttccccgacatttgcaaaatcgatggaattgtgtttaatcagtgtgaaggcgaaagcctgcctcaacccttcgacgtcgcctggatggatgtggggcactcccataagatcatcatgcgcgagcacaaaacaaagtgggtgcaggagtctagctccaaggactttgtctgctataaagaaggaaccggcccgtgtagcgagtctgaagagaagacatgcaaaacctccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccacgctggaagtgaaccagcctgagcaacgccttggacagtgcaccggctgtcacctggaatgcattaatgggggcgtcagactcatcacactgacctctgagcttaagagcgcgacagtgtgtgcctcccatttctgctctagcgctacctccggaaagaaaagcacggagattcagttccactctggctccctcgttgggaagacagccatccacgtgaaaggagctctggtcgatggcaccgaatttacattcgaggggagctgtatgtttcccgacggatgcgatgccgtggactgcaccttctgtcgggaatttcttaagaacccccaatgctatcctgcgaaaaagtggctgttcattatcatcgtcattctcctgggctacgccgggcttatgctgctcaccaatgtgctgaaggctatcggcatttggggatcttgggttatcgccccggtgaaactgatgtttgctattatcaagaaactcatgcgcacagtctcctgtctgatgagaaagctgatggatcggggcagacaggtgatccatgaggaaattggggagaaccgcgagggaaatcaggacgatgttcggatcgaaatggccagaccccgccgggtgagacactggatgtatagccctgtcattctgacgatcctcgccattggcctggctgagtcttgcgacgaaatggtgcatgcggatagcaaacttgtgtcctgtcgccaggggagcggaaacatgaaggagtgcgttaccacaggccgggccctgctctctgctgtcaatcccgggcaagaggcctgtctgcacttcaccgcccctggctcccccgacagcaagtgcctgaaaatcaaggtgaaaagaattaacctcaagtgtaaaaagtcctctagctactttgtgccggatgctcgctcccggtgcacatctgtcagacgctgtcggtgggccggagactgccagagcggctgccctccccatttcacctccaattcttttagcgacgattgggcggggaagatggacagagctggactgggcttctccgggtgtagcgatggatgcggcggggccgcctgtggctgctttaacgctgccccttcttgtatcttctggcggaaatgggtggaaaatccccacggaatcatttggaaggtttccccttgcgctgcctgggtgcccagcgcggtcatcgagcttacgatgccgtctggcgaagtgcgcacattccaccctatgtccgggattcccacccaggtttttaaaggagtgagcgtcacctatctgggctctgacatggaggtgtccgggctcacagatctgtgtgaaatcgaggagcttaagagcaaaaagctggccctcgctccctgcaaccaggccggaatgggcgttgtgggcaaagtcggggaaattcaatgttccagcgaggaatctgctagaaccatcaagaaggacggatgcatctggaacgccgatctggtgggcattgagctgcgggtggacgatgcggtctgttacagcaaaatcacatccgttgaagccgtggctaattattctgccattcctacgaccatcgggggactcagattcgagcgcagccatgactcccagggcaagatttctgggagcccgctggatatcacagctatccggggatccttttctgtgaactacagaggccttcgcctgagcctctccgagattaccgccacatgcaccggcgaagtcacgaatgtgagcgggtgctactcttgtatgaccggagccaaagtttccatcaagctgcacagctctaaaaactccacagctcatgtgagatgcaagggcgacgagaccgcgttcagcgtcctggaagggggacactcctatacagtgtctcttagctttgatcacgccgttgtggacgagcagtgtcagctcaattgcggcgggcatgaatcccaagtcaccctgaagggaaacctgattttcctcgacgtgcccaaatttgttgatggcagctacatgcagacgtatcactctacagtgcctaccggcgctaatatcccctcccctacagactggctgaacgcccttttcgggaatggactgagccggtggattctcggcgtcatcggggtgctgctgggaggccttgccctctttttcatgatcatgtctctgtttaagctggggaccaaacaggtgttccgcagcagaaccaagctcgcttga

SEQ ID NO: 14927 - RNA, 3222 nt, synthetic construct
  misc_feature 1..3222: note = derived and/or modified CDS sequence (opt5) from SFTSV/Phlebovirus(JS24)__HQ830164.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagcttaagagcttctctcagtccgaatttcccgacatctgcaaaattgatggcatcgtgttcaatcagtgtgggggagagagcctccctcaaccctttgacgtcgcctggatggatgtgggccactctcataagatcattatgcgcgaacacaaaacaaagtgggtgcaggagagctcctctaaggacttcgtctgctataaagaggggaccggaccgtgtagcgaatccgaggaaaagacatgcaaaaccagcggctcttgcagaggcgacatgcagttttgtaaggttgctgggtgcgagcacggagaagaggcctccgaggctaaatgtcggtgcagcctggtgcataagcctggcgaagtggtcgtgtcttacgggggaatgcgcgttagacccaaatgttacggcttctcccggatgatggccacgcttgaggtgaaccagcctgaacaacgcatcgggcagtgcaccggctgtcacctggagtgcattaatggaggcgtcagactcatcacactgaccagcgaactgaagtccgcgacagtgtgtgcctctcatttttgcagctccgctacctctgggaagaaaagcacggagattcagttccactccggaagcctcgttggcaagacagccatccacgtgaaaggggctctggtcgatggaaccgagttcacatttgaaggctcttgtatgttccccgacgggtgcgatgccgtggactgcaccttttgtcgggagttccttaagaacccccaatgctatcctgcgaaaaagtggctgtttatcattatcgtcattctcctgggctacgccggacttatgctgctcaccaatgtgctgaaggctatcggcgtttgggggtcctgggtgattgccccggtcaaactggtgttcgctatcatcaagaaactcatgcgcgccgttagctgtctgatgggaaagctgatggatagaggcagacaggtgattcatgaagagatcggggaaaaccgggagggaaatcaggacgatgtccgcattgagatggcccggcccagacgcgtgcggcactggatgtattctcctgtgatcctgacaattctcgctatcggcctggcggaagggtgcgacgagatggttcatgccgattccaaacttgtcagctgtagacagggctctggaaacatgaaggaatgcgtgacgaccggccgcgctctgctccccgccgtgaatcctgggcaagaggcctgtctgcactttacagctcccggaagcccggactccaagtgcctgaaaattaaggtcaaaaagatcaacctcaaatgtaagaagtctagctcctacttcgtgcctgatgcccggagcagatgcacctccgttcgccggtgtagatgggcgggcgactgccagtctgggtgtccccctcattttacaagcaattccttctctgacgattgggctggaaaaatggaccgcgccggcctggggtttagcggctgctccgatggatgcggcggggccgcttgtggatgcttcaacgccgctccctcttgtatcttttggcggaagtgggtggagaatcctcacggcattatctggaaagtcagcccctgcgccgcgtgggtgccgtccgccgttattgaacttaccatgcctagcggggaggtgagaacgttccaccccatgtctggaatccccacacaggtcttcaagggcgtgtccgttacctatctgggcagcgacatggaagtgtctgggctcaccgatctgtgtgagattgaggaactgaaatccaagaaacttgctctcgccccttgcaaccaggctggaatgggcgtcgtggggaaggtgggagagatccaatgtagctctgaagagtccgcccggacaatcaagaaagacggctgcatttggaacgcggatctggtcgggatcgaactgcgcgttgacgatgccgtgtgttacagcaagattacctccgtggaggctgtcgccaattatagcgctatcccgacaacgattggaggcctcagatttgaacggtctcatgacagccagggcaaaatctccgggtctcccctggatatcaccgccattagaggcagcttctccgtgaactaccgcggacttcggctgtctctcagcgagatcacagctacctgcacaggggaggttaccaatgtgtccggatgctactcttgtatgacgggcgccaaggtcagcattaaactgcactccagcaagaactctaccgcgcatgtgagatgcaagggggacgaaacagccttttccgttctggagggagtgcacagctattctgtctcccttagcttcgatcacgctgtggttgacgaacagtgtcagctcaattgcggcggccatgagtcccacgtgaccctgaaagggaacctgatctttctcgacgtccctaagttcgtggatggatcttacatgcaaacatatcatagcaccgtgcccacgggcgccaatattccttcccccacagactggctgaacgccctttttgggaatggactgagccgctggatcctcggcgtcatcggggttctgctgggaggccttgctctcttctttctgattatgtctctgttcaaactcggcaccaaacaggtgtttagatcccggacaaagctggcctga

SEQ ID NO: 14928 - RNA, 3222 nt, synthetic construct
  misc_feature 1..3222: note = derived and/or modified CDS sequence (opt5) from SFTSV/Phlebovirus(JS4/China/2010 strain JS4)__HQ141605.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccctcccgagcagcgcatcggacaatgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaaccctcagtgctatccggcgaaaaagtggcttttcatcattatcgtcattctgctcggctacgccgggctgatgcttctgaccaatgtgctcaaggctatcggcgtttggggatcttgggtgattgcccccgtcaaactgctgtttgctatcatcaagaaactcatgcgcaccgtgtcctgtctgatgggcaagctgatggatagagggcggcaagttattcatgaggaaatcggagagaacagagagggcaatcaggacgatgtgcgcattgaaatggcccggcctagacgcgtccggcactggatgtatagccccgtgatcctgacaattctcgccatcgggctggctgagggatgcgacgaaatggtgcatgcggattctaaacttgttagctgtagacagggctccgagaacatgaaggagtgcgtcacgaccgggcgcgccctgctccctgctgtgaatcccggccaggaagcctgtctgcacttcacagccccgggaagccctgactctaagtgcctgaaaattaaggtgaaacggatcaacctcaagtgtaaaaagtccagctcctactttgtccccgatgctagatctcgctgcaccagcgtgcggagatgtcgctgggccggcgactgccaatccgggtgccctccccatttcacatctaatagcttttccgacgattgggcgggaaagatggaccgggctggcctggggttctctggatgtagcgatggctgcgggggcgccgcctgtggatgctttaacgctgccccttcctgtatcttctggagaaaatgggttgagaatccccacggcattatctggaaggtgagcccgtgcgctgcctgggtcccttctgcggtgattgaacttaccatgccctccggggaggttcggacgttccaccccatgagcggaatccctacacaggtgtttaaaggcgtctctgtgacctatctggggtccgacatggaagttagcggactcaccgatctgtgtgagattgaggaactgaagtctaaaaagctcgcccttgctccgtgcaaccaggccggcatgggcgtggtcgggaaagtgggagagatccagtgttccagcgaagagtccgctcgcacaatcaagaaggacggctgcatttggaacgccgatctggtggggatcgaactgagagtcgacgatgcggtttgttacagcaaaattacctctgtggaggccgtggctaattatagcgccatccccacaacgattggaggcctccggttcgagagatcccatgactctcaagggaagatcagcggatcccctctggatatcaccgctattcgcggctcttttagcgtcaactaccggggccttagactgtccctctctgaaatcacagctacctgcacaggggaggtgaccaatgttagcggatgctactcctgtatgacgggcgccaaagtgagcattaagctgcactcttccaaaaacagcaccgcccatgtccgctgcaagggggacgaaacagcgttctctgtgctggagggagttcactcctataccgtgagcctttcctttgatcacgccgtcgtggacgaacagtgtcagctcaattgcggcgggcatgagtctcaggttacactgaagggaaacctgatcttcctcgacgtgcccaaatttgtcgatggcagctacatgcaaacctatcactccacggtgcctacaggcgctaatattcccagccctaccgactggctgaacgcccttttcgggaatggactgtctagatggatcctcggcgtgatcggggtcctgctgggaggccttgccctctttttcctgattatgtccctgtttaagctcgggacaaaacaggttttccggagccgcaccaagctggcttga

SEQ ID NO: 14929 - RNA, 3222 nt, synthetic construct
  misc_feature 1..3222: note = derived and/or modified CDS sequence (opt5) from SFTSV/Phlebovirus(JS6)__HQ830170.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagcttaagagcttctctcagtccgaatttcccgacatctgcaaaattgatggcatcgtgttcaatcagtgtgagggggaaagcctccctcaaccctttgacgtcgcctggatggatgtgggacactctcataagatcattatgcgcgagcacaaaacaaagtgggtgcaggagagctcctctaaggacttcgtctgctataaagaaggcaccgggccgtgtagcgagtccgaagagaagacatgcaaaaccagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacgcttgaagtgaacgagcctgaacagcgcatcggccaatgcaccgggtgtcagctggagtgcattaatggcggagtcagactcatcacactgaccagcgagctgaagtccgcgacagtgtgtgcctctcacttttgcagctccgctacctctggcaagaaaagcacggaaattcagttccattccgggagcctcgttggaaagacagccatccacgtgaaaggcgctctggtcgatgggaccgagttcacatttgaaggatcttgtatgttccccgacggctgcgatgccgtggactgcaccttttgtcgggagttccttaagaacccccaatgctatcctgcgaaaaagtggctgtttatcattatcgtcattctcctggggtacgccggccttatgctgctcaccaatgtgctgaaggctatcggagtttggggctcctgggtgattgccccggtcaaactggtgttcgctatcatcaagaaactcatgcgcgccgttagctgtctgatggggaagctgatggatagaggaagacaggtgattcacgaagagatcggcgagaaccgggaagggaatcaggacgatgtccgcattgagatggcccggcccagacgcgtgcggcattggatgtattctcctgtgatcctgacaattctcgctatgggactggcggaaggctgcgacgagatggttcacgccgattccaaacttgtcagctgtagacaggggtctggcaacatgaaggagtgcgtgacgaccggacgcgctctgctccccgccgtgaatcctggccaagaagcctgtctgcattttacagctcccgggagcccggactccaagtgcctgaaaatcaaggtcaaacggattaacctcaagtgtaaaaagtctagctcctacttcgtgcctgatgccagaagccgctgcacctccgttcggagatgtcgctgggcgggagactgccagtctggctgtccccctcactttacaagcaattccttctctgacgattgggctgggaagatggaccgggccggactgggctttagcgggtgctccgatggctgcggaggcgccgcttgtgggtgcttcaacgccgctccctcttgtatcttttggagaaaatgggtggagaatcctcatggaatcatttggaaggtcagcccctgcgccgcgtgggtgccgtccgccgttatcgaacttaccatgcctagcggcgaggtgcggacgttccaccccatgtctgggattcccacacaggtcttcaaaggagtgtccgttacctatctgggcagcgacatggaagtgtctggcctcaccgatctgtgtgagatcgaggaactgaagtccaaaaagctggctctcgccccttgcaaccaggctgggatgggagtcgtgggcaaagtgggggagattcaatgtagctctgaagagtccgcccgcacaatcaagaaggacggatgcatctggaacgcggatctggtcggcattgaactgagagttgacgatgccgtgtgttacagcaaaatcacctccgtggaggctgtcgccaattatagcgctattccgacaacgatcgggggactccggtttgagagatctcacgacagccagggcaagatttccggctctcccctggatatcaccgccatccgcgggagcttctccattaactaccggggacttagactgtctctcagcgaaatcacagctacctgcacaggcgaggtgaccaatgtttccgggtgctactcttgtatgacgggagccaaagtgagcattaagctgcattccagcaaaaactctaccgcgcacgtccgctgcaagggcgacgaaacagccttttccgtgctggagggggttcatagctattctgtgtcccttagcttcgatcacgctgtcgtggacgaacagtgtcagctcaattgcggaggccacgagtcccaagttaccctgagaggcaacctgatctttctcgacgtgcctaagttcgtcgatgggtcttacatgcagacatatcatagcaccgtgcccacgggagccaatattccttcccccacagactggctgaacgccctttttggcaatgggctgagccggtggatcctcggagtgatcggcgtcctgcttgggggacttgctctcttctttctgattatgtctctgttcaaactcggcaccaagcaggtttttcgctccagaacaaaactggcctga

SEQ ID NO: 14930 - RNA, 3222 nt, synthetic construct
  misc_feature 1..3222: note = derived and/or modified CDS sequence (opt5) from SFTSV/Phlebovirus(JSD1)__JF267784.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactctcactcccggtggagcggactcctgtctccttgcgatgcggactggcttggcatgctggtcgtgaaaaaggctaaaggctccgatatgattgttcccgggcctagctacaagggaaaggtgtttttcgagcgccccacctttgacggctatgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcattcccacaagatcattatgcgcgagcacaaaaccaagtgggtgcaggagtctagctccaaggactttgtctgctacaaagaaggaacaggcccgtgtagcgagtctgaagagaagacctgcaaaacatccgggagctgcagaggagacatgcagttctgtaaggttgctggctgcgaacatggcgaggaggcctctgaagctaaatgtcggtgctccctcgtgcacaagcctggggaggtggtcgtgagctatggaggcatgcgcgttagacccaaatgttacgggttttcccggatgatggccaccctggaagtgaaccagcctgagcaacgcatcggacagtgcacgggctgtcatcttgaatgcattaatgggggcgtcagactgatcaccctcacatctgagctcaagagcgcgaccgtgtgtgcctcccacttctgctctagcgctacatccggaaagaaaagcaccgagattcagttccactctggctccctggttgggaagacggccatccatgtgaaaggagctctggtcgatggcacagaatttaccttcgaggggagctgtatgtttcccgacggatgcaacgccgtggattgcacattctgtcgggaatttctgaagaatccccaatgctaccctgcgaaaaagtggcttttcatcattatcgtcattctgctcggctatgccgggctgatgcttctgaccaacgtgctcaaggctatcggcatttggggatcttgggttatcgccccggtgaaactgatgtttgctatcattaagaaactgatgcgcaccgtctcctgtctcatgggcaagctgatggacagagggagacaggtgatccacgaggaaattggagagaatcgggagggcaaccaggatgacgttcgcatcgaaatggcccggcccagacgcgtgcggcattggatgtacagccctgtcattcttacattcctggccatcgggctcgctgagtcttgcgatgaaatggtgcacgcggacagcaaactggtgtcctgtagacagggaagcggcaatatgaaggagtgcgttacgaccgggcgcgcccttctgcccgctgtcaaccctggccaagaggcctgtctccattttacagcccccggatctccggattccaagtgcctgaaaattaaggtgaaacggatcaatctgaagtgtaaaaagagctcctcttatttcgtgcctgacgctagaagccgctgcacctccgtccggagatgtcgctgggccggcgattgccagtctgggtgtccccctcactttacaagcaactccttctctgacgactgggcgggaaagatggatcgggctggcctcgggtttagcggatgctccgacggctgcgggggcgccgcctgtggatgcttcaatgctgcccccagctgtatcttctggagaaaatgggtggaaaaccctcacggcattatctggaaggtttctccctgcgctgcctgggtgccgtccgcggtcattgagctgaccatgcctagcggggaagtgcggacgtttcatcccatgtctggaatccccacacaggttttcaaaggcgtgtccgtcacctaccttgggagcgatatggaggtgtctggactgaccgacctctgtgaaattgaggagctgaagtccaaaaagctggcccttgctccttgcaaccaggccggcatgggcgttgtggggaaagtcggagaaatccaatgtagctccgaggaaagcgctcgcacaatcaagaaggatggctgcatttggaatgccgacctcgtggggatcgagctgagagtggatgacgcggtctgttattctaaaattaccagcgttgaagccgtggctaactactccgccatcccgacaacgattggaggcctgcggtttgagagatctcacgatagccaggggaagatctccggatctcccctcgacatcaccgctattcgcggcagcttctccgtgaattatcggggcctgagactttctctgagcgagatcacagctacctgcacaggggaagtcaccaacgtgtccggatgctacagctgtatgacgggcgccaaagtttctattaagctccattccagcaaaaattctaccgcccacgtgcgctgcaagggggatgagacagcgttttccgtcctggaaggagtgcacagctacaccgtttccctgtctttcgaccatgccgtggtcgatgagcagtgtcagcttaactgcggcgggcacgaaagccaagtgacactcaagggaaatctgatctttctggacgttcctaaattcgtggacggctcctatatgcagacctaccatagcacggtccccacaggcgctaacattccttctcccaccgattggctcaatgccctgtttgggaacggactttccagatggatcctgggcgtgatcggggtgctcctgggaggcctggcccttttctttatgattatgagcctcttcaagctggggacaaaacaggtctttcggtctcgcaccaagctggcttga

SEQ ID NO: 14931 - RNA, 3222 nt, synthetic construct
  misc_feature 1..3222: note = derived and/or modified CDS sequence (opt5) from SFTSV/Phlebovirus(LN2/China/2010 strain LN2)__HQ141608.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgaatttcccgacatctgccgcattgatggaatcgtgtttaatcagtgtgagggcgaaagcctgcctcaacccttcgacgtcgcctggatggatgtggggcactcccataaaatcattatgagagagcacaagaccaaatgggtgcaggagtctagctccaaggactttgtctgctataaggaaggaacaggcccgtgtagcgagtctgaagagaaaacctgcaagacatccgggagctgccggggagacatgcagttctgtaaagttgctggctgcgaacacggcgaggaggcctctgaagctaagtgtcgctgctccctcgtgcataaacctggggaggtggtcgtgagctacggaggcatgagagttcggcccaagtgttacgggttttcccgcatgatggccaccctggaagtgaaccagcctgtccaaagaatcggacagtgcacgggctgtcaccttgagtgcattaatgggggcgtgcggctgatcaccctcacatctgaactgaaaagcgcgaccgtttgtgcctcccatttctgctctagcgctacatccggaaagaagtccaccgagattcagttccactctggctccctggtggggaaaacggccatccacgtcaagggagctctcgtggatggcacagagtttaccttcgaagggagctgtatgtttcccgacggatgcgatgccgtcgactgcacattctgtcgcgagtttctgaaaaacccccaatgctatcctgcgaagaaatggcttttcatcattatcgtgattctgctcggctacgccgggctgatgcttctgaccaatgttctcaaggctatcggcatttggggatcttgggtgatcgccccggtcaagctgatctttgctattatcaaaaagctgatgagaaccgtgtcctgtctcatgggcaaactgatggatcgggggagacaggttattcatgaagagatcggagaaaaccgcgagggcaatcaggacgatgtgcggattgagatggccagaccccgccgggtcagacactggatgtatgcccctgtgatccttacaattctggctatggggctcgcggaaagctgcgacgagatggtgcatgccgattctaagctggttagctgtcgccagggatccggcaacatgaaagaatgcgtcacgaccgggcgggcccttctgcccgccgtgaatcctggccaagaggcctgtctccacttcacagctcccggaagcccggactctaagtgcctgaagatcaaagtgaagagaatcaacctgaaatgtaagaaatccagctcctactttgtccctgatgcccgctctcggtgcaccagcgtgagacgctgtcggtgggcgggcgactgccagtccgggtgtccccctcatttcacatctaatagcttttccgacgattgggctggaaagatggacagagccggcctcgggttctctggatgcagcgatggctgcgggggcgccgcttgtggatgctttaacgccgctccctcctgtattttctggcggaagtgggttgagaatcctcacggcatcatttggaaagtgagcccctgcgccgcgtgggtcccgtctgccgtgatcgaactgaccatgccttccggggaggttcgcacgttccaccccatgagcggcattcccacacaggtgtttaagggagtctctgtgacctatcttgggtccgacatggaagttagcggactgaccgatctctgtgagatcgaggaactgaaatctaagaaactggctcttgccccttgcaaccaggctggcatgggcgtggtcgggaaggtgggagagatccaatgttccagcgaagagtccgccagaacaattaaaaaggacggctgcatctggaacgcggatctcgtggggattgaactgcgggtcgacgatgccgtttgttacagcaagatcacctctgtggaggctgtggccaattatagcgctattccgacaacgatcggaggcctgagattcgaacgctcccatgactctcaggggaaaatcagcggaagccccctcgatattaccgccatccggggctcttttagcgtcaactacagaggcctgcgcctttccctgtctgagattacagctacctgcacaggggaggtgaccaatgttagcggatgctactcctgtatgacgggcgctaaggtgagcatcaaactccactcttccaagaacagcaccgcgcatgtcagatgcaaaggggacgaaacagccttctctgtgctggagggagttcactcctataccgtgagcctgtcctttgatcacgctgtcgtggacgaacagtgtcagcttaattgcggcgggcatgagtctcaagttacactcaagggaaacctgattttcctggacgtgcctaagtttgtcgatggcagctacatgcagacctatcactccacggtgcccacaggcgccaatatccctagccccaccgactggctcaacgccctgttcgggaatggactttctcggtggatcctgggcgtgattggggtcctcctgggaggcctggctcttttcttcatgatcatgtccctctttaaactggggacaaagcaggttttccgcagcagaaccaaactggcctga

SEQ ID NO: 14932 - RNA, 3222 nt, synthetic construct
  misc_feature 1..3222: note = derived and/or modified CDS sequence (opt5) from SFTSV/Phlebovirus(LN3/China/2010 strain LN3)__HQ141611.1__GP
  source 1..3222: mol_type = other RNA
atgatgaaggtgatctggttcagctccctgatttgcctcgtcatccagtgtggcggggacaccggacccattatctgcgccggccctattcactctaacaaaagcgctgatatcccgcatctgcttgggtactccgagaagatctgtcaaattgacagactgatccacgtttctagctggctccggaatcattcccagtttcagggatatgtgggccagcgcgggggaagatctcaagtgagctactatcccgccgaaaactcctacagccggtggtctggcctgctttccccttgcgatgcggactggctgggcatgctcgtcgtgaaaaaggctaaagggagcgatatgattgttcccggaccttcttataagggcaaggtgttctttgagcgccccacattcgacgggtacgtcggatggggctgtgggtccggaaaaagcagaacggaatctggcgagctgtgctccagcgattccggcacctctagcgggctgctcccttccgaccgggtgctgtggatcggagatgttgcctgtcagccgatgacacccattcctgaagagacctttcttgagctgaagtctttctctcagtccgaatttcccgacatctgcaaaattgatggcatcgtgttcaatcagtgtgagggggaaagcctccctcaaccctttgacgtcgcctggatggatgtgggacactctcataagatcattatgcgcgagcacaaaacaaagtgggtgcaggagagctcctctaaggacttcgtctgctataaagaaggcaccgggccgtgtagcgagtccgaagagaagacatgcaaaaccagcggatcttgcagaggcgacatgcagttttgtaaggttgctggctgcgaacacggggaggaggcctccgaagctaaatgtcggtgcagcctggtgcataagcctggagaggtggtcgtgtcttacggcgggatgcgcgttagacccaaatgttacggattctcccggatgatggccacgcttgaagtgaaccagcctgagcaacgcatcggccagtgcaccgggtgtcacctggaatgcattaatggcggagtcagactcatcacactgaccagcgagctgaagtccgcgacagtgtgtgcctctcatttttgcagctccgctacctctggcaagaaaagcacggagattcagttccactccgggagcctcgttggaaagacagccatccacgtgaaaggcgctctggtcgatgggaccgagttcacatttgaaggatcttgtatgttccccgacggctgcgatgccgtggactgcaccttttgtcgggagttccttaagaacccccaatgctatcctgcgaaaaagtggctgtttatcattatcgtcattctcctggggtacgccggccttatgctgctcaccaatgtgctgaaggctatcggagtttggggctcctgggtgattgccccggtcaaactggtgttcgctatcatcaagaaactcatgcgcgccgttagctgtctgatggggaagctgatggatagaggaagacaggtgattcatgaagaaatcggcgagaaccgggaggggaatcaggacgatgtccgcattgaaatggcccggcccagacgcgtgcggcactggatgtattctcctgtgatcctgacaattctcgctatcggactggcggagggctgcgacgaaatggttcatgccgattccagacttgtcagctgtcgccaggggtctggcaacatgaaagagtgcgtgacgaccggacgggctctgctccccgccgtgaatcctggccaagaggcctgtctgcactttacagctcccgggagcccggactccaagtgcctgaagattaaagtcaagagaatcaacctcaaatgtaagaaaagcagctcctacttcgtgcctgatgcccgcagccggtgcacctccgttagacgctgtcggtgggcgggagactgccagtctggctgtccccctcattttacaagcaattccttctctgacgattgggctgggaagatggacagagccggactgggctttagcgggtgctccgatggctgcggaggcgccgcttgtgggtgcttcaacgccgctccctcttgtatcttttggcggaagtgggtggaaaatcctcacggaattatctggaaagtcagcccctgcgccgcgtgggtgccgtccgccgttattgagcttaccatgcctagcggcgaagtgcgcacgttccaccccatgtctgggatccccacacaggtcttcaagggagtgtccgttacctatctgggcagcgacatggaggtgtctggcctcaccgatctgtgtgaaattgaggagctgaaatccaagaaacttgctctcgccccttgcaaccaggctgggatgggagtcgtgggcaaggtgggggaaatccaatgtagctctgaggaatccgccagaacaatcaaaaaggacggatgcatttggaacgcggatctggtcggcatcgagctgcgggttgacgatgccgtgtgttacagcaagattacctccgtggaagctgtcgccaattatagcgctatcccgacaacgattgggggactcagatttgagcgctctcatgacagccagggcaaaatctccggctctcccctggatatcaccgccattcgggggagcttctccgtgaactacagaggacttcgcctgtctctcagcgagatcacagctacctgcacaggcgaagttaccaatgtgtccgggtgctactcttgtatgacgggagccaaggtcagcattaaactgcactccagcaagaactctaccgcgcatgtgagatgcaaaggcgacgagacagccttttccgttctggaaggggtgcacagctattctgtctcccttagcttcgatcacgctgtggttgacgagcagtgtcagctcaattgcggaggccatgaatcccacgtgaccctgcggggcaacctgatctttctcgacgtccctaagttcgtggatgggtcttacatgcaaacatatcatagcaccgtgcccacgggagccaatattccttcccccacagactggctgaacgccctttttggcaatgggctgagccgctggatcctcggagtcatcggcgttctgcttgggggacttgctctcttctttctgattatgtctctgttcaagctcggcaccaaacaggtgtttagatcccggacaaagctggcctga

SEQ ID NO: 14933 - RNA, 3222 nt, synthetic construct
  misc_feature 1..3222: note = derived and/or modified CDS sequence (opt5) from SFTSV/Phlebovirus(SD24/China/2010 strain SD24)__HM802201.1__GP
  source 1..3222: mol_type = other RNA
atgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatatcgcctggatggacgtcgggcactcccataagattatcatgcgcgagcacaaaaccaagtgggtgcaggaatctagctccaaggatttcgtgtgctataaagagggaacaggcccgtgtagcgaatctgaggaaaaggcttgcaaaacctccgggagctgcagaggagacatgcagttttgtaaggtcgccggctgcgagcacggcgaggaagctagcgaggccaaatgtcggtgctccctggttcataagcctggggaagtggtggtcagctacggaggcatgcgcgtgagacccaaatgttacgggttctcccggatgatggcgacacttgaggttaaccctcccgaacagcgcattggacaatgcaccggctgtcacctggagtgcatcaatgggggcgtgagactcattacgctgacctctgagctgcggagcgccacagtctgtgcttcccatttttgctctagcgccacctccggaaagaagtctacagaaatccacttccactctggctccctcgtggggaaaaccgctatccatgttaagggagccctggtggacggcacggagttcacatttgaagggagctgtatgttccccgatggatgcgacgcggtcgattgcaccttttgtcgcgagttccttaaaaaccctcagtgctatccggccaagaaatggctgtttattatcattgtgatcctcctgggctacgctgggcttatgctgctcacaaatgtcctgaaggccattggcgtgtggggatcttgggttatcgctcccgtgaagctgatgttcgccatcattaaaaagctcatgagaaccgtctcctgtctggtgggcaaacttatggaccgggggagacaggttatccacgaagagattggagagaacggcgaagggaatcaagatgacgtgcgcatcgagatggcccggcctagacgcgtccggcattggatgtatagccccgtgattctgaccatcctcgctattggactggcggaaggctgcgatgagatggtgcacgccgactctaagctggttagctgtagacaggggtccggcaacatgaaagagtgcatcacaacgggacgcgctctgctccctgccgtcaatcccggccaggaagcctgtctgcattttaccgctccggggagccctgattctaagtgcctgaagatcaaagtgaagcggattaacctcaaatgtaagaaatccagctcctacttcgtgcccgacgccagatctcgctgcacaagcgtccggagatgtcgctgggcgggagattgccagtccggctgccctccccactttacctctaatagcttctccgacgactgggctgggaagatggatcgggccggactgggcttttctgggtgtagcgacggctgcggaggcgccgcttgtgggtgcttcaacgccgctccttcctgtatcttttggagaaagtgggtggagaatccccacggaattatctggaaagttagcccgtgcgccgcgtgggtgccttctgccgtcattgaacttacaatgccctccggcgaggtgcggaccttccatcccatgagcgggatccctacgcaagttttcaagggagtgtctgtcacatatctgggctccgatatggaagtgagcggcctcaccgacctgtgtgagatcgaggaactgaaatctaagaaacttgctctcgccccgtgcaaccaggctgggatgggagttgtgggcaaggtcggggagattcagtgttccagcgaagagtccgcccgcaccatcaaaaaggatggatgcatttggaacgcggacctggtgggcatcgaactgagagtggatgacgccgtctgttacagcaagattacatctgttgaggctgtggccaattatagcgctatccccaccacaatcgggggactccggtttgagagatcccacgattctcagggcaaaattagcggctcccctctggacatcacggccattcgcgggtctttcagcgtgaactaccggggacttagactgtccctctctgaaatcaccgccacatgcaccggcgaggtcacaaatgtgagcgggtgctactcctgtatgaccggagctaaggttagcattaaactgcattcttccaagaacagcacggcgcacgtgcgctgcaaaggcgatgaaaccgccttttctgtcctggagggggtgcactcctatatcgttagcctttccttcgaccatgctgtggtcgatgaacaatgtcagctcaattgcggaggccacgagtctcaggtgacactgaagggcaacctgatctttctcgacgttcccaagttcgtggacgggagctacatgcagacctatcattccacagtccctaccggagccaatattcccagccctacggattggctgaacgccctttttggcaatgggctgtctagatggatcctcggagtgattggcgtgctgcttgggggacttgctctcttctttctgatcatgttcctgctcaaactgggcacaaagcaagtctttcggtcccgcaccaaacttgcctga

SEQ ID NO: 14934 - RNA, 3222 nt, synthetic construct
  misc_feature 1..3222: note = derived and/or modified CDS sequence (opt5) from SFTSV/Phlebovirus(SD4/China/2010 strain SD4)__HM802203.1__GP
  source 1..3222: mol_type = other RNA
atgatgaaggtgatctggttcagctccctgatttgctttgtcatccagtgttctggcgacagcgggcccattatctgcgccggacctattcactccaacaaatctgctgatatcccgcatctcctgggctacagcgagaagatctgtcaaattgacagacttatccacgtttcctcttggctgcggaatcatagccagttccaggggtatgtgggacagcgcggcgggagatcccaagtgagctactatcccgccgaaaactcttactcccggtggagcggactcctgtctccttgcgatgcggactggcttggcatgctggtcgtgaaaaaggctaaaggctccgatatgattgttcccgggcctagctataagggaaaggtgtttttcgagcgccccacctttgacggctacgtcgggtggggatgtggctctgggaaatccagaacagaaagcggagagctctgctcctctgatagcggcacgtccagcggcctgctgccttctgaccgggtgctctggatcggggatgttgcctgtcagccgatgacccccattcctgaagagacattcctggagcttaagtcctttagccagtctgagttccccgacatctgcaaaattgatggaatcgtgtttaatcagtgtgaaggcgaaagcctgcctcaacccttcgacgtcgcctggatggatgtggggcactcccataagatcattatgcgcgagcacaaaaccaagtgggtgcaggagtctagctccaaggactttgtctgctataaagaaggaacaggcccgtgtagcgagtctgaagagaagacctgcaaaacatccgggagctgcagaggagacatgcagttctgtaaggttgctggctgcgaacacggcgaggaggcctctgaagctaaatgtcggtgctccctcgtgcataagcctggggaggtggtcgtgagctacggaggcatgcgcgttagacccaaatgttacgggttttcccggatgatggccaccctggaagtgaaccctcccgagcagcgcatcggacaatgcacgggctgtcaccttgaatgcattaatgggggcgtcagactgatcaccctcacatctgagcttaagagcgcgaccgtgtgtgcctcccatttctgctctagcgctacatccggaaagaaaagcaccgagattcagttccactctggctccctggttgggaagacggccatccacgtgaaaggagctctcgtcgatggcacagaatttaccttcgaggggagctgtatgtttcccgacggatgcgatgccgtggactgcacattctgtcgggaatttctgaagaaccctcagtgctatccggcgaaaaagtggcttttcatcattatcgtcattctgctcggctacgccgggctgatgcttctgaccaatgtgctcaaggctatcggcgtttggggatcttgggtgattgcccccgtcaaactgctgtttgctatcatcaagaaactcatgcgcaccgtgtcctgtctgatgggcaagctgatggatagagggcggcaagttattcatgaggaaatcggagagaacagagagggcaatcaggacgatgtgcgcattgaaatggcccggcctagacgcgtccggcactggatgtatagccccgtgatcctgacaattctcgccacggggctggctgagggatgcgacgaaatggtgcatgcggattctaaacttgttagctgtagacagggctccgggaacatgaaggagtgcgtcaccacaggccgcgccctgctccctgctgtgaatcccggacaggaggcctgtctgcacttcaccgccccgggcagccctgactctaagtgcctgaaaatcaaggtgaaacggattaacctcaagtgtaaaaagtccagctcctactttgtccccgatgctagatctcgctgcacaagcgtgcggagatgtcgctgggccggggactgccaatccggatgccctccccatttcacctctaatagcttttccgacgattgggcgggcaagatggaccgggctgggctgggattctctggctgtagcgatgggtgcggcggagccgcctgtggctgctttaacgctgccccttcctgtatcttctggagaaaatgggttgaaaatccccacgggatcatttggaaggtgagcccgtgcgctacgtgggtcccttctgccgtgatcgagcttacaatgccctccggagaagttcggaccttccaccccatgagcggcattcctacccaggtgtttaaaggggtctctgtgacatatctgggatccgacatggaggttagcggcctcaccgatctgtgtgaaatcgaggagctgaagtctaaaaagctcgcgcttgccccgtgcaaccaggctggcatgggggtgattggaaaagtcggcgaaatccagtgttccagcgaggaatccgcccgcacaatcaagaaggacgggtgcatttggaacgctgatctggtgggaatcgagctgagagtggacgatgccgtctgttacagcaaaattacgtctgttgaagcggtggccaattatagcgctatccccaccacaattggcgggctccggttcgagagatcccatgactctcaaggaaagatcagcggctcccctctggatatcaccgccattcgcggctcttttagcgtgaactaccgggggcttagactgtccctctctgagatcacagctacctgcacgggagaagtcaccaatgtgagcggctgctactcctgtatgacaggggccaaagttagcattaagctgcactcttccaaaaacagcaccgcccatgtgcgctgcaagggagacgagacagctttctctgtcctggaaggcgtgcactcctataccgttagcctttcctttgatcacgcggtggtcgacgagcagtgtcagctcaattgcgggggacatgaatctcaggtgacgctgaagggcaacctgatcttcctcgacgttcccaaatttgtggatggcagctacatgcaaacatatcactccaccgtccctacaggggccaatattcccagccctaccgactggctgaacgctcttttcggaaatggcctgtctagatggatcctcggggtgatcggagtgctgctgggcgggcttgccctctttttcctgattatgtccctgtttaagctcggaaccaaacaggtcttccggagccgcacaaagctggcctga

SEQ ID NO: 14935 - RNA, 3222 nt, synthetic construct
  misc_feature 1..3222: note = derived and/or modified CDS sequence (opt5) from SFTSV/Phlebovirus(SDYY104/China/2011)__KU239112.1__GP
  source 1..3222: mol_type = other RNA
atgatgaaggtgatctggttcagctccctgatttgcctcgtcatccagtgttctggcgacagcgggcccattatctgcgccggacctattcactccaacaagtctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaacttaattccttcagccagtctgagtttcccgatatctgcaagattgacggaatcgtgttcaaccagtgtgaaggcgagagcctccctcaaccctttgatgtcgcctggatggacgtggggcactcccataaaatcattatgcgcgagcacaagaccaaatgggtgcaggaatctagctccaaggatttcgtctgctataaggagggaacaggcccgtgtagcgaatctgaggaaaaggcttgcaagacctccgggagctgcagaggagacatgcagttttgtaaagttgccggctgcgagcacggcgaggaggcttctgaagccaagtgtcggtgctccctggtgcataaacctggggaagtggtcgtgagctacggaggcatgcgcgttagacccaagtgttacgggttctcccggatgatggcgacacttgaggtgaatcctcccgaacagcgcatcggacaatgcaccggctgtcacctggagtgcattaacgggggcgtcagactcatcacgctgacctctgagctgcggagcgccacagtgtgtgcttcccatttttgctctagcgccacctccgggaaaaagagcacagaaattcacttccactctggctccctcgttgggaagaccgctatccatgtgaaaggagccctggtcgacggcacggagttcacatttgaagggagctgtatgttccccgatggatgcgacgcggtggattgcaccttttgtcgcgagttccttaagaatcctcagtgctatccggccaaaaagtggctgtttatcattatcgtcattctcctgggctacgctgggcttatgctgctcacaaacgtgctgaaagccatcggcgtttggggatcttgggtgattgctcccgtcaagctgatgttcgccatcatcaagaaactcatgagaaccgtgtcctgtctggttggcaaacttatggaccgggggagacaggtgattcacgaagagatcggagagaatggcgaagggaaccaagatgacgtccgcattgagatggcccggcctagacgcgtgcggcattggatgtatagccccgtgatcctgaccattctcgctatcggactggcggaaggctgcgatgagatggttcacgccgactctaaacttgtcagctgtagacaggggtccggcaatatgaaggagtgcattacaacgggacgcgctctgctccctgccgtgaaccccggccaggaagcctgtctgcattttaccgctccggggagccctgattctaaatgcctgaagatcaaggtgaaacggatcaatctcaagtgtaaaaagtccagctcctacttcgtccccgacgccagatctcgctgcacaagcgtgcggagatgtcgctgggcgggagattgccagtccggctgccctccccactttacctctaacagcttctccgacgactgggctgggaaaatggatcgggccggactgggcttttctgggtgtagcgacggctgcggaggcgccgcttgtgggtgcttcaatgccgctccttcctgtatcttttggagaaagtgggttgagaacccccacggaattatttggaaggtgagcccgtgcgccgcgtgggtcccttctgccgtgatcgaacttacaatgccctccggcgaggttcggaccttccatcccatgagcgggattcctacgcaagtgttcaaaggagtctctgtgacatatctgggctccgatatggaagttagcggcctcaccgacctgtgtgagatcgaggaactgaagtctaaaaagctggctctcgccccgtgcaaccaggctgggatgggagtggtcggcaaagtgggggagatccagtgttccagcgaagagtccgcccgcaccattaagaaagatggatgcatctggaatgcggacctggtgggcattgaactgagagtcgatgacgccgtttgttacagcaagatcacatctgtggaggctgtggccaactatagcgctattcccaccacaatcgggggactccggtttgagagatcccacgattctcagggcaagatcagcggctcccctctggacattacggccatccgcgggtctttcagcgtcaattaccggggacttagactgtccctctctgaaattaccgccacatgcaccggcgaggtgacaaacgttagcgggtgctactcctgtatgaccggagctaaagtgagcatcaagctgcattcttccaaaaatagcacggcgcacgtccgctgcaagggcgatgaaaccgccttttctgtgctggagggggttcactcctatattgtgagcctttccttcgaccatgctgtcgtggatgaacaatgtcagctcaactgcggaggccacgagtctcaggttacactgaaaggcaatctgatctttctcgacgtgcccaagttcgtcgacgggagctacatgcagacctatcattccacagtgcctaccggagccaacatccccagccctacggattggctgaatgccctttttggcaacgggctgtctagatggattctcggagtgatcggcgtcctgctgggaggacttgctctcttctttctgattgttttcctgctcaagctgggcacaaaacaagcctttcggtcccgcaccaaacttgcgtga

SEQ ID NO: 14936 - RNA, 3417 nt, synthetic construct
  misc_feature 1..3417: note = derived and/or modified CDS sequence (opt11) from ANDV(Chile-9717869)__AF291703.2__GP
  source 1..3417: mol_type = other RNA
atggaggggtggtacttagtcgtattgggagtctgctacacactgacacttgccatgccaaaaacaatttacgaactcaagatggaatgtccccacaccgtcggcctaggccaaggctacattatcggttctactgaactgggactaatttccatagaagcggcatctgacatcaaactcgagagcagctgcaacttcgaccttcacacaacttccatggcccagaaatctttcacgcaggtcgaatggcgcaagaaatcagacacaacggacaccacaaacgcggcctcaaccacctttgaagcccaaaccaaaaccgtaaacctacgaggaacctgtatcctcgcacccgagctttacgacaccctcaagaaagtcaaaaagaccgtactctgctacgacctaacctgcaatcagacacactgccaaccaaccgtatatctaatcgctcccgtattaacatgcatgtccatccgaagctgcatggcatcagtcttcaccagcagaatacaagtaatctatgaaaagacccactgtgtcacaggccaattaatcgaaggccagtgcttcaatccagcccacaccctcaccctatcacaacccgcccacacctacgatacagtcacacttcccatatcctgcttcttcacacccaagaaatccgagcaactcaaagtgatcaaaacctttgagggcattctgaccaaaaccggctgtaccgagaacgcgctccaaggctattacgtgtgttttctaggcagtcactccgaaccactgatcgtaccatccctcgaagacatccggtcggccgaagtagtctcccgcatgctcgttcacccacgaggcgaagaccacgacgctatccaaaactcacaatcccatctgcgcatcgtcggaccaataaccgcgaaggtcccgtcaacgtcgtccaccgacacactcaaaggcaccgcctttgccggcgtacccatgtactcctccctatccacgctcgtccgaaatgccgaccccgagttcgtattctcaccaggcatagtaccggaaagcaaccactccacgtgcgacaagaaaacggtccccatcacttggaccggctacctgccaatctcaggggaaatggaaaaagtcaccggttgcactgttttctgcactctagcaggcccaggcgcaagctgcgaagcctactcagaaaacggcatattcaacattagcagcccaacatgtctcgtaaacaaagtacaacgctttcgaggctccgaacagaaaataaacttcatatgccaaagggtcgaccaagacgtcgtagtctactgcaacggccaaaagaaagtaatcctcaccaaaacactcgtcatcggacagtgcatctacacatttacctcactattcagcctcatgccagatgtcgcgcactcccttgcagtggagctctgcgtaccagggctacacggctgggccaccgtaatgcttctatccacattttgcttcgggtgggtcctaattcccgccgtcaccctgatcatactaaaatgcctccgagtcctcactttctcgtgctcacactacacaaacgaatccaaattcaaattcatactcgaaaaagtaaaaatagaataccagaaaacgatgggatcaatggtatgcgacgtatgtcaccacgagtgtgagaccgccaaagaacttgaatcgcaccgccaatcctgcatcaacggacaatgcccatactgcatgaccataacagaagcaaccgaaagcgccctccaagcccactactcaatctgcaaactgaccggaaggttccaggaagcccttaagaaatccctaaagaaacccgaggtaaagaaaggctgctaccgcacgctcggagtcttccgatacaaatctcgctgttacgtaggcctagtctggtgcctactcctaacctgcgaaatagtcatctgggcggcctcggccgaaaccccgctcatggaatccggctggtccgacaccgcccacggagtcggagaaataccaatgaaaacagacctcgaactcgacttctctctaccctcctcctcaagctacagctaccgccgcaaacttaccaaccccgccaataaagaagaaagtatcccatttcacttccaaatggagaaacaagtaattcacgccgaaatccagcctctcggccactggatggacgcaaccttcaacatcaaaacagcgttccactgctacggcgcctgccaaaaatacagctacccctggcagacctccaaatgtttcttcgagaaagactaccaatacgaaacagggtggggctgtaaccccggcgactgcccaggagtcggtacaggctgtactgcctgtggcgtctacctcgacaaactaaaatctgtaggcaaagcatacaaaatcatcagcctgaaatacacacgcaaagtatgtatccaactaggaacagaacaaacgtgcaaacacattgatgccaacgactgccttgtgacaccctccgtcaaagtatgcatcgttggaaccgtatccaaactccaaccctccgacaccctcctatttcttggtcccctagaacaagggggcatcatccttaaacaatggtgcaccacctcctgcgcattcggagacccaggcgacataatgtcaaccccaagcggaatgcgatgtccagagcacacaggctcctttcgcaaaatatgcggcttcgcaaccacaccggtctgcgaataccaaggcaacacaatctccggctacaaaagaatgatggccacgaaagactccttccaatcgttcaacctcaccgaaccccatatcacaaccaacaaactcgagtggattgaccccgacggcaacacccgcgaccacgtcaacctcgtcctcaaccgtgacgtatcgttccaagacctcagcgacaacccctgcaaagtcgacctacacacacaggcgatcgaaggcgcttggggtagcggcgtcggcttcacactaacctgcaccgttggactcaccgaatgcccttccttcatgacttccatcaaggcatgcgacctcgccatgtgctacggctccaccgtcacaaacctggccagaggatccaacaccgtaaaagttgtaggaaaaggcggccactcaggaagcagctttaaatgctgccacgacaccgattgctcctctgaaggcctacttgcctccgcgccacacctagaacgcgtaaccgggttcaaccagatagacagcgacaaggtgtacgacgacggcgcgcctccatgcactttcaaatgctggttcacaaaatcaggagaatggctcttaggcatactcaacggcaattggatagtagtcgtcgtcctagtagtaatactgatcttatctatcatcatgttctcagttctttgccccagacgggggcacaagaagacagtctaa

SEQ ID NO: 14937 - RNA, 3417 nt, synthetic construct
  misc_feature 1..3417: note = derived and/or modified CDS sequence (opt11) from ANDV(AH-1)__AF324901.2__GP
  source 1..3417: mol_type = other RNA
atggaaggatggtatctcgtcgccctaggcgtttgctacaccctgaccctcgcaatgcctaaaaccatatatgaacttaaaatggaatgcccacacacagtcggactaggccaaggttacataatcggctcaaccgaactcggattaatctcaatagaggcagcatcagatatcaaacttgagagctcctgcaacttcgacctccacacgacctccatggcccagaaatctttcacccaagtcgaatggcgcaagaaatccgacaccaccgacactaccaacgcagcatccaccacttttgaagctcaaacaaaaacggtaaacctccgcggcacgtgcattctcgcccccgaactttatgacactcttaagaaagtgaagaaaacagtcttatgctacgacctgacatgcaatcaaactcactgccaaccaaccgtctaccttatcgctcccgtccttacatgcatgtctattcggtcgtgcatggcctcagtctttacctctcgaatacaagtaatatacgagaaaacccactgcgtaacgggacaacttatagaaggccagtgcttcaatccagcccacacgctcacactctcacaacccgcccacacctacgacaccgtaaccctcccaatatcctgctttttcaccccaaagaaatcagaacaactaaaagtcataaaaacgttcgaaggaatcttaaccaaaactggttgcaccgagaacgcactgcaaggctactacgtctgtttcctcggttctcactcggagccactcatagtcccctcacttgaagacatacgctcagctgaagtcgtcagccgcatgctcgtccacccaatcggtgaagaccacgacgccatccaaaattctcaatcctatctacgtattgttggaccaattacagcgaaagtccccagcacatcctcgaccgatacactcaagggaatagcattcgcaggcgtcccaatgtactcctccttctcaacgctagtccgcaacgccgaccccgagttcgttttctcccccggcatcatccccgaaagcaaccactccgtctgcgacaagaaaaccgtccctatcacttggactggctaccttccaatttcaggcgaaatggaaaaagtcacaggttgcacagtattctgcacactggccggcccaggagccagctgcgaggcatactcagaaaacggtatattcaacatctccagcccaacctgcctagtcaataaagtccaacgtttccggggctcagagcagaaaataaacttcatatgccaacgggtcgatcaagacgttgtcgtgtactgcaatggtcagaagaaagtaatcctaaccaaaaccttggtaatcggacaatgcatctacaccttcacctcactattctccctgatgcccgacgtcgcacactccctggccgtagagctatgcgtaccaggcctgcacggctgggccacagtaatgctactctcaacattctgcttcggatgggtgctaattccagcggtcaccctaattatacttaaatgccttcgagtgctgacgttcagttgctcacactacacgaacgagtcaaaattcaaattcatcctagaaaaagtcaaagtcgagtaccagaaaaccatgggcagcatggtatgcgatgtctgccaccacgagtgcgaaacagccaaagaactggaatctcaccgacaaagctgcataaacggccaatgcccttactgcatgaccataacagaagcaaccgaaagcgccctccaagcccactactcaatctgcaaactgaccggccgattccaagaagcgctcaaaaagagcctaaagaaacccgaagtcaagaaaggctgctaccgaacacttggcgtcttccgctataaatcgcgctgctacgttggactcgtttggtgccttctacttacatgtgaaatagtaatatgggccgcatccgccgaaaccccgctcatggaatcaggttggtccgacaccgcgcacggagtcggagaaatccccatgaagaccgacctcgagctcgacttctcactccccagctcctcctcatactcttacagacgaaagctaaccaaccctgctaacaaagaggaatcaattcccttccacttccaaatggaaaaacaagttatacacgccgaaatccaaccacttggacactggatggatgcaaccttcaacatcaaaacggccttccactgctacggagcgtgccaaaaatattcgtacccctggcaaacctcaaaatgcttctttgaaaaagactaccaatacgagaccggctggggctgcaaccccggagattgcccgggcgtgggaacgggctgcaccgcctgcggtgtctaccttgacaagctaaaatccgtcggaaaagcctacaaaatcatatccctcaagtacacccggaaagtatgcatccaacttggtaccgaacaaacatgcaaacatattgatgccaatgattgcctcgtcacaccctcagttaaagtctgcatagtaggcacagtatcaaaactacaacccagcgacactctcctgttcctcggacccctggagcaaggcggcataatccttaaacaatggtgcacaacttcttgcgccttcggcgaccctggagacatcatgtcaaccccctccggaatgcggtgccctgagcataccggcagctttcgcaaaatctgtggattcgcaaccacgcccgtttgtgagtaccagggaaacacagtatctgggtacaaacgcatgatggcaacaaaagactctttccaatcattcaacctcaccgaaccccatatcacaaccaacaaactcgaatggatcgaccccgacggaaacacccgagaccacgtcaacctcgtactcaaccgcgatgtctcgtttcaagatctatccgacaacccatgcaaagtggacctccacacacaagccatagagggcgcatggggatcaggagtcggcttcaccctaacctgcaccgtcgggcttacagaatgcccctccttcatgacatcgatcaaggcatgcgacctggcaatgtgctacggcagcaccgtggcaaacctggcacgaggatcaaatacagtaaaggtcgtgggcaaaggaggccacagtggtagcagcttcaaatgctgccacgacacagactgcagcagtgaaggactcctcgcctcggctccccacctcgagcgagtcaccggattcaaccaaatcgactcagacaaagtctacgacgatggtgcgcccccgtgcacttttaaatgctggttcacaaaatctggcgagtggcttctaggaatcctcaacgggaactggatcgtcgtcgtcgtgctcgtagtgatcttaatactctcaattatcatgttctcggtcctgtgcccgcgccgaggacacaagaaaaccgtataa

SEQ ID NO: 14938 - RNA, 3417 nt, synthetic construct
  misc_feature 1..3417: note = derived and/or modified CDS sequence (opt11) from ANDV(CHI-7913)__AY228238.1__GP
  source 1..3417: mol_type = other RNA
atggagggctggtacttggtggccctaggtatctgctacacccttacgctggcaatgcccaagacgacctacgagctcaagatggagtgcccgcacaccgtcggcttggggcagggttacatcatcggttcaaccgagctgggcttgatctccatcgaggccgccagcgacatcaagctggagtccagctgtaatttcgacttgcacacgacctccatggcccagaagtcattcacccaggtcgagtggcgcaagaagtccgacaccacggacaccacaaatgccgctagcaccaccttcgaggctcagactaagaccgttaacctgagagggacctgcatactggcccccgagctgtacgacacgctcaagaaggtcaaaaagaccgtcctgtgctacgacctgacatgcaaccaaacccactgccaaccgacggtgtacctcattgcccccgtcctgacatgcatgagcatccgcagctgcatggccagagtgttcacttcccgcatccaggtgatttatgagaagactcattgcgtcacggggcagttgatcgagggccagtgctttaacccggcgcacaccctcaccctgtcgcagccggcgcacacctacgacacggtgaccttacccatctcctgcttcttcacccccaaggaaagcgagcagctcaaagttatcaagaccttcgagggcatcctgactaaaaccggctgcaccgagaacgccctgcaggggtactacgtctgcttcctcggctcccacagcgagccgctgatcgtgccctcccttgaagacatccggagcgccgaggtggtctcccgaatgctcgtgcacccacgaggcgaagaccacgacgccatccagaacagccagagccacctccggatcgtggggcccatcaccgctaaggtcccctccacgagctccaccgacaccctgaagggaacggccttcgccggggtgcccatgtacagctccctgtccaccctggtgaagaacgcagaccccgagttcgtcttctcccccggcatcattccggagtcgaatcactccgtgtgcgataagaagacggtgcccatcacctggaccggctacctgcctatcagcggggagatggagaaagtcaccggctgcacggtgttctgcaccctcgccgggcccggtgcgtcttgcgaggcctactccgagaacggcatcttcaacatctccagcccgacctgcctggtcaacaaggtgcagcggttcagaggctcggagcagaaaataaacttcatctgccagcgggtggaccaagacgtcgtggtgtactgcaacggccagaagaaggtcatcctgaccaagaccctcgtgatcgggcagtgtatctacacgttcaccagcctgttctccctgatgcccgacgtggcccacagcctcgccgtcgagctgtgtgtgcccggccttcatgggtgggccaccgtaatgctcttatccacgttctgctttggctgggtcctaattcccgcagtgaccctcataatcctgaaatgtctccgcgtgctcaccttcagctgcagccactacaccaacgagtccaaattcaagttcatcctggagaaggtcaaggtggagtaccagaagacgatgggctcaatggtgtgcgacgtctgccaccacgagtgcgagaccgccaaagagctggagtcccaccggcagagctgcatcaacggccagtgcccgtactgcatgaccatcacggaggccacggagtccgccctgcaagcccactatagcatatgcaagctcactggccgcttccaggaggcgctgaaaaagtccctgaagaagcccgaggtgaagaaggggtgctacaggaccctcggcgtgttccgctacaagagcagatgctacgtcgggctggtgtggtgcctgctcctgacctgcgaaatcgtcatctgggccgcatccgctgagacgcctctgatggaaagtggctggtccgataccgctcacggggtcggggagatccccatgaagaccgacctcgagctggactttagcctgccctccagctccagctactcctaccgccggaagctcaccaaccccgccaacaaggaggagagcatctcgtttcacttccagatggagaagcaggtcatccacgccgagatccaacccctgggccactggatggacgccacgttcaacactaaaaccgccttccactgttacggggcgtgccagaaatactcctacccgtggcagaccagcaagtgtttcttcgagaaggactaccagtacgagacgggctgggggtgcaaccccggcgactgccccggcgtggggaccggctgcacggcctgcggggtgtatctggacaagctcaagtccgtcggcaaggcctacaagatcatcagcctgaagtacacccgcaaagtgtgcatccagctggggacggagcagacctgcaagcacatagacgccaacgactgtctcgtcaccccctccgtgaaggtgtgcatcgtcggcacggtgagcaagctgcagccatccgacactctactgttcctgggcccgctcgagcagggtggcgtcatcctcaagcagtggtgcacgaccagctgcgctttcggggaccccggagacataatgtccaccccaagcgggatgcggtgcccggagcacacgggctccttccgcaagatctgcggattcgcgactaccccagtctgcgagtaccaggggaacactatatcaggctacaagcgcatgatggccaccaaggacagtttccagagcttcaacctgacggagccccacatcaccgccaacaagctagagtggatcgaccccgacgggaacacccgggaccacgtgaacctcgtgctgaaccgcgacgtctctttccaagacctgagcgacaacccgtgcaaggtggacctccatacccaggccatcgagggcgcctgggggtctggcgtgggctttacgcttacctgcaccgtcggactgaccgagtgccccagcttcatgacgtccatcaaggcctgtgacctagccatgtgctacggcagcaccgtggccaacctcgcacgggggagcaataccgtcaaggtcgtgggcaagggagggcactccggaagctcctttaagtgctgccacgacaccgactgcagctccgaggggctgctcgcatcagcgccacacctggaacgcgtaacgggcttcaaccagattgactccgacaaggtctacgacgacggggcgccaccgtgcacctttaagtgctggtttaccaagtctggcgagtggctgctcggcatcctgaatggaaactggatcgtggtggtcgtgctggtcgtgatcctcatcctgtcaatcataatgttctccgtgctgtgcccgcggcgcggtcacaagaagacggtctag

SEQ ID NO: 14939 - RNA, 3417 nt, synthetic construct
  misc_feature 1..3417: note = derived and/or modified CDS sequence (opt11) from Hu39694(Hu39694)__AF028023.1__GP
  source 1..3417: mol_type = other RNA
atggaaggctggtacctgatcgtgttaggggtctgcagcactctgacactcgccatgcccaggacgatctacgaactcaggatggagtgtccccacaccgtgggcctggggcagggctatatcatcgggtcaaccgagttaggcctcatccccatcgagaccgtgagcgacctgaagctggagtccagctgcaacttcgacctccacactacctccatgacccagaagtcctacacccaggtcgagtggcgcaagaagtcggacacgaccgacaccaccaacgccgcgagcactaccttcgaggcccagaccaagacggtgaacctgcggggcacgtgcgtgctggcaagtgagctctatgacactctgaagaagatcaagaaaaccgtcctgtgctacgaccttacctgcaaccagacgcactgccagccaaccgtgtacctcatagcccccgtctcaacgtgtatgtccatccgtagctgcatggcctccgtcttcaccaatcggatccaggtgatctacgagaaaacccactgcgtgaccggccagctggtcgagggccagtgtttcaacccggcgcacaccctcaccctctcccaacccgcccacacgtacgagatggtgaccctgccagtgacctgcttcttcaccccgaaaaagtccgaccagctcaagctgatcaagacgttcgaggggatcatcagcaagacgggttgcaccgagaacgccctgcaagggtactacgtatgcttcctcggcagccactcggagccactgcacgtgccctcccttgaggacatccgcagcgtggaggtgttcagccggatgatcatacacccccgcggcgaggaccacgacccaatccaaaattcccaggggtttctccggatcgtgggcccgatcaccgcaaaggtgccaagcacctcctcgaccgacactttgaaggggaccgctttcgccggtgttcccatgtactctagcctgtccaccctcgtgcgcacgaccgatcctgaatacgtgttctccccgggcatcatccccgagtccaaccacagcacgtgcgacaagaagaccattcccctgacatggacggggtacctccccatagcgggcgaaatggagaaggtcaccgggtgcacggtgttctgcacgcttgctggcccaggcgcctcctgtgaggcgtacagcgagcacggaatattcaacatctccagcccgacctgcctggtgcacaaggtgcagaaattccgtggctccgagcagaaaatcaactttatctgccagcgcgtggaccaggacgtcgtagtgtactgcaacgggcagaagaaggttatactgaccaaggacttggtgatcggccagtgtatttacacctttacgagcctatttagcctgatgcccgacgtggcccacagcctcgccgtcgagctgtgcgtgccaggcttgcacggctgggccacagtgatgctcctctccaccttctgcttcgggtggatcctgatacccgccatcacactcgtcgtgctgaagtttctgaagatggcgacgttcagctgcagccactacaccaacgagtccaagttcaagtttatcctcgagaaggtgaaggtagagtaccagaagaccatgggcagcatggtctgcgacatctgccaccacgagtgcgagaccgccaaggagctggagtcgcacaagcagagctgcatcaacggccaatgcccctattgcatgactatgaccgaggccaccgagtccgcgctgcaggcccattacagcatttgcaagctgaccgggcgattccaggaggctctcaagaagtccctaaagcgccccgaggtgaagaagggctgctaccggacgttgggggtcttccgatataaaagccggtgctacgtgggcctcgtctggtgcgttttactgacctgtgagctcatagtatgggcagcctcagccgagactcccttgctggagtccgggtggtccgacaccgcacacggcgtgggcgaggtccctatgaagaccgacctcgagctggacttcagtcttccctcctcatcctcgtattcctaccgccggaagctcaccaacccagcgaacaaagaggagtctatcccgttccacttccagatggagaagcaagttatccacgccgagatccaaaccctggggcattggatggacgccacctttaacatcaagacggcatttcactgctacggagcatgccagaagtactcctacccgtggcagactgccaagtgcttctttgaaaaggactaccagtacgaaaccgggtggggatgtaaccccggagactgtcccggcttcggcaccgggtgcacggcgtgcggtgtgtacctggataagctcaagtccgtggggaaggcgtacaagataatcagcctgaagtacacccggaaggtgtgcatccagctgggcaccgagcagacttgtaaacacattgacgccaacgactgcctggtgaccccgtccgtcaaggtgtgcatcatcggcacagtgtctaaactgcagccctccgacaccctcctcttcctgggccccctggagcagggcgggatcctcctgaaacagtggtgcaccaccagctgcgcattcggcgaccccggggacatcatgtccacgaccagcggcatgcggtgcccggaacacaccggctccttccgcaagatctgcgggttcgcgaccacgccagtctgtgagtaccagggcaacaccatcagcggatacaagcgcatgatggccacgaaggactccttccagtcgttcaatctgaccgacccacacatcaccacgaacaagctcgaatggatcgaccccgacggcaacacccgggaccacgtgaacctagtgctgaaccgcgacgtctccttccaggatctctctgataatccgtgcaaggtggacctgcacacccaggccatcgagggggcctggggatccggcgtggggttcacactgacctgcaccgtcggcctcacggaatgcccctctttcatcacgagtatcaaggcgtgcgacatggccatgtgctatgggagcaccgtgtccaatctcgcccggggcagcaatacggtgaaggtcgtggggaagggcggacacagcgggcttcactcccgctgctgccacgacaccgactgcagcagcgagggcttagtggcctctgcaccgcacctggagcgggtcacggggttcaatcagatcgactccgataaggtgtacgacgacggcgcaccaccatgcacgttcaagtgttggttcaccaagagcggtgagtggctgctcgggatcctgaacggaaactggatcgtcgtcgtagtgctggtcgtggttctcatcttctccataatactattcaatatcctgtgcccccgcagggggcacaagaagaccgtgtag

SEQ ID NO: 14940 - RNA, 3417 nt, synthetic construct
  misc_feature 1..3417: note = derived and/or modified CDS sequence (opt11) from LECV(Of22819)__AF028022.1__GP
  source 1..3417: mol_type = other RNA
atggaaggatggtacctcattgtcctcggcgtctgcagcacactcacactcgccatgccaaaaacaatctacgaactaaaaatggaatgcccccacaccgtcggattgggtcaaggcattatagtaggaagcacagaactcggattaatccccatagagacagcctcggacctaaaactagaatcatcttgcaacttcgatctgcacaccacatcaatgacgcagaaaagctacactcaagtagaatggagaaagaaatcagataccacggataccaccaatgccgcagcaacaacgttcgaatcacaagcaaaaacggtgaacctgcggggaacctgcgtgttagctgcagaactttacgacaccctgaagaaggtgaaaaagacagtactctgctacgacctaacttgcaatcaaactcactgccaacccaccgtatacctcatcgcacccgtgataacctgcatgagcataagatcctgcatggcttccgtcttcatctcacgcatccaaatcatttacgagaaaacgcattgcgtgactggccagctgatcgaaggtcaatgctttaaccccgcccacaccttaaccttagcccaacccgcccacacatacgaaacagttacactcccagtaacctgcttcttcacccccaagaaaagcgaccaactcaaactcattaaaacatttgaaggcataatatccaaaacaggatgcactgaaaacgcgctccaagggtattacgtctgttttctgggttcccactccgaaccacttcacgtcccgagcctcaaggacatccgtagcgccgaagtggttacccgaatgatagtgcacccccgaggagaagaccacgatcccattcaaaactcccaagggtaccttaggatcgtcggccccctgaccgcaaaggttccatccacctctagctccgataccctgcaaggcactgcctttgcaggcgtcccaatgtactcatcactctccactctagtccgtaacaccgatcctgagttcgtgttctctccaggaatcattccagaatccaaccactccgcctgcgataagaaaaccatcccccttacctggacgggctatctaccaatctcgggcgaaatggagaaagtcacaggatgcacagttttctgcacccttgcgggccccggcgcctcctgcgaggcctactctgaatctggaatcttcaacataagctcccctacctgcctcgtcaacaaagtccaaaaatttcgtggctcagagcagaaaataaacttcatctgccaacgagtagaccaagacgtcgtcgtatattgtaacggccagaagaaagtgatactaaccaaaaccctcgtaattggtcaatgcatctacacctttacttcactcttctccctcatgcccgatgttgctcactcacttgccgtcgaactttgcgtacccggcctccatggatgggccaccgtaatgctgctaagcaccttctgcttcggctggatcttaataccagccatcaccctagtagtgctgaaagtgttaaaagtagcgacattctcctgctcacactacaccaacgagtccaagttcaaatttatactagagaaagtcaaagtcgaataccagaaaaccatgggcagtatggtatgcgacatttgtcaccacgaatgtgaaacagccaaagagctcgaatcccacaaacaatcatgcattaacggccaatgtccctactgcatgacaatgactgaggcgaccgaaagcgccctccaagcccatttcgccatttgcaaactcaccggccgattccaagaagccctaaagaaaagcctaaagaaacccgaagtaaggaaaggctgctaccgcacattaggggtcttccgttacaaatcgcgatgctacgtgggcctagtgtggtgtgtcctcctaacatgcgaactcatcgtctgggcggcctccgccgaaaccccactattagagagcggctggtccgacaccgctcacggagtgggcgaagtcccgatgaaaacagacctggaactcgacttctccctcccctcctcctcctcctactcctaccgaagaaaactcactaaccccgccaacaaagaagaatccatacccttccatttccagatggagaaacaagtcatacatgcggagatccaaaacctaggccattggatggacgcaacctttaacattaaaaccgccttccactgctacggtgcctgccaaaaatactcttatccctggcaaacagcgaagtgtttcttcgaaaaggactaccaatacgaaacgggatggggatgcaaccccggcgactgccccggagtaggcacaggctgcaccgcctgcggagtctacctcgacaaactcaaatcggtcggcaaggcatacaaaataatctcccttaaatacacacgcaaagtttgcattcagctaggtaccgaacaaacctgcaagcatatagacgcaaacgactgcctcgtaacaccatccgtaaaggtctgcatcgtcgggaccgtctcaaaactccaaccctccgacacacttctattcctaggccccctcgaacaaggcggcatcatcttaaagcagtggtgcaccaccagctgtgcattcggggaccccggcgacatcatgtcaaccacctccggaatgcgctgccccgaacacacaggcagcttccgcaaaatctgcggattcgccacaacaccagtctgcgagtaccaaggcaacaccataagcggctacaaacgcatgatggccactaaggactcattccaatcctttaacctaacagacccgcacatcacaacaaacaaactcgagtggatcgaccccgacggcaacacccgagatcacgtcaacttggtcctaaacagagacgtatcctttcaagacctgtctgataacccctgtaaggtggacctgcacacccaagccatagaaggtgcctgggggagcggcgtcgggttcactctcacttgcaccgtggggctcaccgaatgcccatcattcatgacctcgatcaaagcatgcgacctggccatgtgctacggctcgaccgtccacaacctcgcgaggggtagcaacaccgtcaaagtcgttggaaaaggcggccactccggatccagcttcaaatgctgccacgacaccgattgctcatccgaaggcttagtcgcatcagctccccatctagaaagagtcaccgggttcaaccaaatagacagcgacaaagtttacgatgacggagccccaccctgcacattcaagtgttggttcaccaaatccggcgaatggctcctaggcatcctaaacggaaactggatcgtcgtagttgtcctcgtcgtcgtactcatcttcagcataattctcttctcaatcctatgcccccgcaggggccacaagaaaacagtataa

SEQ ID NO: 14941 - RNA, 3417 nt, synthetic construct
  misc_feature 1..3417: note = derived and/or modified CDS sequence (opt11) from ORNV(Ol22996)__AF028024.1__GP
  source 1..3417: mol_type = other RNA
atggaaggctggtacctcatcgttctaggcgtgtgctccaccgtaacactagccatgccaaagaccatctacgaactaaaaatggaatgcccccatacagttggtctgggccaaggatacatcatcggctccaccgaactcaacctaatacccatcggtgcagcctccgaccttaaattagaatcctcctgcgacttcgacctatacacaaccccgatgacccaaaagtcttacacccaagtcgagtggcggaagaaaagcgagactacagacacaactaacgccgcagccaccacattcgaatcccaaactaaaaccgtcaacctccggggaacgtgcatcctggcatccgaactctatgacaccctaaacaaaataaagaaaccggtattgtgctacgacctcaactgcaaccaaacacgctgccaacccaccgtgtaccttattgcccccgttatcacatgcatgtccatacgcagctgcatggcctccgtctccaatagccgcatccaaatcatatacgagaaaacccattgcgtcaccgggcaactggtagaaggccagtgcttcaacccaagccacaccctcacacttgcacagcccgcccacacatacgaaacagtcacactgcccgtaacatgctttttcacccccaaaaagtctgaccagctcaaacttgtcaaaactttcgaaggcatcataactaagaccggctgcacagaaaacgcgctacaaggctattacgtatgcttcctcggatcacattcagagccccttcacgttccctccctcgaggacatacgaagcgccgaggtcgtcagccgtatgatcgtccaccccaggggcgaagaccatgacccaatccaaaactcacagggacacctacgtatagtcggacccattaccgcaaaagtaccatccacatcctcttccgacacccttcaaggcaccgccttctctggcgtaccaatgtacagcagcctctccaccctagtccggtccgccgaccccgagttcgtgttctcacccgggatcctcccggaaagcaaccatagcgtatgtgacaaaaagactctcccactcacgtggaccggctacctaccaatctcgggcgaaatggaaaaagtcaccgggtgcacggtcttttgcaccttagcagggcccggtgcctcctgtgaggcatactctgaaaatggtatattcaacatatcttccccaacctgcctagtaaacaaagtacaaaaattcaggggatccgaacagaaaatcaatttcatctgccaacgcatggaccaagacgtcgttgtatattgcaacggccaaaagaaagttatcttgaccaaaacacttgttatcggccagtgcatttacacattcactagcttattctcccttatgcccgacgtcgctcactccctcgccgtagaactgtgcgtccccggcctccacggatgggccacagtaatgctcttaagcaccttttgtttcggctggatcctaatcccggcaataacccttgtcgtactaaaattcctaaaaatggccacattttcctgctcacactatacaaacgaaagcaaattcaaactaatactcgaaaaagtaaaagtagaataccagaaaactatgggctcaatggtatgcgacatttgccaccacgaatgcgagacagcgaaagtcctcgaatctcacaagcaatcgtgtatcaacggccaatgcccctactgcatgacgatgaccgaagcgacagaatccgccctccaagcccattactcgatatgtaaattaactggacgattccaagaagccctcaaaaagtccctgaagaaaccagaggtcaaacgcggctgctacagaaccctaggcgtcttccgctacaaatcccgatgctacgtcggcctagtatggtgcgtcctcctaacgtgcgaattaatcgtctgggcagcttccgcagaaacacccctcctagagtcaggatggtccgacaccgcccacggcgtcggagaaatcccgatgaaaacggacctcgaactcgacttcagcttaccctcaagttccagctactcatacagacgtaaactaaccaacccagcgaataaagaggagtcaatcccattccacttccaaatggaaaaacaagtaatacatgccgaaatccaaaccctaggacactggatggacgcgacattcaacataaaaaccgccttccactgttacggcgcgtgccaaaaatactcctacccctggcaaaccgccaaatgcttcttcgaaaaagactaccaatacgagacaggctggggatgcaaccccggcgactgtcctggtgtaggaaccggatgcaccgcatgcggtgtctacctagacaaactcaaatccgtcggaaaagcctacaaaatcatctcactcaaatacacccgaaaagtctgcatccaactcggcaccgaacaaacctgtaagcacatcgacgcaaacgactgtctcgtgaccccctctgtcaaggtgtgcatagtaggcacggtaagcaaactacaaccctcagacaccctccttttcctaggccccctcgaacaaggaggcataatactaaagcagtggtggaccacttcatgcgccttcggagacccaggcgacatcatgagcaccacatcaggcatgcgctgccccgaacacacgggatcattccgaaagatatgcggcttcgcgacaacacccgtctgtgaataccaaggaaatacaatatccggttacaagaggatgatggcgaccaaagactcattccaatcgttcaacctcaccgacccgcacataacaacaaataagctggaatggatagacccggacggaaacacccgcgaccacgtcaacctcgtcctaaacagagacgtctcattccaagacctctcagacaacccttgcaaagtggacctccacacacaagcgatagaaggggcatggggctcaggtgtcggcttcacccttacatgtaccgttggccttaccgagtgtccatccttcatgacctccatcaaagcatgcgacctagccatgtgctacggtagcaccgtcaccaacctcgcccggggatccaatacagttaaggtcgtaggcaagggaggtcattcaggctcctccttcaaatgctgccacgacacagactgctcatcggaagggctagtcgccagcgcgccacacctagaaagagtgacaggattcaatcaaatagactcagacaaagtctatgacgacggcgcacccccatgcacctttcgttgctggttcacaaaatcaggcgaatggctcttagggatactcaacggaaactggatcgtagtagtcgtactaatcgtagttctaatcttctccattgtcctcttctctatcctttgtccccgcagaggacacaagaaggccgtgtaa

SEQ ID NO: 14942 - RNA, 3426 nt, synthetic construct
  misc_feature 1..3426: note = derived and/or modified CDS sequence (opt11) from BCCV__L39950.1__GP
  source 1..3426: mol_type = other RNA
atgggcaggctgtacctaatcgtgctgggagttctgattaccgccaccgccggcttcccccggagcgtgcacgagctcaagatcgagtgtccgcacacggtggttctggggcagggctacgtgacggggtccgtggagctgggcttcatcgccctcgaccaggtcaccgatctgaagatcgagagctcgtgcagcttcgaccatcacgccgcccccaccacgacccaaaacttcacccagctgaagtgggccaagaccgcctccactaccgacacgaccaacgcggccgaaacgaccttcgagagcaagtccaccgaggtgcacctcaagggcgtgtgtaccatcccctcaaacgttctggacgggccctcccgcccggtgacgggccggaagaccgtggtttgctatgatctagcgtgcaaccagacccactgccagcccaccgtgcacctcctggcacccatacagacgtgcatgagcgtgcgctcctgcatgatcagcctgcttgcatcccgcatccaggttgtttacgagaagacctactgcgtgactgggcagctgatcgagggcctgtgtttcaaccccgtcccgaacctcgccctaacccagcccggacacacgtacgacaccttcacactccccatcacgtgcttcttagtggctaaaaagggtgccaatctgaaaatcgctgtggagcttgagaagctcaccaccaaaaccggctgcgcagagaacgccctgcaggcctactacatctgtttcatcgggcagcacagcgagcccttgaccgtgccgatgctcgaggattaccgctccgctgagatctttacgcggatcatgatgaaccccaagggcgaggaccacgacatggagcaaagctcccagggggccctgcgcatagtggggccaatcaaaggcaaggtaccaccgacggaaaccagcgacaccgtccagggtatcgcgttcgctggcctgcccatgtacagcagcttcagctccctggtacggaaggccgagccggagtacctgttcagcccaggcatcatcgccgagtccaaccacagcagttgcgacaagaagacactgccgctcacctggcgaggcttcctaagcatgtccggggaaatcgagcggatcaccggctgcaacgtcttctgcacgctggccggaccgggggccagctgcgaggcgtattccgaaaacggcattttcaacatttcctccccgacctgtctagtgaacaaggttcagaagttcagaggcagcgagcagagaataaacttcatctcccagcgaatcgaccaagacgtaatagtgtactgcaacggccagaagaaggtgattctcacgaagaccctggtcatcgggcagtgcatctacaccttcaccagcatcttctccctcatccccagcgtggcccactccctggcagttgagctatgcgttcccggcatccacggctgggctacgatcgcgctcgtaatcaccttctgcttcggatggctactgattccgaccacgacgatggtagtcttgaaatgtctgcggctgctaacctacagctgctcccactacagcaccgagagcaagttcaaggtgatcctggagaaagtgaaggtcgagtaccagaagaccatgggctcgatggtgtgcgacatttgccaccacgagtgcgaaacggcgaaggagctagagagtcacaaaaagagctgcgccgacggccaatgcccctactgtatgaccatcaccgaggccacagaaagcgcgctgcaagcccactacgccgtgtgcaagctcacgggccgcttccacgaggccctgaagaagtccttaaagaagccggaggtccagcgcgggtgctacaggactctcggcgttttccggtacaagagccgctgctacgtgggcctggtctggatgtgtctgctcaccctggagctgatagtgtgggccgcgtccgccgacacgcccctcctggaacccgggtggagcgacaccgcccacggcgttggggacatccctatgaagaccgacctggagctcgacttcgcgatcccgtccagcagtagctactcctatcggaggcgcctggtcaaccccgccaacagtgatgagactgtgcccttccacttccagctggaaagacaggtgatccacgcggaaatccagtccctcggtcactggatggacgctacctttaacattataagcgccttccactgctacggcgaatgcaagaagtactcctatccgtggcagacggccaagtgcttctttgagaaggactaccagtacgagaccagctggagctgcaacccgccagactgccccggggtcggaaccggttgcaccgcgtgcggcatctaccttgataagctgaagtccgtcggtaaggcgtacaaagtgatcacgctcaagtacgcccggaaggtctgcatccaactcggcaccgagcaaacctgcaagaacatcgacgtgaacgactgcctggtgaccagctccatcaaagtctgcatgattggcacgatctccaagtttcagcccggggataccctcctgttcctgggcccgctcgaggagggcgggctagtcctgaagcagtggtgcaccactacgtgctccttcggagaccctggagacatcatgagcaccacctccggaatgcgatgccctgagcacactgggagcttccgcaagatctgcggcttcgcaacaacgcccgtgtgtgagtatcaggggaacaccgtctccggattcaagcgactcatggccaccaaagacagcttccagtcgtttaacgtcagcgaggtgcatatcaccacgacaaagttggagtggtcagatcccgacagcaatattaaggaccacatcaacctgatcttaaacagggacgtctccttccaggacctgagcgacaacccctgtaaggtggacctgtccacccaggcgatcgacggggcatggggcagcggcgtggggttcaccttaacgtgcatcgtcggcctgaccgagtgctccagcttcatgactagcataaaggtgtgcgacatggcaatgtgctatggtgcctccgtggtcaacctggtgcggggctctaacaccgtgaagatagtcggcaagggcggccactctgggtccacgttccgctgctgccacgataaagactgcacctccaacggcctcctggccagcgcgccccacctggagcgggtgaccgggttcaaccagatcgactccgataaggtgtacgacgatggcgcgcccccgtgcagcatcaagtgctggttcgcgaagtcaggcgagtggctccttgggatcctgaatggcaactgggtcgtggtcgccgtcctcgtgatcatcctgctgatcagcattttcctcttcagtttcttctgccccatccgctcacacaagaagcaattatga

SEQ ID NO: 14943 - RNA, 3408 nt, synthetic construct; identical to SEQ ID NO: 11657
  misc_feature 1..3408: note = derived and/or modified CDS sequence (opt11) from DOBV(DOBV/Ano-Poroia/Afl9/1999)__NC_005234.1__GP
  source 1..3408: mol_type = other RNA

SEQ ID NO: 14944 - RNA, 3408 nt, synthetic construct; identical to SEQ ID NO: 11658
  misc_feature 1..3408: note = derived and/or modified CDS sequence (opt11) from DOBV(DOB/Saaremaa/160V)__AJ009774.2__GP
  source 1..3408: mol_type = other RNA

SEQ ID NO: 14945 - RNA, 3408 nt, synthetic construct
  misc_feature 1..3408: note = derived and/or modified CDS sequence (opt11) from DOBV(East Slovakia/400Af/98)__AY168577.1__GP
  source 1..3408: mol_type = other RNA
atgatcatgtgggggctgctcctgaccatgatcctgatcgacttcgggaccagcctcagaaacgtgtacgacatgaagatcgagtgcccccactccatcaacttcggcgagagttccgtcacggggaaggtggagctgccgcccctgctgctgacagacgccgaggccctggtgccggagagcagttgcaacatggacaaccaccagagcatgtccatcatccagaaggtcaccaaggtgtcatggcggaagaaagccgacaaagcccaggccgccaaggattccttcgagactacgagctctgaggtcaacctcaaggggacatgcaccctgagccacaggatggtcgaggagtcctaccgaaaccgccggagcgtgatctgctacgacctgtcctgcaacagcacccactgtaagcccacgatgcacatgatcgtgccggtccactcctgcaacatgatgaagtcctgcctcgtggggctgggcccatacaggatccaggtggtctacgagcggacatattgcaccaccggcatcctgacggaggggaagtgcttcgtgcccgaccagagcatcgtgaacgtcatcaagaacggcgtcttcgacatcgctagcgtgagcatcgtctgcttcttcatacgcgtgaaggggaccaactataagatcatggcgtccattaagaccgccaccgccaacaactgcaacgacacggacaacaaagtgcaggggtactacctctgcatcgtcgggggcaactcaagtcccgtgtacgcccccagcaccaccgatttccggtccatggaggcgctggccagcctgctccgcgcgccccacggcgaggaccatgacctgtccggtgaggaggtggccacgtacagcattgcaggccagatagaggggaagatccctcacacggccaacgcggccaacatgctgtttaccgccttctccggcatcccaagctactccagcctctccgtctacatcgggagccaggatgggccggtggtctactcccccggcctattccccaagctgaaccagagctcctgcgacaaggtggccctcccactgatctgggaagggtacatcgacctgccgggctattacgagaccgtgcacccctgcaacgtcttctgcgtgctcagcgggcccggcgcgtcctgcgaggcattctctgagggcgggatcttcaacatcaccagccccacgtgcctggtgtccaagcagaaccggttccgcgccgccgagcagcaggtcaacttcgtgtgccagcgggtcgaccaggacatcgtcatctactgcaacggccagaagaagaccatattgaccaagaccctcgtgatcgggcagtgcatttacagtgtgacgtccctgttcagcatcatgccgggcgtcgcccactccatcgcgatcgagctgtgtgttcccgggttccacggctgggcgactgccgccctcctgaccaccttctgcttcggctggatccttatcccctcaatcactctcgccgtgttagtcgtgctgaagttcttcgcggccatcctccacaactccagccaggagaaccgcttcaagataatactgcggaagatcaaggaggaatttgaaaagaccaaggggtccatggtgtgcgaggtctgcaagtacgagtgtgagaccggcaaggagttgaaggcccacaatctcagctgcccccagtcccagtgtccgtactgcttcacccactgcgagcccacggaaagcgccttccaggcgcactacaaggtgtgccaggccacacaccgcttccgggacgacctgaagaagaccatcacgccccagtccacgagccccgggtgctaccgcacactgaacctcttccggtacaagtcccgctgctacattttcaccgtgtgggtcaccctgctgataatcgagagcatcatgtgggcggcctccgcctcggagaacgtgctcgagccgagctggaatgacaacgcgcacggcgtgggggtcgtgcccatgcacaccgacctggagctggacttctccctccccagctccagcaagtacacgtacaagcggaagctcacctccccgctgaaccaggagcaaagcgtggacctgcacatcgagatcgagtcccagggcatcagcacctccgtccacgccctcggccattggttcgacgggcgcctgaacctgaagacgagcttccactgctacggcgcctgtacaaagtacgagtacccctggcacaccgccaagtgtcacttcgagcgcgacttcgagtacgagaactcctgggggtgcaaccccgccgactgccccggcatcggcaccgggtgcaccgcgtgcggcctctacatcgaccagctgaagccggtggggagcgcctacaagctgatcactgtgcggtattcccgcaaggtctgcgtgcagttcggcgaggagaacctctgcaagaccatcgacatgaacgactgcttcgtcacccggcacgttaaggtatgcatcatcggcaccgtgagcaagttttcccagggcgatacgctggtcttcctgggccccatggagggcggcgggctcatcttcaaggactggtgcacaagcacgtgccagttcggcgaccccggggacatcatgtcccccaaggacaagggcttcagctgcccggacttcaccggccacttccgcaagaagtgcaacttcgccaccaccccagtgtgcgaatatgacgggaacatggtgtccggctacaagaaggtcatggccaccatcgacagcttccagagcttcaacacctccagcatccactacactgatgagcggatcgagtggaaggatcccgacgggatgttgaaagaccacctaaacatcctcgtcaccaaagacatcgacttcgaaaacctgggcgagaacccctgcaaggtggggctgcaaaccagtagcatcgagggcgcctggggcagtggggtcggcttcaccctcacgtgccagatcagcctgaccgagtgctcccgcttcctgacctctatcaaggcgtgtgacatggccatctgttacggggcccagtccgtgaccctcatccggggccagaacacggtgaaggtcagcgggaagggagggcactccgggagctccttcaagtgctgccacggcaccgattgcagccagcaggggctgcaggcctccgcgccgcacctggacaaagtaaacggcatagtggaacaggagagcgaaaaggtctacgacgacggcgcgccccagtgcgggatctcttgctggttcgtcaagagcggggaatggattaccgggatcttcaacggaaactggatcgtgatcgtggtgttaatcttcttcttcatcctgtccctgatcctactgagcctcctctgccccatccgcaagcacaagcggagctga

SEQ ID NO: 14946 - RNA, 3408 nt, synthetic construct
  misc_feature 1..3408: note = derived and/or modified CDS sequence (opt11) from DOBV(East Slovakia/862Aa/97)__AY168578.1__GP
  source 1..3408: mol_type = other RNA
atgatcatgtggggcctgctcttgacgatgagcctgatcaacctcggggcctccctgcgcaacgtgtacgacctccggatcgagtgccctcacagcatcaacttcggcgagtccagcgtcaccgggaaggtggagctcccgcccatccccctgacggacgccgaaaccctcgttccagagtccagctgcaacatggacaaccaccagtccctcagcatcacacagaaggtcaccaaggtgtcatggcgcaagaaggcggacaaggtgcaggccgccaaggacagcttcgagacgacatccagcgagatcaacctgaaggggacctgcaccctggcccaccggatggtcgaagagagttaccgcaaccgcaagagcgtgatctgctacgacctctcctgcaacagcacgcactgcaagccgaccatgtacatgatcgtgcccgtccactcctgcaacatgatgaagtcctgcctggtggggctggggccctaccggatccaggtagtttacgagcggacctactgcaccacgggcatcctcatcgaggggaagtgcttcgtgcccgaccagagcatcatcagcgtgataaagaacggcgtcttcgacatcgccagcgtgtccatcgtgtgcttcttcatccgcatcaaggggaacagctataagatcatgaccaacatcaagaccgcgaacccaaacaactgcaacgacaccgataacaaggttcagggctattacctgtgcatcgtcggggccaactccagccccgtgtacgccccctccacgaccgacttcaggagcatggaagtcctggcctccctcctgcgcagcccccacggcgaggaccacgacttatccggcgaggaggtggcgacctacagcatcgccggccaggtggaaggcaaggtcccgcacaccgagaacgccgctaacatgctgttcacggccttttccgggatcccctcttactccagcctctccgtcttcgcgggcaaccaggacgggaccgtcatctacagccccgggctattccccaagctcaaccaatccagctgcgagaaggtggccctcccgctgatctgggagggctacatcgacctccccgggtactacgagacaatccacccctgcaacgtgttctgcgtcctgtccggccccggggccagctgcgaagccttcagcgagggcggcatcttcaacatcacctccccgacgtgcctggtgagcaagcagaatcggttccgcgccgcggagcagcagatcaacttcgtgtgccagcgggtcgaccaggacatcgtgatctactgcaacgggcagaagaagaccatcctcaccaagaccctggtgatcggccagtgcatctactccgtcacgagcttattctccatcatgcccggggtggcccacagcatcgccatcgagctctgcgtgcccggcttccacggatgggccaccgccgcgctgctgaccaccttctgcttcggctggatcctcatcccctccatcacgctggccatcctgatcgtcctcaagttcttcgccgccatcctgcacaacagctctcaggagaaccgcttcaaggtgatcctgcggaagatcaaggaggagttcgagaagaccaagggcagcatggtgtgcgaggtctgcaagtacgagtgcgagaccgggaaggagctcaaggcccacaacctgtcctgcccgcagagccagtgcccctactgcttcacccactgtgagctgacggagtccgcgttccaggcccactaccgcgtgtgccaggccacccaccggttccgcgatgacctcaagaagaccatcacgccccagagcacctctcccggctgctaccggacgctgaacctgttccgctacaagagccggtgctacatcttcaccgtgtgggtcgtgctcctgatcatcgagtccatcctgtgggccgcgagcgccagcgagatcgtgctggagccgtcctggaacgacaacgcccacggggtcggcgtggtgcccatgcacaccgacctcgagctggacttcagcctgccctccagctccaagtacacctacaagcgcaagctcacgagcccgatcaaccaagagcagtccgtcgacctgcacatcgagatcgagagccagcgcatctccaccagcgtgcacgccctgggacactggttcgacggcaggctcaacttgaagacctccttccactgctacggcgcctgcaccaagtacgagtacccctggcacacggcgcgctgtcactttgagcgggacttcgagtacgagaacagctggtcctgcaaccccgccgactgcccagggatcggcacagggtgcaccgcctgcggcctgtacctcgaccagctgaagccggtaggcagcgcctacaagctgatcaccgtccgctactcccggaaggtgtgcgtgcagttcggggaggagaacctctgcaagatcatcgacatgaacgactgcttcgtcagccgccacgtgaaggtctgcatcatcggcacggtctccaagttctcgcagggggataccctggtgttcctgggccccatggagggcgggggactcatcttcaaggactggtgcaccaccacttgccagttcggggaccccggcgacatcatgtccccgaaggacaaggggttcagctgcccggacttcacaggccacttccggaagaagtgcaacttcgccaccacccccgtgtgcgagtacgacgggaacatggtcagcggctacaagaaggtgatggcgacgatcgactccttccaggccttcaacaccagctacatccactacaccgacgagcgcatcgagtggaaggaccccgacggcatgctgaaggatcacattaacatcctggtgaccaaggacatcgacttcgagaacctcggggagaacccctgcaaggtcggcttacagacggcctccatcgagggggcctggggcagcggggtgggcttcaccctgacctgccagatctccctcaccgaatgcagccggttcctgacgtccatcaaggcttgcgacatggcgatctgctacggcgcccagagcgtgaccttagtccgcgggcagaacaccgtgaaggtgtccggcaagggcgggcacagcggctccagcttcaagtgctgccacggcaccgactgttcccagcagggcctccaggccagcgccccgcacctggacaaggtcaacgggatcgtggagcaggagtccacccaggtgtacgatgacggcgcgccccagtgcgggatctcatgctggttcatcaagtccggcgagtggatcaagggcattttcaacgggaactggatcgtcatcgtggtgctgatcttcttcttcatcctcagcctgatcctgctgtccttcctgtgccccatccggaagcacaagcgcagctga

SEQ ID NO: 14947 - RNA, 3408 nt, synthetic construct; identical to SEQ ID NO: 11661
  misc_feature 1..3408: note = derived and/or modified CDS sequence (opt11) from DOBV(A35)__GU904036.1__GP
  source 1..3408: mol_type = other RNA

SEQ ID NO: 14948 - RNA, 3408 nt, synthetic construct; identical to SEQ ID NO: 11662
  misc_feature 1..3408: note = derived and/or modified CDS sequence (opt11) from DOBV(A6)__GU904033.1__GP
  source 1..3408: mol_type = other RNA

SEQ ID NO: 14949 - RNA, 3408 nt, synthetic construct
  misc_feature 1..3408: note = derived and/or modified CDS sequence (opt11) from DOBV(B13)__GU904034.1__GP
  source 1..3408: mol_type = other RNA
atgatcatgtggggcctgctcctgaccatgatcctgatcgacttcggggcctctctccgcaacgtgtatgacatgaagatcgagtgcccccactccatcaacttcggcgagagctccgtcaccgggaaggtggagctgccgcccctgctcctgaccgacgccgaggccctcgtgcccgagagctcctgtaacatggacaaccaccagagtatgtccatcatccagaaggtcaccaaggtgagctggcggaagaaggccgacaaggcccaggccgccaaggactccttcgagaccaccagctccgaggtgaacctcaagggcacgtgcaccctgagccaccgcatggtcgaggagtcataccggaatcgccggagcgtgatctgctacgacctgtcctgcaacagcacccactgcaagcccaccatgcacatgatcgtgccggtccactcctgcaatatgatgaagtcctgcctcgtagggctgggcccctaccgcatccaagtggtctacgagcggacgtactgcaccaccggcatcctgaccgaggggaagtgcttcgtgcccgaccagagcatcgtgagcgtcataaagaacggcgtgttcgacatcgccagcgtgtccatcgtctgcttcttcatccgcgtgaaggggacgaactacaagatcatggccagcatcaagaccgccaccgccaacaactgcaacgacaccgacaacaaagtgcagggctactacctctgcatcgtcgggggcaactcaagtcccgtgtacgcgccgtccactaccgacttccggagcatggaggccctggcctccctgctccgcgcgccccacggcgaggaccacgacttaagcggggaggaagtggccacctactccatcgccggccagatcgaggggaagatcccccacaccgccaacgccgccaacatgctgttcacggcattcagcggcatcccctcctacagcagcctctccgtcttcatcggctcccaggacgggccgatcatctacagccctggcctgttccccaagctgaaccagagcagctgcgacaaggtggcgctccccctgatttgggaggggtacatcgacctgccgggctactacgagaccgtccacccctgcaacgtgttctgcgtgctctccgggcccggcgcaagctgcgaggccttcagcgagggcgggatcttcaacatcacctcaccgacctgcctggtcagcaagcagaaccggttccgcgccgccgagcagcaggtcaacttcgtgtgccagcgggtcgaccaggatatcatcatctactgcaatggtcagaagaaaacgatcctgaccaagaccctcgtgatcgggcagtgcatctactccgtgaccagcctgttctccatcatgcccggcgtcgcgcacagcatcgccatcgagctgtgcgttcccgggttccacggctgggccacggccgccctcctgaccaccttctgtttcggctggatcctgatcccctccatcaccctcgctgtgctggtcgtgctgaagttcttcgcagctatcctccacaacagctcccaggagaaccgcttcaagatcatcctgcggaagatcaaggaggagttcgagaagacgaaggggagcatggtgtgcgaggtatgcaagtacgagtgcgagaccggcaaggagctgaaggcccacaacctctcctgcccccagtcccagtgcccgtactgcttcacccactgcgagcccaccgagtccgcgttccaagcccactacaaggtgtgccaggccacgcaccgcttccgggatgacctgaagaagaccatcacgccccagagcacctcccctgggtgctaccgcaccctcaacctcttccggtacaagagccgctgctacatcttcaccgtgtgggtcaccctgctgatcatcgagtccatcatgtgggcagccagcgcgagcgagaacgtgctcgagccgtcctggaacgacaacgcccacggcgtgggggtcgtgcccatgcacaccgacctggagctggacttcagcctgccctccagctccaagtacacctacaaacggaagctcacgagcccgctgaaccaggagcagtccgtggacctgcacatagagatcgagagccagggcatctccaccagcgttcacgccctcggccactggttcgacgggcgcctgaacctgaaaacctccttccactgctacggcgcctgcaccaagtacgagtacccctggcacacggccaagtgccacttcgagcgcgacttcgagtacgagaacagctgggggtgcaaccccgcggactgccccggcatcggcacggggtgcaccgcctgcggcctctacatcgaccagctgaagccggtggggtccgcctacaagctgatcaccgtgcggtacagccgcaaggtctgtgtgcagttcggcgaggagaacctctgtaagacgatcgacatgaacgactgcttcgtgacacggcacgtcaaggtgtgcatcatcgggaccgtgtccaagttcagccagggcgacaccctggttttcctgggccccatggtcgggggcgggctcatcttcaaggactggtgcacctccacgtgccagttcggagaccccggggacatcatgagccccaaggacaagggcttctcctgcccggacttcaccggccacttccgcaagaaatgcaacttcgccaccacccctgtgtgcgagtacgacgggaacatggtgagcggctataagaaggtgatggccaccatcgacagcttccagtccttcaacaccagctccatccactacaccgacgagcggatcgagtggaaggaccccgacgggatgctgaaggaccacctgaacatcctcgtgacgaaggacatcgacttcgagaacctgggcgagaacccctgcaaggtcgggcttcagacctcatccatcgagggcgcgtggggcagcggggtgggcttcaccctgacctgccagatctctctcacagagtgctctcgcttcctgacctccatcaaggcctgcgacatggccatctgctacggggcccagagcgtgaccctcatccggggccagaacacagtcaaggtgtccgggaagggcggccacagcgggtccagcttcaagtgctgccacggcacggactgctcccagcaggggctgcaggcgagcgcaccgcacctggacaaggtgaacggcatcgtcgagcaggactcagagaaggtgtacgacgacggcgcgccccagtgcgggatcagctgctggttcgtgaagtccggcgagtggatcaccgggatcttcaacggcaactggatcgtcattgtggtgctcgtcttcttcttcatcctgagcctgatcctcctgagcctgctctgccccatccgcaaacacaagcggtcctga

SEQ ID NO: 14950 - RNA, 3408 nt, synthetic construct
  misc_feature 1..3408: note = derived and/or modified CDS sequence (opt11) from DOBV(Aa1854/Lipetsk-02)__EU188453.1__GP
  source 1..3408: mol_type = other RNA
atgatcatgtggggcctgctcctgaccatggccctgatcaaccccggggccaccctccgcaacgtgtacgacatgcggatcgagtgcccccacagcatcaacttcggcgagtccagcgtcacggggaaggtggagctgccgcccatcccactggccgacgccgagaccctcgtgccagaatccagctgcaacatggacaaccaccagtccctgagcatcacccagaaagtcaccaaggtttcctggcgcaagaaggccgataaggtgcaggccgccaaggacagcttcgagacgacctccagcgagatcaacctgaaggggacctgcaccctcacgcaccggatggtcgaggagtcctaccgcaaccgcaagagcgtgatctgctacgacctgtcctgcaacagcacccattgcaagcccaccatgcacatgatcgtgcccgtccactcctgcaacatgatgaagtcctgcctggtgggcctcggcccctaccggatccaggtggtctacgagcgaacctactgcacgaccggcatcctgaccgaggggaagtgcttcgtcccggaccagagcatagtgagcgtcatcaagaacggcgtattcgacatcgcctccgtgagcatcgtctgcttcttcatccgcataaaggggaacagctacaagataatggcctccatcaaggaggccaaccccaacaactgcaacgacaccgacaacaaggtgcaaggctactacctgtgcatcgtgggggccaacagctcccccgtctacgcgcccagcacgaccgacttccggtccgtggaggccctcgccagcctgctgcgctcccctcacggcgaggaccacgacctcagcggcgaggaggtggccacctactccatcgcagggcaggtcgagggcaaggtgccccacaccgcgaacgccgcgaacatgctgttcactgccttctcagggatcccctcccacagctccttcagcgtctttaccggcaaccaggacggcaccgttatctactcccccgggttattcccgaagctcaatcagagcgcatgtgacaaggtggcgctgcctttaatctgggaaggctacatcgacctccccgggtactacgagacaatccacccctgcaacgtcttctgcgtcctgagcggcccgggggcctcctgcgaggccttctccgagggcggaatcttcaacatcacgagccctacctgcctggtatccaagcagaaccggttccgcgctgccgagcagcagatcaacttcgtctgccagcgggtggaccaagacatcgtgatctactgcaacgggcagaagaaaaccatcttaaccaagacgctggtcatcggccagtgcatctactccgtgaccagcctgttctccatcatgcccggggtggcgcacagcatcgccatcgagctctgcgtacccggtttccacgggtgggccaccgccgccctgctgaccacgttctgcttcggctggattctcataccctccatcaccctggcgatcctgatcgtgctcaagttcttcgccgccatcctgcataacagctcccaggagaacaggttcaagatcatcctgcgcaagatcaaggaggaatttgagcgcaccaagggcagcatggtgtgcgaggtctgcaagtacgagtgtgagaccgggaaggagctcaaggcccacaacctgtcctgcccccagagccagtgcccctactgcttcacacactgcgagctgaccgagtccgcgttccaggcccactaccgggtgtgccaagccacccaccgcttccgggacgacctcaagaagacgatcacgccccagagcacctccccgggctgctaccgcaccctgaacctgttccgatacaaaagccgctgctacatcttcaccgtgtgggtcgtgctcctgatcatcgagtccatcctgtgggccgccagcgcgtccgagaccgtgctcgagcccaactggaacgacaacgcccacggggtcggcgtggtacctatgcacacagacctagagctggacttcagcctgccgtcttcgagcaagtacacctataagcgcaagctcacctcccccatcaaccaggagcagagcgtcgatctgcatatcgaggtggagtcccaggggattagcacctccgtgcacgccctgggccactggttcgacggccggctcaatctaaagacgagcttccactgctacggggcctgcaccaagtacgagtacccctggcacaccgcgcgctgccacttcgagcgggacttcgagtacgagaactcctggagctgcaaccccgcggactgcccgggcatcgggacaggctgcacggcctgcggcctttacctcgaccagctgaagccagtcggctccgcctacaagttaatcaccgtgcggtacagccggcgcgtgtgtgtccagttcggcgaggaaaacctctgcaagaccatcgacatgaacgattgcttcgtgacccggcatgtgaaggtctgcatcatcgggacggtgtccaagttcagccagggcgacaccctggtgttcctggggcccatggagggtggcggcctaatctttaaggactggtgcaccaccacgtgccagttcggcgaccccggggacatcatgagcccgaaggacaagggattcagctgccccgacttcaccgggcactttcgcaagaagtgcaacttcgcgaccacacccgtctgcgagtacgacgggaacatggtatccggctacaagaaggtgatggccacgatagacagcttccaggcgttcaacacctccaacatccactacaccgacgagcgcatcgagtggaaggaccccgacgggatgctgaaagaccacctgaacatcctcgtcaccaaggacatcgacttcgaaaacctgggggagaatccgtgcaaggtggggctacagacggccagtatcgagggcgcctgggggagcggcgtgggcttcaccctgacctgtcagatctccctcactgagtgcagccggttcctgacttccatcaaggcctgcgacatggcgatttgctacggggcccagagcgtcaccctcgtgcggggccagaataccgtgaaggtatccgggaagggcgggcacagcggaagctcattcaagtgctgccacggcaccgactgctcccagcaggggctgcaggccagcgctccgcacctggacaaagtgaacggcattgttgagcaggagtccacgcaggtttacgacgacggggcgccccagtgcggcatcagctgctggttcatcaagtcaggcgaatggatcaaggggatctttaacggcaattggatcgtgatcgtggtcctcatcttcttctttatcctgagccttatcctcttgtccttcctgtgccccatccgcaagcacaagcggagctag

SEQ ID NO: 14951 - RNA, 3402 nt, synthetic construct
  misc_feature 1..3402: note = derived and/or modified CDS sequence (opt11) from DOBV(Ap/Sochi/hu)__JF920149.1__GP
  source 1..3402: mol_type = other RNA
atgtggggcttgctcctgactatgatcctgatagacttcggagcgaccctccgcaacgtgtacgacatgcggatagaatgcccccatagcgtcaacttcggagaatccagcgtgtccgggaaggtggagctgccacccgtcctgctctcagaggttgagacgctggtgcccgagtccagctgcaacatggacaaccaccagtccatgagcatcatccagaaggtcacccagctgacatggcgcaagaaggccgacaaggcccaggccgcaaaggactccttcgagatcaccagcggcgaggtgagcctgaaggggacgtgcaccctgacccaccgaatggtagaggacagccaccgcaaccggaagtccatcatctgctacgacctgagctgcaactccacccactgcaagcccacgatgcacatgatcgttcccatccacagctgcaacatgatgaagtcctgcctcgtgggcctaggcccctaccgcatccaggtagtctacgagcggacctactgcaccaccgggatcctgacggagggcaagtgcttcgtgcccgaccaaagcatcgttaacgtaatcaagaatggcgtgttcgatatcgccagcgtgagcatcgtctgcttcttcgtgcgggtaaagggcaccaactacaagatcatggccagcatcaagacggcgacttccaataactgcaacgacacggggaacaaggtccaaggctactacctctgcatcgtgggcgggaacagcagccccgtgtacgtcccgagcaccaccgacttccgtagcatggaggccctggccagtatgctgcgcgctccccatggcgaggaccacgacctcgcgggagaggaagtggcgacctactccatcgccggccaagtcgagggcaaggtgccccacacggcatccaccgccaacatgctgctgaccgcgttctccggaatccccagctactcctcactctccgtcttcaccggcagccaggacggaccaatcgtctactcccccggcctattccctaagctgaaccagagctcctgcgacaaggtggggctcccactgatctgggagggctacattgacctgccgggctactacgagacagtgcaccagtgcaacgtcttctgcgtgctcagtgggcccggggcctcctgtgaggccttcagcgagggcgggatcttcaacatcaccagccccaactgcatggtgtccaagcagaaccggttccgcgccgccgagcagcaggtcaacttcgcgtgccagcgggtggaccaggacatcttgatattctgtaacggtcagaagaagaccatcttaaccaagacgctcgtgatcggtcagtgcatatacagcatcacatccctgttcagcatcatgcccggcgtcgcccactccatagccatcgagttgtgcgtgccggggttccacggctgggccaccgccgctctcctgaccaccttctgcttcgggtgggtgctgatccccagcatcactctcgccgtactggtggtgctaaagttctttgccgccattctccataattccagccaggagaaccgctttaagctgatcctgaaaaagatcaaggaggagttcgaaaagaccaagggctccatggtctgcgaggtgtgcaagtacgagtgcgaaaccgggaaggagctcaaggcccacaacctgagctgccctcaatcccagtgcccctactgcttcacgcactgtgagccgaccgagagtgcgttccaggcccactacaaggtgtgccaggccacccaccggtttcgggacgacttaaagaagaccatcactccgcagtccaccagccccggctgctaccggacgctcaacctgtttcgctacaagtccaggtgctacatcttcaccgtctgggtggtgctgctggtcgtggagagcgttatgtgggcagcatctgcctcggagaccgtcttagagcccagctggaatgacaatgcccacggcgttggggtggtcccgatgcacacggacctggagctggacttctccttgccctcatccagtaagtacacctacaagcgcaagctgacctcccccatcaaccaggagcagagcgtggacctgcacatcgagatcgagtcacaggggatcagcacgtctgtgcacgccctcggacactggttcgacggccggctgaaccttaagacgagctttcactgctacggtgcctgcaccaagtacgagtacccgtggcacaccgcgcgctgccacttcgagcgcgatttcgagtatgagaactcatgggggtgcaatcccgccgactgccccggaataggtaccggctgcacggcctgcgggatctacatagaccagctcaagcccgtcggcagcgcgtacaagctgatcaccgtgagatactcccgcaaggtgtgcgtccagttcggcgaagagaacctgtgcaagactatcgacatgaacgactgcttcgtgacgcgtcatgtgaaagtctgtataatcggcaccgtgagcaagttctcccagggcgataccctcgtgttcctagggccgatggagggcggaggcctgatcttcaaggactggtgcacctctacatgccagttcggcgatcccggggacatcatgtcccctaaggacaagggctttagctgccccgagttcaccgggcacttccgcaagaagtgcaattttgccaccaccccggtctgcgagtacgacggcaacatggtgtccgggtacaagaaggtgatggcgaccatcgacagcttccaggccttcaatacctcctccatccactacacggatgagcggatcgagtggaaggaccccgacggcatgctcaaggaccatctgaacatcctggtcaccaaggacatcgacttcgagaacctaggcgataacccctgcaaggtggggctgcagaccgtgagcatcgagggcgcctgggggtccggagtcggttttacgctgacctgccaggtgagtctcacagagtgctcccgtttcctgaccagcatcaaggcctgcgacaaggccatctgttacggtgcgcaatcctcaactctgatccggggtcagaacaccgtgaaggtctccgggaagggagggcacagcgggtccagcttcaagtgctgccacggcacggactgctcccagcaggggctccaagccagcgcgccccacctcgacaagatcaacggcatcgtggagcaggagaacgagaaggtctacgacgacggggcgccacagtgcggcatctcctgctggtttgtcaaaagcggagagtggatccagggaatcttcaacgggaactggattgtgatcgtggtgctgatcttcttcttcatcctctccctgatcttactctcgatcttctgccccatccgcaagcacaagcggtcctga

SEQ ID NO: 14952 - RNA, 3402 nt, synthetic construct
  misc_feature 1..3402: note = derived and/or modified CDS sequence (opt11) from DOBV(Ap1584/Sochi-01)__EU188450.1__GP
  source 1..3402: mol_type = other RNA
atgtggggcctgctcctgaccatgatcttaatcgacttcggggccaccctccgcaacgtgtacgacatgcggatcgagtgcccccacagcgtcaacttcggcgagtccagcgtgtccgggaaggtggagctgccacccgtcctgctcagcgaggtggagacgctggtgcccgagtccagctgcaacatggacaaccaccagtccatgagcatcatccagaaggtcacccagctgacgtggcgcaagaaggccgacaaggcgcaggccgccaaggactccttcgagatcaccagcggcgaggtgagtctcaaggggacgtgcaccctgacccaccggatggtggaggacagccaccgcaaccggaagtccatcatctgctacgacctgagctgcaattccacccactgcaagcccacaatgcacatgatcgtcccgatccacagctgcaacatgatgaagtcctgcctcgtgggcctgggcccttaccgcatccaggtggtctatgagcggacctactgcaccaccgggatcctgacggagggcaagtgcttcgtgcccgaccagagcatcgtgaacgtcatcaagaacggggtcttcgacatcgccagcgtgagcatcgtctgcttcttcgtgcgcgtgaagggcaccaactacaagatcatggccagcataaagaccgctacctccaacaactgcaacgacaccgggaacaaggtccagggctactacctctgtatcgtgggcgggaacagctcccccgtgtacgtcccgtcgaccaccgacttccggtctatggaggccctggccagcatgctgcgcgcgccccacggcgaggaccacgacctcgccggagaagaggtggccacctactccatcgccggacaggtcgagggcaaggtgccccacacggccaacgccgcgaacatgctgctgacagccttcagcggggtgccctcctacagctccctcagcgtcttcaccggctcccaggacgggccgatcgtgtacagccccggtctgttccccaagttaaaccaatccagctgcgacaaggtggggctccccctgatctgggagggctacatcgacctgccgggctactacgagaccgtccaccagtgcaacgtgttctgcgtgctctccgggcccggagccagctgcgaggccttctccgagggtgggatcttcaacatcacgagccccaactgcatggtaagcaagcagaaccggttccgcgcagcggagcagcaggtcaacttcgcctgccagtccgtggaccaggatatcctgatcttctgcaacgggcagaagaagaccatcctgaccaagaccctcgtgatcggccagtgcatctaccccatcacgagcctgttctccatcatgccgggcgtggcccacagcatcgccatagagctctgcgtgcccgggttccacggctgggccaccgcggccctcctgaccaccttctgcttcggctgggtcctgatcccctccatcacgctcgccgtgctggtggtcctgaagttcttcgccgccatcctccacaacagctcgcaggagaaccggttcaagctgatcctgaagaagatcaaggaggagttcgagaagaccaagggctctatggtgtgcgaggtgtgtaagtacgagtgcgagaccgggaaggagctcaaggcgcacaacctgtcctgcccccagagccagtgcccgtactgcttcacccactgcgagcccacggagtccgccttccaggcccactacaaggtctgccaggccacccaccgcttccgggacgacctgaagaagaccatcacgccccagagcacctcccccggctgctaccgcaccctcaacctgttccggtacaagagccgctgctacatcttcaccgtgtgggtggtcctgcttgtggtggagtccgtgatgtgggcggccagcgcctccgagaccgtgctggagccgagctggaacgacaacgcccacggcgtgggggtcgtgcccatgcacaccgatctggagctggacttcagcctcccctccagctccaagtacacgtacaagcggaagctgaccagcccgatcaaccaggagcagtccgtggacctgcacatcgagatcgagtcgcagggcatctccaccagcgtccacgccctcgggcactggttcgacggccgcctgaacctgaagacgtccttccactgctacggcgcgtgcacgaagtacgagtacccctggcacaccgcccggtgccacttcgagagagacttcgagtacgagaacagctgggggtgcaaccccgccgactgccccggcatcgggaccggctgcaccgcctgcgggatctacatcgaccagctcaagccggtgggctccgcctacaagctgatcacggtacgctacagccggaaggtctgcgtgcagttcggcgaggagaacctgtgcaagaccatcgacatgaacgactgcttcgtgaccagacacgtcaaggtgtgcatcatcgggaccgtgtccaagttcagccagggggacacgctcgtgttcctggggcccatggagggcggaggcctgatcttcaaggactggtgcacctccacgtgccagttcggagaccccggggacatcatgagccccaaggacaagggcttctcctgcccggagttcaccgggcatttcaggaagaagtgcaacttcgcgaccacccccgtgtgcgagtacgacggcaacatggtgagcggctacaagaaagtcatggccaccatcgactccttccaggccttcaacacctcgagcatccactacacggacgagcgcatcgagtggaaggaccccgacggcatgctcaaggaccacctcaacatcttagtgaccaaggacatcgacttcgagaacctcggcgactccccttgcaaggtggggctgcagaccgtctccatcgaaggcgcttgggggtccggcgtgggattcaccctcacgtgccaggtgagcctcaccgagtgctcccggtttctgaccagcatcaaggcctgcgacaaggcaatctgctacggcgcccaatccagcaccctgatccgcggccagaacacggtcaaggtgtccgggaagggcgggcacagcggctccagcttcaagtgctgccacggcaccgactgctcccagcaggggctccaggccagcgccccgcacctggacaagatcaacggaatcgtcgagcaggagaatgagaaggtgtacgacgacggggcgcctcagtgcggcatctcctgctggttcgtcaagagcggggaatggatccagggcatcttcaacggcaactggatcgtgatcgtggtactgatcttcttcttcatcttgtccctgatcctgctctcaatcttctgccccattcggaagcacaagcgctcctaa

SEQ ID NO: 14953 - RNA, 3408 nt, synthetic construct
  misc_feature 1..3408: note = derived and/or modified CDS sequence (opt11) from DOBV(GER/05/477/Af)__GQ205411.1__GP
  source 1..3408: mol_type = other RNA
atgatcatgtggggcctgctcttaaccctgagcctcatcaacctgggggcctccctgcgcaacgtgtacgacatgaagatcgagtgcccgcatagcatcaacttcggcgagtccagcgtcaccgggaaggtggagctcccgcccctgctgctcacggacgccgaggccctggtgcccgagtccagctgcaacatggacaaccaccagtccctgagcatcacccagaaggtcaccaaggtgtcctggcggaaaaaggccgacaaggtgcaggccgccaaagacagcttcgagaccacgtccagcgaggtcaacttcaaggggacctgcaccctcacccaccgcatggtggaggagtcctaccggaaccgcaagagcgtgatctgttacgacctgtcctgcaacagcacgcactgcaagcccaccatgcacatgatcgtcccggtgcactcctgcaacatgatgaagtcctgcctggtggggctcggcccctaccgcattcaggtcgtgtacgagagaacctactgcaccacgggcatcctgaccgaggggaagtgcttcgtgccagaccagtccatcatcagcgtcctgaagaacggcgtgttcgacatcgccagcgtgtccatagtctgcttcttcatccggatcaaggggaccagctataagatcatgacctccatcaaggaggcgaaccccaacaattgcaacgacacggacaataaggtgcagggctactatctctgcatcgtgggggccaacagctccccggtttacgcccccagcaccaccgacttccgctccgtggaggccctggcgagcctgctccggagcccccacggcgaggaccacgacctggccggcgaggaggtggccacctacagcatcgccgggcaggtcgaggggaaggtgccccacacggccaacgcggccaacatgctgttcaccgccttctccgggatcccgagctactccagcttctccgtctttaccggcaaccaggagggcaacgtgatctacagccccggcctcttccccaagctgaaccagtccagctgcgagaaggtggccctgcccctcatctgggagggctacatcgacctgccggggtactacgagaccgtccacccctgcaacgtgttctgcgtgctgtccggccccggggccagctgcgaggcgttcagcgagggcggcatcttcaacatcacgtccccgacctgcctcgtcagcaagcagaaccgcttccgggcagcagagcagcagatcaacttcgtgtgccagcgcgtggaccaggacatcgtcatctactgcaacgggcagaagaagactatcctgaccaaaacgctggtgatcgggcagtgcatctactccgtgaccagcctcttctccatcatgcccggtgtcgcccacagcatcgccatcgagctgtgcgtccccggcttccacgggtgggcgacagccgccctgctcaccacgttctgcttcggctggatcctgatcccctccattaccctggccatcctcatcatccttaagttcttcgccgcgctattccacaacagctcccaggagaaccggttcaagatcatcctcaagaaaatcaaggaggagttcgagaagaccaagggcagcatggtgtgcgaggtatgcaagtacgagtgcgagaccgggaaggagctgaaggcccacaacctgtcctgcccccagagccagtgcccttactgcttcacgcactgcgagctcaccgagtccgccttccaggcccactaccgcgtgtgccaggcgacccatcgcttcagagacgacctgaagaagaccatcacgccccagagcacgtcccccggctgctaccggaccctgaacctcttccgctacaagagccggtgctacatcttcaccgtgtgggtcatcctgctgatcatcgagtccatcctgtgggccgccagcgccagcgagaccgtgctcgagccctcctggaacgacaacgcccacggggtgggcgtcgtgccaatgcacacggacctggagctggacttcagcctcccatccagctccaagtacacctacaagcgcaagctgaccagccccatcaaccaggagcagtccgtggacctgcacatcgagatcgagagccaggggatctccaccagcgtccacgcgctcggccactggttcgacggccggctgaacctaaagacgtccttccactgctacggggcctgcaccaagtacgagtacccgtggcacaccgccaagtgccacttcgagcgcgacttcgagtacgagaacagctggtcctgcaaccccgccgactgccccggcatcgggaccggctgcacggcctgtggcctttacctggaccagctcaagcccgtcgggagcgcctacaagctcatcaccgtgcgctactcgcggaaggtctgcgtgcagttcggcgaggagaacctgtgcaaaaccatcgacatgaacgactgcttcgtgacccgccacgtcaaggtgtgcatcatcgggacggtgagcaagttctcccagggcgacaccctggtcttcctcgggccgatggagggcggcgggctgatcttcaaggactggtgcaccaccacgtgccagttcggcgaccccggggatatcatgagtcccaaggataagggcttctcctgccccgactttaccgggcacttccggaagaagtgcaacttcgccaccaccccggtgtgcgagtacgacggcaacatggtgagcggctacaagaaggtcatggccacgattgacagcttccaggccttcaacacctccaacatccactacaccgacgagcgcatcgagtggaaggaccccgacgggatgctgaaggaccacctcaacatcctggtgaccaaagacatcgacttcgagaacctgggcgagaacccctgcaaggtggggctccagacggccagcatcgacggcgcgtgggggtccggcgttggattcaccctgacctgccagatcagccttaccgagtgctcccggttcctcacgagcatcaaggcctgcgacatggccatctgctacggggcccagtccgtgaccctggtccggggccagaacaccgtccgggtgagcgggaagggcgggcactccggcagctcctttaagtgctgccatggcactgactgcagccagcaggggctgcaggcgtccgcgccccacctcgacaaggtgaacggcatcgtcgagcaggagagcacccaggtgtacgacgacggggccccgcagtgcggaatctcctgctggttcgtcaaaagcggcgagtggatcaaggggatctttaacggcaactggatcgtgatagttgtgctgatcttcctgttcctcctgtccctgatcctcctgagcttcctgtgccccatccgcaagcacaagcggtcctga

SEQ ID NO: 14954 - RNA, 3408 nt, synthetic construct
  misc_feature 1..3408: note = derived and/or modified CDS sequence (opt11) from DOBV(GER/07/607/Af)__GQ205410.1__GP
  source 1..3408: mol_type = other RNA
atgatcatgtggggcctgctcgtgaccttaagcctgatcaacctcggggcctccctgcgcaacgtctacgatatgaagatcgagtgcccccacagcatcaacttcggcgagtccagcgtgaccgggaaggtggagctgccgcccctccccctgacggacgccgagaccctggtccccgagtcctcgtgcaacatggacaaccaccagtccctcagcatcacccagaaggtgaccaaggtgtcctggcggaagaaggccgacaaggtccaggccgccaaggacagcttcgagacgacctccagcgagatgaacctgaaggggacctgcaccctgacgcaccgcatggtggaggagtcctaccggaaccgcaagagcgtgatctgctacgacctctcctgcaacagcacccactgcaagccgaccatgcatatgatcgtcccggtgcactcctgcaacatgatgaagtcctgcctggtgggcctgggcccctaccggatccaggtcgtgtacgagcgcacctactgcacgaccggcatcctcaccgaggggaagtgcttcgtgcccgaccagtccatcatcagcgtcatgaaaaacggcgtgttcgacatcgccagcgtgtccatcgtctgcttcttcatccggatcaaggggaccagctacaagatcatgacgtcaatcaaggaggccaacccgaacaactgcaacgacaccgacaccaaggtgcagggctactacctgtgcatcgtgggggcgaacagctcccccgtctatgcacccagcaccacggacttccgcagtgtggaggctctggccagcctcctgcggagcccccacggcgaggaccacgatctggcgggcgaggaggtcgccacctacagcattgccgggcaggtagagggcaaggtgccgcacaccgcgaacgccgcgaacatgctgttcaccgccttctccgggatccccagctactccagcttctccgtcttcacgggcaaccaggacggcaccgtgatctacagcccaggcctcttccccaagctgaaccagtccagctgcgacaaggtggccctcccgctaatctgggaggggtacatcgacctgcccgggtactacgagaccgtccacccctgcaacgtgttttgcgtgctctccggccctggggccagctgcgaggccttcagcgagggcggcatcttcaacatcacctccccgacgtgcctggtcagcaagcagaaccgcttccgggcggccgagcagcagattaacttcgtgtgccagcgcgtggaccaggacatcgtcatctactgcaatgggcagaagaagaccatcctaaccaagaccctcgtgatcggccagtgcatctactccgtgacgagcctgttttccatcatgcccggggtcgcacacagcatcgccatcgagctgtgcgtgcccggcttccacgggtgggccaccgcggcactgctgaccaccttctgcttcggctggatcctgatcccctccatcacgctcgccatcctgatcgtgctgaagttcttcgccgcactcctgcacaacagctcccaggagaaccggttcaagatcatcttaaagaagatcaaggaggagtttgagaaaaccaagggcagcatggtctgcgaggtgtgcaagtacgagtgcgaaaccgggaaggagctcaaggctcacaacctgtcctgcccgcagagccagtgcccctactgcttcacccactgcgagctgaccgagtccgccttccaggcccactaccgcgtgtgccaggccacgcaccggttccgcgacgacctcaagaagaccatcacgccccagagcacctcccccggctgctaccggaccctgaacctgttccgctacaagagccggtgctacatcttcaccgtctgggtgatcctcctgattatcgagtccatcctgtgggcggccagcgccagcgaaaccgtgctggagccgtcctggaacgacaatgcccacggggtcggcgtggtgcctatgcacgccgacctcgagctggacttcagcctgccctccagctccaagtacacctacaagcgcaagctcacaagcccgataaaccaagagcaatccgtcgacctgcacatcgagatcgagagccaggggatctccaccagcgtgcacgcgctgggccactggttcgacggccggctcaacctgaagacctccttccactgctacggggcctgcaccaagtacgagtacccctggcacacggccaagtgccacttcgagcgcgacttcgagtacgagaacagctggtcctgcaaccccgccgactgccccggcatagggaccggctgcaccgcttgcggcctgtacctcgaccagctgaagcccgtggggagcgcgtacaagctgatcaccgtccggtactcccggaaggtgtgcgtgcagttcggcgaggagaacctctgcaagacgatcgatatgaacgactgcttcgtcacccgccacgtgaaggtgtgcatcatcggaaccgtcagcaagttctcccagggcgacaccctggtgttcctggggcccatggagggcggcgggctcatcttcaaggactggtgcacgacgacctgccagttcggggaccccggggacatcatgagccccaaggacaagggcttctcctgcccggacttcaccgggcacttccggaagaagtgcaacttcgccaccacccccgtgtgcgagtacgacggcaacatggtcagcggatacaagaaggtgatggccaccatcgacagcttccaggccttcaacaccagtaacatccactacacggacgagaggatcgagtggaaggaccccgacggaatgctgaaggaccacctgaacattctcgtgaccaaggacatcgacttcgagaacctgggcgagaacccctgcaaggtcgggctgcagaccgccagcatcgacggcgcgtgggggtccggcgtgggcttcaccctcacgtgccagatcagcctgaccgagtgctcccgattcctgaccagcatcaaggcctgcgacatggccatctgctacggggcccagtccgtgaccctcgtccgcggccagaacacggtgaaggtgagcgggaagggcgggcactccggcagctccttcaagtgctgccacggcaccgactgcagccagcaggggctgcaggcgtccgccccgcacctggacaaggtcaacggcatcgtggagcaggagagcacccaggtgtacgacgacggggcgccccagtgtggcatctcctgctggttcgtcaagagcggcgagtggatcaaggggatcttctccggcaactggatcgtgatcgtggtcctcatcttcctgttcctgctcagcctgatcctgctctccttcctgtgccccatccggaagcacaagcgcagctga

SEQ ID NO: 14955 - RNA, 3408 nt, synthetic construct
  misc_feature 1..3408: note = derived and/or modified CDS sequence (opt11) from DOBV(GER/08/118/Aa)__GQ205412.1__GP
  source 1..3408: mol_type = other RNA
atgatcatgtggggactgctcgtaatcctgagcctgattaatcttggggcctccctgcgcaacgtctacgacatgaagatcgagtgcccccacagcatcaactttggcgagtccagcgtgaccgggaaggtggagctgccgcccctccccctgaccgacgccgagacgctggttcccgagtccagctgcaacatggacaaccaccagtccctcagcatcacccagaaggtgaccaaggtctcctggcggaagaaggcggacaaggtccaggccgcgaaagactcattcgaaaccacgtccagtgagattaacctgaaggggacctgcaccctgactcaccgcatggtggaggagtcctaccggaaccgcaagagcgtaatctgctacgacctctcctgcaacagcacgcactgcaaaccgaccatgcacatgatcgtccccgtgcactcctgcaacatgatgaagtcctgcctggtaggcctgggcccctaccggatccaggtggtgtacgagcgcacctactgcaccacgggcatcctcactgaggggaagtgcttcgttcccgaccagtccatcatcagcgtcatgaagaacggcgtgttcgacatcgccagcgtgtccatcgtctgcttcttcatccggataaaggggaccagctacaagattatgacttccatcaaggaggccaacccgaacaactgcaatgacacagacaacaaagtgcagggctactacttatgcatagtgggggcgaacagctcccccgtgtacgcgcccagcaccaccgacttccgatccgtggaggccctggccagcctccttcggagcccccacggcgaggaccatgacctggcgggcgaggaggtggccacctacagcatcgccgggcaggtcgacggcaaggtgccgcacacggccaacgccgcgaacatgctgtttaccgccttctccgggatcccaagctactccagcttctccgtcttcaccggtaaccaagacggcacagtgatctacagccccggcctcttccccaaactgaatcagtcctcttgcgacaaggtggccctcccgctgatctgggaggggtacatcgacctgcccgggtactacgagacggtccacccctgcaacgtgttctgcgtgctctccgggcccggtgccagctgcgaggccttcagcgaagggggcatcttcaacatcacctccccgacctgtctggtcagcaaacagaaccgcttcagagcggccgagcagcagatcaactttgtgtgccagcgcgtggaccaggacatcgtcatctactgcaatgggcagaaaaagaccatactgacgaagaccctggtgatcggccagtgcatctactccgtgaccagcctgttctccatcatgcccggggtcgcccacagcatcgccatcgaactgtgcgtgcccggcttccacgggtgggccaccgctgccctcctgacgacattctgcttcggctggatcctgatcccctccataaccctcgccatcctgatagttctgaagttcttcgccgccctcctgcacaacagctcccaggaaaaccggttcaagatcatcctgaagaagattaaggaggagttcgagaagaccaagggcagcatggtctgcgaggtgtgcaagtacgagtgcgagacggggaaggagctcaaagcgcacaatctgtcctgcccgcagagccagtgcccctactgcttcacccactgtgagctgaccgagtccgccttccaggcccactaccgcgtgtgccaggccacccaccgtttccgcgacgacctcaaaaagaccatcacgccccagagcacatcccccggctgctaccggaccctgaacctgttccgctacaagagcagatgttacatattcaccgtctgggtgatcctcctgatcatcgagtccatcttatgggcggccagcgccagcgagacgatcctggagccctcctggaatgacaacgcccacggggtgggcgtcgtgcccatgcacacagacctcgagctagacttcagcctgccctcctcttccaaatacacctataagcgcaagctcaccagcccgatcaaccaggagcagtccgtggacctgcacatagagatcgaaagccaagggatctccacgagcgtacatgccctcggccactggtttgatggccggctcaacctgaagacctcctttcactgctacggggcatgcaccaagtacgagtacccctggcacactgccaaatgccacttcgaacgcgactttgaatacgagaacagctggtcctgcaaccccgccgactgccccggcatcgggacgggctgcaccgcttgcggcctgtacctcgaccagctgaagccggtggggagcgcctacaagctgatcaccgtgcgctactcccggaaggtctgcgtgcagtttggcgaggagaatctctgtaagaccatagacatgaacgactgtttcgtgacgcgccacgtcaaggtgtgcatcatcgggaccgtgagcaagttctcccagggtgacaccctggtcttcctggggcccatggagggcggcggattaatcttcaaggactggtgcaccacgacatgtcagttcggtgaccccggggacatcatgagccccaaggacaagggcttctcctgcccggacttcaccggtcatttccggaagaagtgcaacttcgcgaccacgcccgtgtgcgagtacgacggcaacatggtgagcggctacaagaaggtcatggccacgatcgactcgttccaagccttcaacacctccaacatccactacaccgacgagcgcatcgagtgggaggaccccgatgggatgctgaaggaccacctgaacattctcgtgacgaaagatatcgacttcgagaacctgggcgagaacccctgcaaagtggggctgcagaccgccagcatcgacggcgcctggggctccggcgtaggcttcaccctgacctgccagattagtctcacggagtgctcccggttcctgaccagcatcaaggcgtgcgacatggccatctgttacggggcccagtccgtgaccctagtgcgcggccagaacaccgtcaaggtgagcggtaagggcgggcactccggcagctcatttaagtgctgccacggcacggattgcagccaacaggggctgcaggcatccgcgccgcacctggataaggtgaacggcatcgtcgagcaggagagcacacaggtgtacgacgacggcgcgcctcagtgcggtatctcctgctggttcgtcaagagcggggagtggatcaagggggtgttctccggcaactggatcgtgatcgtggtcctcatcttcctgttcttactcagcttaatcctgctctccttcttgtgccccatccggaaacataagcgcagctga

SEQ ID NO: 14956 - RNA, 3408 nt, synthetic construct
  misc_feature 1..3408: note = derived and/or modified CDS sequence (opt11) from DOBV(GER/08/131/Af)__GQ205413.1__GP
  source 1..3408: mol_type = other RNA
atgatcatgtggggcctgctcctgaccctgagcctcatcaacctgggggcctccctacgcaacgtgtacgacatgaagatcgagtgcccccacagcatcaacttcggcgagtctagcgtcaccggaaaggtggagcttccgcccctgctgctcacggacgccgagaccctggttcccgagtccagctgcaacatggacaaccaccagtccctgagcatcacccagaaagtcaccaaagtgtcctggcggaagaaggcggacaaggtgcaggccgccaaggacagcttcgagacgacctccagcgaggtcaacctcaaggggacctgcaccttaacgcaccgcatggtggaggagtcctatcggagccgcaagtccgtgatctgctacgacctgtcatgcaactccacccactgcaagcccaccatgcacatgatcgtcccggtgcatagctgcaacatgatgaagtcctgcctcgtggggctgggcccctaccggatccaggtcgtctacgagcgcacctactgcacgaccggcatcctgaccgaggggaagtgcttcgtgcccgaccagagcatcatcagcgtcatcaagaatggcgtgttcgacatcgcctccgtatcaatcgtctgcttcttcatccggatcaaggggacctcctacaagatcatgacgagcatcaaggagtccaaccccaacaactgcaacgacaccgacaacaaggtacagggctactacctctgcatcgtgggggccaacagctccccggtctacgcgcccagcaccaccgacttccgctccgtggaggccctggccagcctgctccgatccccctacggcgaggaccacgacctggccggcgaggaggtggcgacgtacagcatcgcagggcaggtcgagggcaaggtgccccacaccgccaatgccgccaacatgctgttcaccgcgttctccgggatcccgagctactccagcttctccgtcttcaccggcaaccaggacggcaacgtgatctacagccccggcctgttccccaagctgaatcagtccagctgcgagaaggtggccctgcccctcatctgggagggctacatcgacctgccggggtactacgagacggtccacccctgtaacgtgttctgcgtgctgagcggccccggggcctcctgcgaggccttcagcgagggcggcatattcaacatcacgtccccgacctgcctcgtcagcaagcagaaccgctttcgggccgcggagcagcagatcaacttcgtgtgccagcgcgtggatcaggacatcgtgatctactgcaacgggcagaagaagaccatcctgacgaagactctggtgatcggccagtgcatctactccgtgaccagcctcttctccattatgcccggggtggcccacagcatcgccatcgagctgtgcgttcccggcttccacgggtgggccaccgccgcgctgctcacgaccttctgcttcggctggatcctgatcccgtccatcaccctggccatcctcatcgtgctgaagttcttcgccgccctgctccacaacagctcccaagagaaccggttcaagatcatcctgaagaagatcaaggaggagttcgagaagaccaagggcagcatggtttgcgaggtctgcaagtacgagtgcgagacggggaaggagctgaaggcccacaacctatcctgcccccagagccagtgcccgtactgcttcacccactgcgagctgaccgagtccgcgttccaggcccactaccgcgtgtgccaggccacccaccggttccgcgacgacctgaagaagaccatcacgccccagagcacctcccccggctgctaccggaccctcaacctcttccgctacaagagccggtgctacatcttcaccgtctgggtgatcctgctgatcatcgagagcattctctgggccgcgtccgccagcgagatcgtgctggagccctcgtggaacgacaacgcccacggggtcggcgtggtgccgatgcacacggacctggagctcgacttcagcctgccctccagctcaaaatacacctacaagcgcaagctgaccagccccataaaccaggagcagtccgtcgacctccacatcgagatcgagagccaggggatctccacctcagtgcacgccctgggccactggttcgacggccggttaaacctcaagacgtccttccactgctacggggcctgcaccaagtacgaatacccgtggcacaccgcgaagtgccacttcgagcgcgacttcgagtacgagaacagctggtcctgcaaccccgccgactgccccggcatcgggaccggctgcacggcctgcggcctgtacctggaccagctcaagcccgtggggagcgcctacaagctgatcaccgtccgctacagtcggaaggtgtgcgtgcagttcggcgaggagaacctgtgcaagaccatcgacatgaacgactgcttcgtcactcgccacgtgaaggtatgcatcattgggactgtctccaagttctcccagggcgacaccctcgtattcctggggccgatggagggcggcggcctgatcttcaaggactggtgcaccaccacgtgccagttcggcgaccccggggacatcatgtcccccaaggacaagggcttcagctgccccgacttcaccgggcacttccggaagaagtgcaacttcgccactaccccggtgtgcgagtacgacggcaatatggtgtccggctacaagaaggtgatggcgacgatcgattcgttccaggcctttaacacctccaacatccattacaccgacgagcgcatcgagtggaaggacaccgacgggatgctcaaggaccacctgaacatcctggtgacgaaggacatcgacttcgaaaacctcggcgagaacccctgcaaggtcgggctgcagaccgcctccatcgacggcgcctgggggtcaggcgtgggcttcaccctgacctgccagatcagcctcacggagtgcagtcggttcctgaccagcatcaaggcctgcgacatggcgatctgctacggggcccagtccgtgaccctggtccgcggccagaacaccgtgcgggtgagcgggaagggcgggcactccggctcgtccttcaagtgttgccacggcaccgactgcagccaccaggggctccaggcctccgccccgcacctggacaaggtcaacggcattgtggagcaggagagcacccaggtgtacgacgacggtgcgccccagtgcggcatctcctgttggttcgtcaagagcggcgagtggatcaaggggatcttctccggcaactggatcgtgatcgtggtcctgatcttcctcttcctgctgagcctcatcctgctgagcttcctctgccccatccgcaagcacaagcggtcctga

SEQ ID NO: 14957 - RNA, 3408 nt, synthetic construct
  misc_feature 1..3408: note = derived and/or modified CDS sequence (opt11) from DOBV(GRW/Aa)__JQ026205.1__GP
  source 1..3408: mol_type = other RNA
atgatcatgtggggcctgctcctgaccctgagcctcatcaacctgggcgccagtctgcgcaacgtgtacgacatgaagatcgagtgcccccacagcatcaacttcggcgagtccagcgtcaccgggaagggcgaactcccgcccctgctgctcacggacgccgagaccctggtccccgagtccagctgcaatatggacaaccaccagtccctgagtatcacccagaaggtgaccaaggtctcctggcggaagaaggcagacaaggtgcaggccgccaaggacagcttcgagacgacctccagcgaggtgaacctcaaggggacttgcaccctgacgcaccgcatggtcgaggagtcctaccggagccgcaaatcagtgatctgctacgacctgagctgcaactctacccattgcaagcccaccatgcacatgatcgtgccggtccacagctgcaacatgatgaagtcctgcctcgtcggcctgggcccttaccggatccaggtggtctacgagcgcacctactgcacgacagggatcctgaccgagggcaagtgcttcgtgcccgaccagagcatcatcagcgtgatcaagaacggggtcttcgacatcgcctccgtgagcatcgtgtgctttttcatccggatcaaggggacctcctacaagatcatgacgagcatcaaggagtccaaccccaacaactgcaacgacacagacaacaaggtccaggggtactacttgtgcatcgtgggcgccaacagctccccggtttacgcgcccagcaccaccgacttccggtccgtcgaggctctggccagcctgctccggtccccctacggcgaggaccacgacctggccggggaggaggtggcgacttacagcatcgccggccaggtggaagggaaggtcccccacaccgccaacgccgccaacatgctgttcaccgcgttctccggcatcccgagctactccagcttctccgtgttcactggaaaccaggacgggaacgtcatctacagccccggcctctttcccaagctcaaccagtccagctgcgagaaagtcgccctgcccctcatctgggaggggtacatcgacctgccgggctactacgaaacggtgcacccctgcaacgtcttctgcgtgagctccgggcccggcgccagctgtgaggctttctccgaaggcggaatcttcaacatcaccagccccacgtgcctggtgtccaagcagaaccgcttccgggccgcggagcaacagatcaacttcgtctgccagcgcgtggaccaggacatcgtgatttactgcaacggccagaagaagaccatcctcacgaagaccctggtcatcgggcagtgcatctacagcgtgacctccctgttcagcatcatgccgggcgtggctcacagtatagccatcgagctgtgcgtccccgggttccatggctgggccaccgccgcgctgctgacaaccttctgtttcggctggatcctaatccccagcataaccctggctatcctgatcgtgctcaagttcttcgccgccctgctgcacaactccagccaggagaaccggttcaagatcatcctcaagaagatcaaggaggagttcgagaagaccaaggggtccatggtgtgcgaggtctgcaagtacgagtgcgagacgggcaaggagctgaaggcccacaacctgagctgcccccaatcccagtgcccgtactgcttcacccactgcgagctcaccgagagcgcgttccaggcccactatcgcgtgtgccaggccacccaccggttccgcgacgacctgaagaagaccatcacgccccagtccaccagccccgggtgctatcggaccctgaacctcttccgctacaagagccggtgctatatcttcaccgtgtgggtcatccttctgatcatcgagtccatcctgtgggccgcgagcgcctccgagatcgtgctcgagcccagctggaacgacaacgctcacggcgtgggggtcgtgccgatgcacacggacctggagctggacttctccctccccagctccagcaagtacacctacaagaggaagctgacctcccccatcaaccaggagcaaagtgtggacctgcacatcgagatagagtcacagggcatcagcacctccgtccacgccctcggccactggttcgacgggcggctgaacctgaagacgtcgttccactgctacggcgcctgcaccaaatacgagtacccgtggcacaccgcgaagtgccacttcgagcgcgacttcgagtacgagaactcctggagctgcaaccccgccgactgtcccgggatcggcaccggctgcacggcctgcgggctctacctggaccagctgaagcccgtgggctccgcctacaagctcataaccgtacgctacagccggaaggtctgcgtgcagttcggagaagagaacctgtgcaagaccatcgacatgaacgactgcttcgtgacccgccacgtcaaggtgtgcatcatcggcacggtgtccaagttcagccagggggacaccctggtcttcctcggtccgatggagggcgggggcctgatcttcaaggactggtgcaccaccacgtgccagttcggggaccccggcgacatcatgtcacccaaggacaaggggttctcctgcccggacttcaccggccacttccggaagaagtgcaacttcgccaccactccggtgtgcgagtacgacggaaacatggtgagcgggtacaagaaggtcatggcgacgatcgactccttccaggccttcaacacctcgaacatccactacaccgacgagcgcatcgagtggaaggaccccgacggcatgctgaaggaccacctcaacatcttggtgaccaaggacatcgactttgagaacctgggtgagaacccctgcaaggtgggcctccagacggcttccatcgacggggcctggggcagcggcgtcgggttcaccctgacctgccaaatctccctgaccgagtgcagccggttcctcacgtccatcaaggcctgcgacatggcgatctgctacggcgcccagagcgtgaccctggtgcgcgggcagaacaccgtccgggtgtccggcaagggcgggcacagcggctcctccttcaagtgctgccacgggaccgactgctcccaccagggcctgcaggcgagcgcgccccacctcgacaaggtgaacgggatagtagagcaggagtccacccaggtgtacgacgacggcgccccgcagtgcggcatcagctgctggttcattaagtccggggagtggatcaagggcatcttcagcgggaactggatcgtgatcgtcgtgctgatcttcctgttcctcctgagcctgatcctcctctccttcctgtgccccatccgcaagcacaagcggagctga

SEQ ID NO: 14958 - RNA, 3408 nt, synthetic construct
  misc_feature 1..3408: note = derived and/or modified CDS sequence (opt11) from DOBV(Slo/Af-BER)__GU904035.1__GP
  source 1..3408: mol_type = other RNA
atgataatgtggggcttgctcctgaccatgatcctgatcgacttcggggccagcctacggaacgtgtacgacatgaagatcgaatgcccccactccatcaatttcggcgagagctccgtcaccgggaaggtggaactacctcccctactcctgacggacgcggaggccttagtgcccgagagctcctgtaacatggacaaccaccagagcatgtccataatccagaaggtcaccaaagtgtcctggcggaagaaagccgacaaggcccaggcagcgaaggactccttcgagaccacctcgtccgaggtaaacttaaaaggcacgtgcaccctgagccaccgcatggtagaggaatcctaccgaaatcgccgtagcgtgatctgctacgacttgtcctgcaacagcacccactgcaagcccaccatgcacatgatagtgcccgtgcactcctgcaacatgatgaagtcctgcttagtcggactgggaccttatcgcatccaagtggtgtacgagcggacgtattgcacaacaggcatcctcaccgagggcaaatgcttcgtccccgaccagagcatcgttagtgtcatcaagaatggagtattcgacatcgcgtcagtatccatcgtgtgcttcttcattagagtgaaggggacgaactacaagatcatggccagcataaaaaccgcgactgccaacaactgcaacgacactgataacaaggtgcaaggctactacctctgtatcgtcgggggaaattcctcgcccgtgtacgcgccctccacaactgacttccgtagcatggaggccttagcgagcttgctccgcgcaccccacggcgaggaccacgacctgtcaggggaagaggtggccacgtactcgatagccggccagatcgaggggaaaatcccccacaccgctaacgccgccaatatgttattcaccgccttcagcggcattcctagttactctagtctcagcgtattcatcggctctcaggacgggccgatcatatatagccccggcctcttccccaaactgaatcagagtagctgcgacaaggtggccctgcccctaatctgggagggttacatcgacctgccaggctactacgaaacagtccacccctgtaacgtattctgcgtgctttccgggccaggtgccagttgcgaggccttcagcgagggcgggatatttaacatcacctccccaacctgcctggtcagcaaacagaaccggtttcgggcagccgagcagcaggtcaatttcgtgtgccaacgggtggaccaggacatcatcatctactgcaatggccagaagaagacgatcctgaccaagaccttggtaatagggcagtgtatctactccgtgacctcgctattttcaataatgcccggcgtcgcgcacagcatcgccatcgagctgtgtgtgcccgggttccacggttgggctactgccgccctcctgaccacattttgcttcggctggatcctgatcccttccatcactttggcggtcctcgtggtgcttaagttcttcgccgccatcctccacaactcttcacaggagaaccgcttcaagatcatcctgcggaagataaaagaggagttcgagaagacgaaaggaagcatggtgtgcgaagtctgcaagtacgaatgcgagacagggaaggaattgaaggcccacaatctcagttgtccacagagccagtgcccatactgtttcacgcactgcgagcccacggaaagtgcgttccaggcacactacaaggtgtgccaggccacgcaccgctttagagacgacctgaagaagaccattacgccacagtcaacctctccgggctgttaccgcacccttaacctctttcggtacaagagccgctgctatatcttcaccgtctgggtcaccttactgatcatcgagtccatcatgtgggcagcctcagcgagcgagaatgtgctggagccgagctggaacgacaacgcccacggcgttggggtcgtccccatgcacaccgacttagagttagacttcagcctgccctcctcctcgaagtacacgtacaagcgaaagttaacaagcccgttgaaccaagagcagtcagtagacctacacatcgagatcgagagccagggaatttcaacgagcgtgcacgccctgggccactggttcgacgggcgcctgaacctgaagacatccttccactgctacggcgcctgcaccaagtacgagtacccctggcacacggccaagtgccacttcgaacgcgacttcgagtacgagaacagctgggggtgcaatcccgcggattgtcccggtatcggcaccgggtgtacagcgtgtggcctctacatcgaccaactaaagccggtgggttctgcctacaaattaatcaccgtacggtacagccgcaaggtctgtgtgcagttcggcgaggaaaacctctgcaagactatcgacatgaatgactgcttcgtgacccgccacgtcaaagtgtgtatcatcgggaccgtgtccaaatttagccagggcgacaccctggtcttcctaggccccatggagggcggaggcctcatcttcaaggactggtgcacgtccacgtgccagttcggggaccccggggacatcatgagccctaaggacaagggattcagctgcccggactttaccggccacttccgaaagaaatgcaacttcgcgaccaccccggtgtgcgaatatgacgggaacatggtctcgggatacaagaaagtcatggcaaccatagacagctttcagtcattcaacacttcctccattcactataccgacgaacggatagagtggaaagaccccgacgggatgctgaaagaccacctgaatatcctcgtgacgaaagacatcgatttcgagaacctgggggagaacccctgtaaagtcgggctccagacgtcttcgatcgagggcgcgtggggctcgggggtagggtttaccctaacctgccagatctctctcacggagtgtagcaggtttctgacctccatcaaggcctgcgacatggcaatctgctacggagcccaaagcgtgaccctcatccggggccagaacacggtgaaggtgagtgggaagggcggacacagcggttcctcattcaaatgttgtcatggcactgactgctcccagcagggattgcaagcgagcgccccgcacctcgacaaggtgaacggcatcgtggagcaagactcggagaaggtttacgacgacggcgcaccccagtgcggcatctcgtgctggttcgtgaaatcaggagagtggattactgggatcttcaacggaaattggatcgtgatcgtcgttctcgtgttcttcttcatcctgagcctgattctgctcagtcttctctgcccgatccgcaagcacaagcggtcatga

SEQ ID NO: 14959 - RNA, 3408 nt, synthetic construct
  misc_feature 1..3408: note = derived and/or modified CDS sequence (opt11) from HTNV(76-118/POR)__KT885048.1__GP
  source 1..3408: mol_type = other RNA
atgggcatctggaagtggctggtgatggcaagcctcgtctggcccgtgcttaccctgcgcaacgtgtatgacatgaagatcgagtgcccgcacacagtctccttcgggggtaacagcgttatcgggtacgtggagctcccgcccgtccccttggccgacacggcgcagatggtccccgagtcatcgtgctccatggacaaccaccagagcctgaacacaatcaccaagtacacccaggtgtcctggcggggcaaggcggaccagagccagtccagccagaactccttcgagacggtcagcacagaggtggacctcaaggggacctgtgtactgaagcacaagatggtcgaggagtcctaccgcagccggaagtccgtgacctgctacgacctgagctgcaactccacatactgcaagcccaccctctacatgatcgtgcccatccacgcctgcaacatgatgaagtcttgcctgatagcactgggcccctatcgcgtccaggtggtttacgagcggacgtactgcatgaccggcgtcctcatcgagggcaagtgcttcgtgccggaccagtccgtggtcagtatcatcaaacacggcatcttcgacatcgccagcgtgcacatcgtttgcttcttcgtcgctgttaagggaaacacgtacaagatcttcgagcaggtcaagaagtccttcgagagcacatgcaacgacaccgagaacaaggtgcaaggctactacatctgcatcgtcgggggcaactccgctcccatctacgtgcccaccctggacgacttccgcagcatggaggccttcacagggatcttccggagcccccacggggaggaccacgacctggccggcgaggagatcgcgagctactccatcgtggggccggccaacgccaaagtgccccacagcgccagcagcgacaccctccgcctgatagcctactccggcatccccagctactccagcttgtccatcctcaccagctccaccgaggcgaagcacgtcttcagccccggcctgttcccgaagctgaaccacacgaactgcgacaagtccgccatccccctcatctggaccgggatgatcgacctgcccggctactacgaggccgtccacccctgcacagtgttctgtgtcctgagcgggccaggcgcctcctgcgaggccttctccgagggcggaatcttcaacatcaccagctccatgtgcctcgtgtccaagcaaaaccggttccgcctgaccgagcaacaggtcaacttcgtgtgtcagcgggtggacatggacatcgtcgtctactgtaatggccagcgcaaggtgatcctgactaagaccctcgtgatcgggcagtgcatctacaccatcacgtccctgttcagcctgctccccggcgtagcgcactccatcgccgtggagctgtgcgtgcccgggttccacggctgggccacggcggccctgctcgtcaccttctgcttcgggtgggtgcttatccccgcgatcaccttcatcatcctgacggtgctcaagttcatcgccaacatcttccacacgagcaaccaggagaaccgtctgaagtccgtcctgcggaagatcaaggaggagttcgaaaagaccaagggctcaatggtgtgcgatgtgtgcaagtacgagtgcgagacctacaaagagctcaaggcccacggcgtatcctgcccgcagagtcagtgcccctactgcttcacgcattgcgagcccaccgaggccgccttccaggcgcactataaggtgtgtcaggtgacccaccggttccgcgacgacctgaagaagaccgtcacaccccagaacttcaccccgggctgctaccggaccctgaacctcttccgctacaagtcccggtgctacatcttcaccatgtggatcttcctgctggtgctcgaaagcatcctgtgggccgcctccgccagcgagacgcccttgacccccgtgtggaacgacaacgcgcacggcgtcgggtccgtgccgatgcacaccgacctcgagctggacttcagcctgactagctccagcaagtacacctaccggcgaaagctgacgaaccccctcgaggaggcccagtccatcgacctgcacatcgagatcgaggagcagacgatcggcgtggacgtccacgccctggggcactggttcgacggccggctcaacctgaagaccagcttccactgctacggcgcctgcacgaagtatgagtatccctggcacacggccaagtgccactacgagcgcgactaccagtacgagacctcctggggatgcaaccccagcgattgtccgggcgtggggaccggctgtaccgcgtgcggcctgtacctcgaccagctgaagcccgtggggtccgcctacaagatcatcacgatccgatacagccgtagggtctgcgtgcagttcggcgaggagaatctgtgtaagatcatcgacatgaacgactgcttcgtgtcccgccacgtcaaggtgtgcatcatcgggaccgtgagcaagttttcccagggcgacacgctcctgttctttggccccctggagggcggcgggctcatctttaagcactggtgcaccagcacgtgccagtttggcgaccccggggacatcatgtccccgcgcgacaagggcttcctgtgccccgagttccccgggagcttccgcaagaaatgcaactttgcgaccacccctatctgcgagtacgacggcaacatggtctccggctacaagaaggtgatggccaccatcgacagcttccagtccttcaacacgagcaccatgcacttcaccgacgagcggatcgagtggaaggacccggacggcatgctgcgcgaccacatcaacatcctcgtgaccaaggacatcgacttcgacaacttgggcgagaatccctgcaagatcgggctgcagacctccagcatcgagggcgcctgggggagcggcgtcggcttcaccctaacctgcctcgtgtccctgaccgaatgtcccacgttcctcaccagcatcaaagcgtgcgataaggccatctgctacggggcggagtccgtgaccctgacccgaggccagaacacggtcaaggtgagcgggaagggcggacactccggcagcaccttcaagtgctgccacggcgaggactgctcccagatcgggctgcacgccgcggcgccccacctcgacaaggtcaacggcatctcagaaatcgagaactccaaggtgtacgacgatggggcacctcagtgtggcatcaaatgctggttcgtcaagagcggcgagtggatctccgggatcttcagcggcaactggatcgtgttgattgtcctgtgcgtgttcctcctgttctccctggtcctcctgagcatcctgtgccccgtgcgcaagcacaagaaatcctga

SEQ ID NO: 14960 - RNA, 3408 nt, synthetic construct; identical to SEQ ID NO: 11674
  misc_feature 1..3408: note = derived and/or modified CDS sequence (opt11) from HTNV(76-118)__Y00386.1__GP
  source 1..3408: mol_type = other RNA

SEQ ID NO: 14961 - RNA, 3408 nt, synthetic construct
  misc_feature 1..3408: note = derived and/or modified CDS sequence (opt11) from HTNV(A16)__AF288645.1__GP
  source 1..3408: mol_type = other RNA
atgggcctgtggaagtggctcattatggccgtgctggtctggccctgcttcgccctgcgcaacgtgtacgacatgaagatcgagtgcccgcacaccgttaacttcggggagaacagcgtcgtgggctacgtggagctcccgcccatgcctatcgccgacatcacccagatgatgccggagtccagctgctccatggacaaccaccagagcctgaacacgatcaccaagtacacccaggtctcctggcggaagaaggccgaccaggcccagagctcccagaccagcttcgagacggtgtccagcgaggtggacttcaaggggacctgcgtgctgaagcacaagatgatcgaggactcctaccgcagccggcgctccatcatctgctatgacctcagctgcaactccacgttctgcaagcccaccctgtatctgatcgtgcccgtgcacgcctgcaacatgatgaagtcctgcctcatcgccctgggcccctaccgggtccaggtggtgtacgaacgcacgtactgcatgtccggggtcctgctcgagggcaagtgcttcgtgccggaccagagcgtggtctccatcatcaagcacggcatcttcgacatcgcgagcgtgcacatcgtgtgtttcttcgtcgccatcaaggggagcacctacaagatcctggagcaggtcaagaaatccttcgagctgacctgcaacgacaccgacaacaagatccagggctactacatctgcctcgtcgggggcaacagcgcccccatctacgtgcccacgctggacgacttccggagcatggaggccttcgcggggatcttcaagagcccccacggcgaggaccacgacctggccggcgaggaggtggcgtcctacagcatcgtggggccggccaacgccaaggtgccccactccgcgagcgccgacaccctcggcctggtggccttctccgggatccccagctactcctccttctccgtcctgaccggcagcaccgacgcccgccacgtgttctcccccggctttttcccgcaactcaaccagacgcggtgcgacaagactgccatccccctgacctggaccgggatgatcgacctgcccggctactacgaggcggtgcacccctgcacggtcttctgcgtgctcagcgggccgggcgcctcctgcgaggccttctccgagggtgggatcttcaacatcacctctcccatgtgcttagtgagcaagcagaaccgcttccggagctccaagcagcaggtcaatttcgtgtgccagcgcgtggacatggacatcgtcgtgtattgcaatggccagaagaaggtgatcctgaccaagaccctcgtcatcgggcagtgcatctacacgatcaccagcctgttctccctgctccccggcgtggcccacagcatcgccgtggagctgtgcgtccccgggttccacggctgggcgactgcggccctgctcgtgaccttctgcttcgggtgggtgctgatcccggccgtcacgctagtcatcctcaccatactgaaattcatcgccaacatcttccacacctccaaccaggagaaccggctcaagagcgtgctcaagaagatcaaggaggagttcgagaagaccaagggctccatggtctgcgacgtgtgcaagtacgagtgcgagacgtacaaggagctgaaggcacacggcgtgagctgcccccagtcccagtgtccctactgcttcacccactgcgagcccaccgaggccgccttccaggcccactacaaggtctgccaggtgacccaccgcttccgggacgacctgaagaagacggtgaccccgcaaaacttcacccccggatgctaccgcaccctcaacctgttccggtacaagagccgctgctacatcttcacaatgtgggtcttcctgctcatcctggagtccatcctgtgggcggccagcgcctccgagacgcccctcaccccgatctggaacgacaacgcccacggggtggggagcatccccatgcacaccgacctggagctggacttctccctgaccagctccagcaagtacacttaccggcgcaagctcaccaaccctctggaggagacccaggccgtggacctgcacatcgagctcgcggagcaaacgatcggcgtcgacgtgcacgccctggggcactggttcgacggccggctgaacctcaagacgagcttccactgctacggcgcctgcaccaagtacgagtacccatggcacaccgccaagtgccactacgagcgcgactaccagtacgagacctcctgggggtgcaacccgagcgactgccccggagtggggacgggctgcacagcctgcggcctgtacctggaccagctcaagcccgtcgggtccgcgtacaagatcatcaccatccgctacagccgtcgcgtgtgcgtgcagttcggcgaggagaacttgtgcaaggtcatcgacatgaacgactgcttcgtatcccggcacgtgaaggtctgcatcatcgggaccgttagcaaattctcccaaggcgacaccctgctgttcttcgggcccctggagggcggcgggctgatcttcaagcactggtgcaccagcacgtgccagttcggcgatccgggggacatcatgagcccccgcgacaagggcttcctgtgccccgagttccccgggagcttccggaagaagtgcaacttcgcaaccaccccgctgtgcgagtacgacggcaacatgatctccggctacaagaaggtgatggccaccatcgacagcttccagtccttcaacaccagcaccatgcatttcacggacgagcgcatcgagtggaaggaccccgacgggatgctgcgtgaccacatcaacatcctcgtcaccaaggacatcgacttcgacaacctgggcgagaacccctgcaagatagggctgcagacctccagcatcgagggcgcctgggggtctggcgtgggcttcaccctcacgtgcctggtgtctctgaccgaatgccccaccttcctcacctccatcaaggcctgcgacaaggcgatctgctacggggccgagagcgtcacgctgacccgtggccagaacaccgtgaaggtgagcggcaagggcgggcactccggcagcactttcaagtgctgccacggcgaggactgttcccagacgggtctgcacgccgccgcgccgcacctcgacaaggtcaatggcatcagcgagattgagaactccaaggtgtacgacgacggggcgccccagtgcggcatcaagtgctggttcgtcaagagcggcgagtggatctccgggatcttcagcggtaactggatcgtgctgatcgtgctgtgcgtcttcctcctgttctccctggtgctcctgagcgtgctgtgccccgtccggaagcacaagaaatcctga

SEQ ID NO: 14962 - RNA, 3408 nt, synthetic construct; identical to SEQ ID NO: 11676
  misc_feature 1..3408: note = derived and/or modified CDS sequence (opt11) from HTNV(A9)__AF035831.1__GP
  source 1..3408: mol_type = other RNA

SEQ ID NO: 14963 - RNA, 3408 nt, synthetic construct
  misc_feature 1..3408: note = derived and/or modified CDS sequence (opt11) from HTNV(84FLi)__AF345636.2__GP
  source 1..3408: mol_type = other RNA
atgggcgtgtggaagtggctggtcatggcaagcctcgtgtggcccgcctgcaccctgcgcaacgtgtacgacatgaagatcgagtgcccgcacaccgtctccttcggggagaatagcgtgatcggctacgtggagctgccgccaatgcccctcgccgacacgacccaactggtccccgagtccagctgctccatggacaaccaccagagcctgaacaccatcaccaagtacacccaggtgtcctggcggaagaaggccgaccaggcccagagctcccagaacagcttcgagacggtgtccgtcgaggtggacctcaaggggacctgcgtgctgaagcacaagatgatcgaggagagctaccgctcccgcaagagtatcacgtgctacgacctgtcctgcaacagcacgtactgcaagcccaccctctacatgatcgtccccatccacgcctgcaacatgatgaagtcctgcctgatcgctctgggcccataccgggtccaggtggtgtacgagcggacttactgcatgaccggggtgctcatcgagggcaagtgcttcgtgccggaccagagcgtcgtctccatcatcaagcacggcatcttcgacatcgcgagcgtgaagatagtctgcttcttcgtggccgtgaagggcaacacgtacaagttgttcgagcaggtcaaaaagagcttcgactccacgtgcaacgacaccgagaacaaggtgcagggctactacatctgcatcgtcggtggtaacagcgcccccatctacgtgcccaccctggacgacttccgctccatggaggccttcagtgggatcttccggagcccccacggcgaggaccacgacctcgcaggcgaggaggtggccagctactccatcgtagggccggccaacgccaaggtgccccacagcgcctccagcgacaccctgtccctgatcgcgtacagcggcatcccctcctacagctccctcagcatcctgacctccagcaccgaggccaagcacgtgttctcccccgggttcttcccgcagctaaaccacaccaagtgcgacaagacggccatccccctcacctggacaggcatgatagacctgcccggctactacgaggccatccacctgtgcaccgtcttctgtgtactcagcgggcccggcgccagctgcgaggcgttctccgagggcgggatcttcaacatcacgagcccgatgtgccttgtgtccaagcagaaccagttccgcctgaccaagcagcaggtcaacttcgtgtgccagcgggtggacatggacatagtcgtgtactgcaacgggcagcgcaaggtgatcctcaccaagaccatggtcatcgggcagtgcatctacacgatcaccagcctgttctccctgctccccggcgtggcccacagcatcgccgtggagctgtgcgtccccgggttccacggctgggccactgccgcgcttctcgtgaccttctgcttcgggtgggtgcttatccctgccgtcacgttcatcatcctgaccgtgctcaagttcgtagccaacatcttccatacctcgaaccaggagaaccggctcaagagcgtgctgcgcaagatcaaggaggagttcgagaagaccaagggctccatggtgtgcgacgtgtgcaagtacgagtgcgaaacgtaccgagagctgaaggcccacggggtcagctgcccgcagtcccagtgcccctactgcttcacccactgcgagcccaccgaggccgcgttccaggcccactaccgcgtttgccaggtgacccaccggttccgcgacgatctgaagaagaccgtcacgccccagaacttcaccccgggctgctaccggaccctgaacctcttccgctacaaaagccggtgctacatcttcaccatgtgggtgttcctgctggtgctcgagagtatcctgtgggccgccagcgcgtccgaagtccccctgaaccccatctggaacgacaacgcccacggtgtggggagcgtgccgatgcacacggacctcgagctggacttctccctgactagcagctccaagtacacctaccgcagaaagctgaccaaccccctcgaggagacgcaggctatcgacctacacatcgagatcgaggagcagaccatcggcgtcgacgtgcatgccctggggcactggttcgacggccgcctcaatctgaagaccagcttccactgttacggggcctgcaccaagtacgagtacccctggcacacggcgaagtgccactacgagagagactaccagtacgagacctcctggggctgcaaccccagcgactgcccgggcgtggggacgggctgcaccgcctgcgggctgtacctcgaccagctgaagcctgtcggctccgcctacaagataatcactatccggtacagccgccgggtgtgcgtgcagttcggcgaggagaacctgtgcaaggtcatcgacatgaacgactgcttcgtgtcccgccacgtgaaggtctgcatcatcgggaccgtgagcaagttctcccagggcgacaccctcctgttcttcgggcccctggagggcgggggcctcatcttcaagcactggtgcaccagcacgtgccagttcggcgaccccggggacattatgtccccgcgggacaagggcttcctgtgccccgagttcccggggagcttccgcaagaagtgcaacttcgccaccacgcccttatgtgagtacgacggcaacatgatctccgggtacaagaaggtgatggccaccatcgacagctttcagtccttcaataccagcaccatgcactttaccgacgagcggatcgagtggaaggacccggacggcatgctccgcgaccacatcaacatcctggtcactaaggacatcgacttcgacaatctgggcgagaacccctgcaagatcgggctccagacgtcctcgatcgagggcgcgtgggggtccggcgttgggttcaccctgacctgcctggtgagcctcaccgaatgccccacgttcctgaccagcatcaaggcctgcgacaaggccatctgctacggcgccgagtccgtcaccctgacccggggccagaacacggtgaaggtcagcgggaagggcgggcactccggcagtaccttcaagtgctgccacggggaggactgctcccagaccggcctccacgccgcggcgccccacctggacaaggtgaacggcatcagcgagatcgagaactccaaggtgtacgacgacggggccccgcagtgcggaatcaagtgctggttcgtaaccagcggggagtggatctccggcatcttcagcggcaactggatcgtgctgatcgtgctctgcgtcttcctgctgttctccctcgtgctgctgagcgtgctctgccccgtccgcaagcacaagaagtcctga

SEQ ID NO: 14964 - RNA, 3408 nt, synthetic construct
  misc_feature 1..3408: note = derived and/or modified CDS sequence (opt11) from HTNV(Aa03-161)__KT934990.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccacccatgcccctggccgacacggcccagctggtccccgagtccagttgctctatggacaaccaccaaagcctcaacaccatcaccaagtacacccaggtgtcctggcgggggaaggccgaccagagccagtccagccagaactccttcgagaccgtgtccaccgaagtcgacctgaagggcacatgcgtgctgaagcacaagatggtggaggagtcctaccgctctcggaagtccataacctgctacgacttaagctgcaactccacgtactgcaagcccaccctgtacatgatcgtccccatccacgcctgcaacatgatgaaaagctgcctgatcgccctcgggccataccgcgtccaggtggtgtacgagcggacctattgcatgaccggcgtgctgatcgagggcaagtgtttcgtcccggaccagtccgtcgtgagcatcatcaagcacgggatcttcgacatcgccagcgtgcacatcgtctgtttcttcgtggcggtgaagggcaacacgtacaagatcttcgagcaagtcaagaagtccttcgagagcacgtgcaacgacaccgagaacaaggtgcaggggtactacatctgcatcgtcggcgggaactccgcccccatctacgtgcccaccctggacgacttccgcagcatggaggccttcaccggcatattccgtagcccccacggcgaggaccacgacctcgccggggaggagaccgcgacctactccatcgtgggcccggccaacgccaaggtcccccattccgccagctccgacaccctgagccttatcgccttcagtgggatccccagctactccagcctctccatcctgacgagctccaccgaggcgaagcacgtgttcagccccggcctgttcccgaagctcaaccacaccaactgcgacaagggcgccatccccctgatgtggaccgggatgatcgacctgccgggctactacgaggccatccacccctgcacggtgttctgcgtactctccgggccgggcgccagctgcgaggccttcagcgaagggggcatcttcaacatcacatcccccatgtgcctggtgagcaagcagaaccgcttccggctgaccgagcagcaggtaaatttcgtctgccagcgcgtggacgtggacattgtcgtgtactgcaacggccagcggaaggtgatcctcaccaagacgctggtcatcgggcagtgcatctacaccatcacctccctcttcagcctcctgcccggcgtggcgcactccatcgccgtagagctgtgcgtccccgggttccacggctgggccaccgccgccctcctggtgacgttctgcttcgggtgggtgctgatcccggcgatcacgttcatcatccttaccatcctgaagttcatcgccaacatttttcacaccagcaaccaggagaacagactgaagtccgtcctccggaagatcaaggaggagttcgagaaaacgaagggcagcatggtgtgcgacgtgtgcaagtacgagtgcgagacctacaaggagctgaaggcccacggcgtctcctgcccccagagccagtgcccctactgctttacccactgtgagcccaccgaggccgccttccaggcgcactacaaggtctgccaggtgacccaccgcttcagggacgacctgaagaagacggtcaccccgcagaacttcacccccgggtgctaccgcaccctcaacctgttccggtacaagtcccgctgctacatcttcacgatgtggatcttcttgctcgtgctggagagcatcctgtgggccgcctccgccagcgagacgcccctcaccccggtgtggaacgacaacgcgcacggcgtcgggtccgtccccatgcacaccgatttggagctggacttcagcctgacctccagcagcaagtacacctaccgacgcaagctcaccaaccccctggaggaggcgcaatccatcgatctgcacatcgaaatcgaggagcagaccataggcgtggacgtccacgccctcgggcactggttcgacggccggctgaacctgaagacgagcttccactgctacggcgcctgcaccaagtacgagtacccctggcacaccgccaagtgccattacgagcgcgactaccagtacgagacatcctgggggtgcaacccgagcgactgccccggcgtcgggacggggtgcaccgcgtgcggcctctacctggaccgcctgaagcccgtggggtccgcctacaagatcatcaccatccgatacagccgccgggtctgcgtgcagttcggcgaggagaacctctgtaagatcatcgacatgaacgactgcttcgtgtcccgccacgtcaaggtgtgtatcatcgggaccgtgagcaagttctcccagggcgacacgctgctgttcttcgggcccctcgaaggcggcgggctgatcttcaagcactggtgcaccagcacgtgccagttcggcgacccgggggacatcatgagcccccgggacaagggcttcctgtgccccgagttccccgggtccttccgcaagaagtgcaacttcgccaccaccccgatttgcgagtacgacggcaacatggtctccggctaccggaaggtaatggccaccatcgacagcttccagtccttcaacacctcaaccatgcacttcacggacgagcgtatcgagtggaaggaccccgacgggatgctccgggaccacatcaatatcctggtgaccaaggacatcgacttcgacaacctgggcgagaacccctgcaagatcgggctacagacctccagcatcgagggcgcctgggggtccggcgtcggctttaccctgacgtgcctggtgagcctcaccgagtgtcccacattcctgaccagcatcaaggcgtgcgacaaggccatctgctacggggccgagtccgtgacactgacccgcggccagaacaccgtcaaggtgagcgggaagggcgggcactccggcagcaccttcaagtgctgccacggcgaggactgctcccagatcggtctccacgccgccgcgccgcacctggacaaggtgaacggcatcagcgagatggagaactccaaggtctacgacgacggggcgccccagtgcgggatcaagtgctggttcgtcaagagcggcgagtggatctccgggatcttcagcggcaactggatagtgctgatcgtgctctgcgtgttcctgctgttttccctcgtcctgctgagcatcctctgccccgtgcggaagcataagaagtcatga

SEQ ID NO: 14965 - RNA, 3408 nt, synthetic construct
  misc_feature 1..3408: note = derived and/or modified CDS sequence (opt11) from HTNV(Aa03-386)__KT934991.1__GP
  source 1..3408: mol_type = other RNA
atgggcatctggaagtggctggtgatggccagcctcgtgtggcccgtgctgaccctgcgcaacgtgtacgacatgaaaatcgagtgcccacacaccatctccttcggcgagaacagcgtcatcggctacgtggagctccctcccatgcccttggccgacacggcgcagctggtaccggagtccagctgctccatggacaaccaccagagcctcaacaccatcaccaagtacacccaggtctcctggcgggggaaggccgaccagagtcagtccagccagaactccttcgagacggtgagcaccgaggtggacctgaaggggacctgcgtcctgaagcacaagatggtggaggagtcctaccgcagtcggaagtccattacctgctacgacctcagctgcaactccacgtactgtaagcccaccctgtacatgatcgtgcccatccacgcctgcaacatgatgaaaagctgcctgatcgccctcgggccctaccgcgtccaggtggtgtacgagcggacctactgcatgaccggcgtcctgatcgagggcaagtgcttcgtgcctgaccagtccgtggtcagcatcatcaagcacgggatcttcgacatcgccagcgtgcacatcgtgtgcttcttcgtcgcggtgaagggcaacacgtacaagatcttcgaacaggtgaagaagtccttcgagtccacgtgcaacgacaccgagaacaaggtccaggggtactatatctgtatcgtgggtgggaactccgcccccatctacgtccccaccctggacgacttccgcagcatggaggccttcaccggcatcttccggagcccccacggcgaggaccacgaccttgccggggaggagaccgcgacctacagcatcgtgggcccggccaacgccaaggtgccccattccgcctcatccgacaccctgagcctgatcgccttctccgggatccccagctactccagcctctccatcctgacgagttccaccgaggcgaagcacgtcttcagccccggcctgttcccgaagctcaaccacaccaactgcgacaagggcgccatccccctgatgtggaccgggatgatcgacctgcccggctactacgaggccatccatccctgcacggtattctgcgtgctctccgggccgggcgccagctgcgaggccttcagcgagggcggcatcttcaacatcacctcccccatgtgcctggtcagcaagcagaaccgcttccggctgaccgagcaacaggtgaacttcgtgtgccagcgcgtcgacgtggacatcgtggtctactgcaacggccagcggaaggtgatcctcaccaagacgctggtgatcgggcagtgcatctacaccatcacctccctgttcagcttgctgcccggcgtcgcgcactccatcgccgtggagctgtgtgtgcccgggttccacggctgggccaccgccgccctcctggtcacgttctgctttgggtgggtgctgatcccggcgatcaccttcatcatcctcaccatcctgaagttcatcgccaacatcttccacaccagcaaccaggagaaccgcctgaagtccgttctccggaagatcaaggaggagttcgagaagacgaagggcagcatggtctgcgacgtgtgcaagtatgagtgcgagacctacaaggagctgaaggcccacggcgtgtcctgcccccagagccagtgcccctattgcttcacccactgcgagcccaccgaggccgcctttcaggcgcactacaaggtctgccaggtgacccaccgcttccgggacgacctgaagaagacggtgaccccgcagaacttcacccccgggtgctaccgcaccctcaacctgttccggtacaagtcccgctgctacatattcacgatgtggatcttcctactcgtcctggagagcatcctgtgggccgcctccgccagcgagacgcccctcaccccggtgtggaacgacaatgcgcacggcgtggggtccgtccccatgcacaccgacctggagctggacttcagcctgacctccagcagcaagtatacctacaggcgcaagctcaccaaccccctggaggaggcccagtccatcgacctacacatcgagattgaggagcagaccatcggcgtggacgtgcacgccctcgggcactggttcgacggccggctgaacctgaagacgtccttccactgttacggcgcctgcaccaagtacgagtacccttggcacaccgccaagtgccactacgagcgcgattaccagtacgagacctcgtgggggtgcaacccgagcgattgccccggcgtcgggacgggctgcaccgcgtgcggcctctacctggaccgcctgaaacccgtggggtccgcctacaagatcatcaccatcagatacagccgccgggtgtgcgttcagttcggcgaagagaacctctgcaagataatcgatatgaacgactgcttcgtgtcccgccacgtgaaggtctgcatcatcgggaccgtgagcaagttctcccagggcgacacgctgctgttcttcgggcccctcgaaggcggcgggctgatcttcaagcactggtgcaccagcacgtgccagttcggagacccgggggacatcatgtcccccagggacaagggcttcctgtgccccgagttccccgggagcttccgcaagaagtgcaacttcgccaccacgccgatctgcgagtacgacggcaacatggtgtccggctacaagaaggtcatggccaccatagacagcttccagtccttcaacaccagcaccatgcacttcacggacgagcgcatcgagtggaaggaccccgacgggatgctccgcgaccacatcaacatcctcgtgaccaaggacatcgacttcgacaacctgggcgagaacccctgcaagatcgggctccagacctccagcatcgagggggcctggggatccggcgtgggcttcaccctgacgtgcctggtcagcctcaccgagtgccccacctttctgaccagtatcaaggcctgcgacaaggccatctgctacggggccgagtccgtgacgctgaccaggggccagaacaccgtgaaggtcagcgggaagggcgggcactccggcagcaccttcaagtgctgccacggcgaggactgctcccagatcggtctccacgccgccgcgccgcacctggacaaggtgaacggcatcagcgagatggagaactccaaggtgtacgacgacggggcaccccagtgcggcatcaagtgctggttcgtcaagagcggcgagtggatatccgggatcttcagcggcaactggatcgtgctgatcgtcctctgcatcttcctgctgttctccctggtgctgctgagcatcctctgccccgtgcgcaagcacaagaagtcctga

SEQ ID NO: 14966 - RNA, 3408 nt, synthetic construct
  misc_feature 1..3408: note = derived and/or modified CDS sequence (opt11) from HTNV(Aa04-722)__KU207182.1__GP
  source 1..3408: mol_type = other RNA
atgggcatctggaagtggctggtgatggccagcctcgtctggcccgtgctgaccctacgaaacgtgtacgacatgaagatcgagtgtccgcacaccgtctctttcggggaaaatagcgtgatcggctacgtggagctcccgcccatgcccctggccgacacggcgcaactggtccccgagtccagctgctccatggacaaccatcagtcgctcaacaccatcacgaagtacacccaggtgtcctggcgggggaaggccgaccagagccagtccagccaaaactccttcgagacggtgagcaccgaggttgacctgaaagggacctgcgtgctgaagcacaagatggtcgaggagtcctaccgctcacggaagtccataacctgctacgacctcagctgcaattccacgtactgcaagcccaccctgtacatgatcgtcccaatccacgcctgcaacatgatgaagtcctgcctgatcgccctcggcccctaccgcgtccaggtggtgtacgagcggacttactgcatgaccggcgtgctgatcgagggcaaatgcttcgtgcctgaccagtccgtcgtgtccatcatcaagcacgggatcttcgacatcgccagcgtgcacatcgtctgctttttcgtggcggtgaagggcaacacgtacaagatcttcgagcaagtcaagaagtcattcgagagcacgtgcaacgacaccgagaacaaggtccaggggtactacatctgcatcgtcggcgggaactccgcccccatctacgtgcccaccctggacgacttccgcagtatggaggccttcaccgggatcttccggagcccccatggagaggaccacgacctcgccggggaggagactgcgacctacagcatcgtcggcccagccaacgccaaggttccccactccgccagctccgacaccctgagcctaatcgccttctccgggatcccatcttactccagcctctccatcttaacgagctccaccgaggcgaagcacgtgttcagccccggcctgttcccgaagctcaaccacaccaactgcgacaagggcgccatcccccttatgtggaccgggatcatcgacctccccggctactacgaggccatccacccctgcacggtgttctgcgtcctctccgggccgggcgccagctgcgaggccttcagcgaagggggcatcttcaacatcacatcccccatgtgcctggtgagcaagcagaacagattccggctgactgagcaacaggtgaatttcgtctgccagcgcgtagacgtagacatcgtagtgtactgcaacggccagcggaaggtgatcctcaccaagacgctggtcatcgggcagtgcatatacacaatcacctccctgttcagcctcctgcccggcgtggcgcactccatcgccgtggagctgtgcgtcccagggttccacggctgggccaccgccgccctcctggtgacgttttgcttcgggtgggtgctgatcccggcgatcacgttcatcatcctcaccatcctgaagttcatcgccaacatcttccacaccagcaaccaggaaaaccgcctgaagtccgtcctccgtaaaatcaaggaggagttcgagaagacgaagggcagcatggtgtgcgacgtgtgcaagtatgagtgcgagacctacaaagagctgaaggcccacggcgtctcttgcccccagagccagtgtccctactgcttcacccactgcgagcccaccgaggccgccttccaggcgcactacaaggtgtgccaggtgacccaccgtttccgggatgaccttaagaagacggtcactccgcagaactttacccccgggtgctaccgcacgctcaacctgttccggtacaagtcccgctgctacatcttcacgatgtggatcttcctgctcgtgctggagagcatcctgtgggccgccagcgccagcgagacgcccctcaccccggtgtggaacgacaacgcgcacggcgtcgggtccgtgcccatgcacaccgacctggagctggacttcagcctgacctccagcagcaagtacacctaccggcgcaagctcaccaacccgctggaggaggcacagtccatcgatctgcacatcgagatcgaggagcagaccatcggcgtcgacgtccacgccctcgggcattggttcgacggacggctgaacctgaagacgagcttccactgctacggcgcatgcacgaagtacgagtacccctggcacaccgccaagtgccactacgagcgcgactatcagtacgagaccagttgggggtgcaatccgagcgactgccccggtgtggggacgggctgcaccgcgtgcggtctctacctggaccgcctgaagcccgtggggtccgcctacaagatcatcaccattagatacagccgccgtgtctgtgtgcagttcggcgaggagaacctctgcaagatcatcgacatgaacgactgcttcgtgtcccgccacgtcaaggtgtgcatcatcggaaccgtgagcaaattctcccaaggcgacacgctgctgttcttcgggccactcgagggcggcgggctgatctttaagcactggtgcaccagcacttgccagttcggcgacccgggggacatcatgtcccctcgggataagggcttcctgtgccccgagttccccgggagcttccgcaagaagtgcaacttcgcaaccacgccgatatgcgagtacgacggcaacatggtctccggctacaagaaggtgatggctaccatcgacagcttccagtccttcaacaccagcaccatgcacttcaccgacgagcgtatcgagtggaaggaccccgacgggatgctccgcgaccacatcaacatccttgtaaccaaggacatcgacttcgacaacctgggcgagaacccgtgcaagatcgggctccagacctccagcatcgagggcgcctgggggtctggcgtgggcttcaccctgacgtgcctggtgagcctgaccgagtgccccaccttcctgaccagtatcaaggcgtgcgacaaggctatctgctacggggccgagagtgtgacgctgacccggggccagaacaccgtcaaggtttcagggaagggcgggcactccggcagcaccttcaaatgctgtcacggcgaggactgctcccaaatcgggctccacgccgccgcgccgcacctggacaaagtgaacggcatcagcgagatggagaactccaaggtctacgacgacggggcgccccagtgcggtatcaagtgctggttcgtcaagagcggcgagtggatctccgggatcttcagcggcaactggattgtgctgatcgtgctctgcgtgttcctgctgttctccctagtcctgctgagcatcctctgccccgtgcgcaagcacaagaagtcctga

SEQ ID NO: 14967 - RNA, 3408 nt, synthetic construct; identical to SEQ ID NO: 11681
  misc_feature 1..3408: note = derived and/or modified CDS sequence (opt11) from HTNV(Aa05-190)__KT934993.1__GP
  source 1..3408: mol_type = other RNA

SEQ ID NO: 14968 - RNA, 3408 nt, synthetic construct; identical to SEQ ID NO: 11682
  misc_feature 1..3408: note = derived and/or modified CDS sequence (opt11) from HTNV(Aa09-1000)__KT935001.1__GP
  source 1..3408: mol_type = other RNA

SEQ ID NO: 14969 - RNA, 3408 nt, synthetic construct
  misc_feature 1..3408: note = derived and/or modified CDS sequence (opt11) from HTNV(Aa09-948)__KT935000.1__GP
  source 1..3408: mol_type = other RNA
atgggcatctggaagtggttagtgatggccagcctcgtctggccggtgctgaccctccgcaacgtgtacgacatgaagatcgagtgtccgcacaccgtcagtttcggggagaacagcgtgatcggctacgtggagctcccgcccatgcccttagccgacacagcccagctggtccccgagtcctcctgctccatggacaaccaccagagcctcaacacgatcaccaagtacacccaggtgtcctggcgggggaaggccgaccagagccagtccagccagaactccttcgagacggtgagcaccgaggtcgacctgaaggggacctgcgtgctcaagcacaagatggtagaggagtcctaccgcagccgtaagtccataacctgctacgacctctcctgcaactccacgtactgcaagcccaccctgtacatgatcgtccccatccacgcttgcaacatgatgaagtcctgcctgatcgccctcgggccatatcgcgtccaggtggtgtacgagcggacgtactgcatgaccggcgtactgatcgagggcaagtgcttcgtgccagaccagtccgtcgtgagcataatcaagcacgggatcttcgacatcgcctcggtacatatcgtctgcttcttcgtggcagtgaagggcaacacgtacaagatcttcgagcaggtcaagaagtcctttgagagcacctgtaacgacaccgagaataaggtacaagggtactacatctgcatcgtcggcgggaactcggcccccatctacgtgcccactctcgacgactttcgcagcatggaggccttcacgggcatcttccggagcccccatggcgaggaccacgacctcgctggagaggagaccgcgacctacagcatcgtgggcccagccaacgcaaaagtcccccactccgccagctccgacaccctcagcctgatcgccttctccgggatcccctcttactccagcctctccatcttaacgtcatccacagaggcgaagcacgtgttcagccccggcctgtttcccaaactcaaccacaccaactgtgacaaaggcgccatccccctgatgtggactgggatgatcgacctgcccggctactacgaggccattcacccttgcactgtgttctgcgtcctcagtgggccgggcgccagctgcgaggccttcagcgagggcggcatcttcaacatcacctcacctatgtgcctgatcagcaagcagaaccgctttcggctgacagagcagcaggtaaacttcgtgtgccagcgcgttgacgtggatatcgtggtctactgcaacggccagcggaaggtgatcctcaccaagacgctggtgatcgggcaatgcatctacaccatcacctccctgttctcgctcctgcccggcgtagcgcactccatcgccgtggagctgtgcgtgcccgggttccacggctgggccaccgccgccctcctggtcacgttctgcttcgggtgggtcctgatcccggcgatcacatttatcatcctcaccatcctgaagttcatcgccaatatcttccacaccagcaaccaggagaacagactgaagagtgtgctccggaagatcaaggaggagttcgaaaagacgaagggcagcatggtctgcgacgtatgcaagtacgagtgcgagacatacaaggagctgaaggcccacggcgtgtcctgcccccagagccagtgcccctactgcttcacccactgtgagccgaccgaggccgccttccaggcgcactacaaggtctgccaggtaacccatcgcttccgggatgacctgaagaagacggtgacaccgcagaacttcacccccgggtgctaccgcaccctcaacctgtttcggtacaaatcccgctgctacatcttcacgatgtggatcttcctgctcgtgctggagagcatcctgtgggccgcctccgctagcgagacgcccctcaccccagtgtggaacgacaatgcgcacggcgtggggtccgtccccatgcacaccgacctggagctggacttcagcctgacctccagcagcaagtacacctaccggcgcaagctgaccaacccgctggaggaggcccagtccatcgacctgcatatcgaaatcgaggagcagaccatcggagtggacgtgcacgccctcgggcactggttcgacggccggctaaacctgaagacgagcttccactgctacggcgcctgcacaaagtacgagtacccctggcacaccgccaagtgccactatgagcgggactaccagtacgagacctcctgggggtgcaacccgtcggactgccctggcgtcgggacgggctgtaccgcgtgcgggctctacctggaccggctgaagcctgtggggtccgcctacaagattatcacaatccggtacagccgccgggtgtgcgtacagttcggcgaggagaacctctgcaaaataatcgacatgaacgactgcttcgtgagtcgccacgtgaaggtctgcatcatagggaccgtttctaagttctcccagggcgacacgctgctattcttcgggcccctcgagggcggcggtctgatcttcaagcactggtgcacctctacctgccagttcggcgacccgggggacatcatgagcccccgggacaagggattcctgtgccccgagttccccgggtccttccgcaagaaatgcaacttcgccactacaccgatctgcgaatacgacggcaacatggtgtccggctacaagaaggtcatggccaccatcgacagcttccagagtttcaacaccagcaccatgcatttcacggacgagcggatcgagtggaaggaccccgacgggatgctccgcgaccacattaacatcctggtgaccaaggacatcgacttcgacaatctgggcgagaacccctgcaaaatcgggctccagacctccagcatcgagggcgcctgggggtccggcgttggcttcaccctgacgtgcctcgtcagcctcaccgagtgccccaccttcctgaccagcatcaaggcttgcgacaaggctatctgctacggggcagagtccgtgacgctgacccggggccagaacaccgtgaaggtcagcgggaagggcgggcactccggcagcaccttcaagtgctgccacggcgaggactgctcccagatcgggctccacgccgccgcgccgcacctggacaaagtcaacggcatcagcgagatggagaactccaaggtgtacgacgatggggcgccccagtgcggcatcaagtgctggttcgttaagagcggcgaatggatctccgggattttctctggcaattggatcgtgctgatcgtcctctgcgtgttcttactgttctccctcgtgctgctgagcatcctttgccccgtccgcaagcacaagaagtcctga

SEQ ID NO: 14970 - RNA, 3408 nt, synthetic construct; identical to SEQ ID NO: 11684
  misc_feature 1..3408: note = derived and/or modified CDS sequence (opt11) from HTNV(Aa10-434)__KT935004.1__GP
  source 1..3408: mol_type = other RNA

SEQ ID NO: 14971 - RNA, 3408 nt, synthetic construct
  misc_feature 1..3408: note = derived and/or modified CDS sequence (opt11) from HTNV(Aa10-518)__KT935005.1__GP
  source 1..3408: mol_type = other RNA
atgggcatctggaagtggctggtgatggccagcctcgtctggcccgtgctgaccctacgcaacgtgtacgacatgaagatcgagtgcccgcacaccgtctcctttggggagaacagcgtgatcggctacgtggagctcccgcccatgcccctggccgatacggcgcagctggtccccgagtccagctgctccatggataaccaccagagcctcaacaccatcaccaagtacacccaggtgtcctggcgggggaaggctgaccagagccagtccagccagaactccttcgagacggtgagcaccgaggtcgacctgaaggggacctgcgtgcttaagcacaagatggtggaggagtcctaccgcagccggaagtccataacctgctacgacctcagctgcaactccacgtactgcaagcccacattgtacatgatagtccccatccacgcctgcaacatgatgaagagttgcctgatcgcactcggcccttaccgcgtccaggtggtgtacgagcggacctactgcatgaccggcgtgctgatcgagggcaagtgcttcgtgccggaccagtccgtcgtgagcatcatcaagcacggcatcttcgacatcgccagcgtgcacattgtctgctttttcgtggcggttaagggcaacacgtacaagatcttcgagcaggtcaagaagtccttcgagagcacatgcaacgacaccaagaacaaggtgcaagggtactacatctgcatcgtcggagggaactccgcccctatctacgtacccaccctggacgacttccgaagcatggaggccttcacgggcatcttccggagcccccatggcgaggaccacgacctcgccggggaggagaccgcgacctattccatcgtgggcccggccaacgccaaggtcccccactccgccagctccgacacgctgagcctgatcgccttctccgggatccccagctactccagcctctccatcctgacgtcctccaccgaagcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcctctccgggccgggcgccagctgcgaggccttcagcgaagggggcatcttcaacatcacctcccccatgtgcctggtgagcaagcagaaccgcttccggctaaccgagcaacaggtgaacttcgtctgccagcgcgtggacgtcgacatcgtcgtgtactgcaacggccagcggaaggtcatcctcaccaagacgctggtcatcgggcagtgcatctacaccatcacctccctgttcagcctcttgcccggcgtggcgcactccatcgccgtggagctgtgcgtccccgggttccacggctgggccaccgccgccctcctggtgacgttctgcttcgggtgggtgctgatcccggcgatcaccttcatcatcctcaccatcctgaagttcatcgccaacatcttccacaccagcaaccaggagaaccgcctgaagtccgtcctccggaagattaaggaggagttcgagaagactaagggcagcatggtgtgcgacgtgtgcaagtacgagtgcgagacctacaaggagctgaaggcacacggcgtctcctgcccccagagccagtgtccctactgcttcacccactgcgagcccaccgaggccgccttccaggcgcactacaaggtgtgtcaggtgacccaccgcttccgggacgacctgaagaagacggtcaccccgcagaacttcacccccgggtgctaccgcaccctcaacctgttccggtacaagtcccgctgctacatcttcacgatgtggatcttcctgctcgtgctggaaagcatcctgtgggccgcctccgccagcgagacgcccctcaccccggtgtggaacgacaacgcgcacggcgtcgggtccgtgcccatgcacaccgacctggagctggacttcagcctgacgtccagcagcaagtacacctaccggcgcaagctcaccaaccccctggaggaggcccagtccatagacctgcacatcgagatcgaggagcagaccatcggcgtggacgtccacgccctcgggcactggttcgacggccggctgaacctgaagaccagcttccactgctacggcgcctgcaccaagtacgagtacccgtggcacaccgccaagtgccactatgagcgcgactaccagtacgagacctcctgggggtgcaacccgtcggactgccccggcgtggggacgggctgcaccgcgtgtggcctctacctggaccgcctgaagcccgtgggctccgcctacaagatcatcaccatccggtacagccgccgggtctgcgtgcagttcggcgaggaaaacctctgcaagatcgtggacatgaacgactgcttcgtcagccgccacgtgaaggtgtgcatcatcgggaccgtcagcaagttctcccagggcgatacgctgctgttctttgggcccctcgagggcggcgggctgatcttcaagcactggtgcacctctacctgccagttcggcgacccgggggacatcatgagcccccgggacaagggcttcctgtgccccgagttccccgggtccttccgcaagaagtgcaacttcgccaccacgccgatctgcgagtacgatggcaacatggtgtccggctacaaaaaggtgatggccaccatcgacagcttccagtccttcaacaccagcaccatgcacttcacggacgagcggatcgagtggaaggaccccgacgggatgctccgcgaccacatcaacatcctggtcaccaaggacatcgacttcgacaacctgggcgagaacccctgcaagatcgggctccagacctcctcaatcgagggcgcctgggggtccggcgtgggcttcaccctgacgtgcctggtgagcctcaccgagtgtcccaccttcttgaccagcatcaaggcgtgcgacaaggccatctgctacggggcagagtccgtcacgctgacccggggccagaacacggtaaaggtgagcgggaagggcgggcactccggcagcaccttcaagtgttgccacggcgaggactgctcccagatcgggctccacgccgccgcgccgcacttggacaaagtcaacggcatcagcgagatggagaactccaaggtgtacgacgacggggccccacaatgcggcatcaagtgctggttcgtcaagagcggcgagtggatctccgggatcttcagcggcaactggatcgtgctgatcgtgctctgcgtcttcctgctgttctccctcgtgctgctgagcatcctctgccccgtgcgcaagcacaagaagtcctga

SEQ ID NO: 14972 - RNA, 3408 nt, synthetic construct
  misc_feature 1..3408: note = derived and/or modified CDS sequence (opt11) from HTNV(Aa10-561)__KT935006.1__GP
  source 1..3408: mol_type = other RNA
atgggcatctggaaatggctggtgatggcctcgctcgtctggcccgtgctgaccctgcgcaacgtgtacgacatgaagatcgagtgcccgcataccgtctccttcggggagaacagcgtgataggctacgtggagctcccgcccatgcccctggccgacacggcccagctggtccccgagtccagctgctccatggacaaccaccagagcctcaacaccatcaccaagtacacccaggtctcctggcgggggaaggccgaccagagccagtcgagccagatctccttcgagacggtgagcaccgaggtcgacctgaaggggacctgcgtgctgaagcacaagatggtggaggagtcctaccgcagccggaagtccattacctgctacgacctcagctgcaactccacgtactgcaagcctacgctgtacatgatcgtccccatccacgcctgcaacatgatgaaaagctgcctgatcgccctcgggccctaccgcgtccaggtggtgtacgagcgaacctactgcatgaccggcgtgctgatcgagggcaagtgcttcgtgccagaccagtcagtcgtgagcatcatcaagcacgggatcttcgacatcgccagcgtgcacatcgtctgcttcttcgtggcggtgaagggcaacacgtacaagatcttcgaacaggtcaagaagtcctttgagtcgacctgcaacgacaccgagaacaaggtgcaggggtactacatctgcatcgtcggcgggaactccgcacccatctacgtgcccaccctggacgacttccgcagcatggaggccttcacgggcatcttccggagcccccacggcgaggaccacgacctcgccggggaggaaaccgcgacctactccatcgtgggcccggccaacgccaaggtcccccattccgccagctccgataccctgagcctgatcgccttttccgggatccccagctactccagcctctccatcctgacgagctccaccgaggcgaagcacgtcttcagccccggcctgttcccgaagctcaaccacaccaactgcgacaagggcgccattcccttaatgtggaccggtatgatcgacctgcccggctactacgaggccatccacccctgcacggtgttctgcgtcctctccgggccgggcgccagctgcgaggccttcagcgagggcggcatcttcaacatcacctcccccatgtgtctggtgagcaagcagaaccgcttccggctgaccgagcagcaggtcaacttcgtgtgccagcgcgtggacgtggacatcgtcgtgtactgcaacggccagcggaaggtgatcctcaccaagacgctggtcatcgggcagtgcatctacaccatcacctccctgttcagcctcctgcccggcgtggcgcactccatcgccgtggagctgtgcgtccccggtttccacggctgggccaccgcggccctcctggtgacgttctgcttcgggtgggtgctgattccggcgatcaccttcatcatcctcaccatcctgaaattcatcgccaacatcttccacacctctaaccaggagaaccgcctcaagtccgtcctgcggaagatcaaggaagaatttgaaaagacgaagggcagcatggtgtgcgatgtgtgcaagtacgagtgcgagacctacaaggagctgaaggcccacggcgtctcctgcccccagagccagtgcccctactgcttcacccactgcgagcctaccgaggccgccttccaggcgcactacaaggtgtgccaggtgacccaccgcttccgggacgacctgaagaagacggtcaccccgcagaacttcacccccggctgctaccgcaccctcaacctgttccggtacaagtcccgctgctacatcttcacgatgtggatcttcctgctcgtgctggagagcatcctgtgggccgcctccgccagcgagacacccctcaccccggtgtggaacgacaacgcgcacggcgtcgggtccgtgcccatgcacaccgatctggagctggacttcagcctgacgtccagcagcaagtacacctaccggcgcaagctcaccaatcccctggaggaggcacagtccatcgacctgcacatcgagatcgaggagcagaccatcggcgtggacgtccacgccctcgggcactggttcgacggccggctgaacctgaagacgagcttccactgctacggcgcctgcaccaagtacgagtacccctggcacaccgccaagtgccactacgagcgcgactaccagtacgagacctcctgggggtgcaatccgagcgactgccccggcgtgggtacgggctgcaccgcgtgcggcctctacctggaccgcctgaagcccgtgggttccgcctacaaaatcatcaccatccggtactcccgccgggtctgcgtgcagttcggcgaggagaacctctgcaagatcatcgacatgaacgactgcttcgtgtcccgccacgtcaaggtgtgcatcatcgggaccatcagcaagttctcccagggcgacacgctgctgttctttggccccctcgagggcggcgggctgatcttcaagcactggtgcaccagcacatgtcagttcggtgacccgggggacatcatgagcccccgggacaagggcttcctgtgccccgagttccccgggtcctttcgcaagaagtgcaacttcgccaccacgccgatctgcgagtacgacggcaacatggtgtccggctacaagaaggtcatggccaccatcgacagcttccagtccttcaacaccagcaccatgcacttcacggacgagcggatcgagtggaaggaccccgacgggatgctccgcgaccacatcaacatcctggtgaccaaggacatcgacttcgacaacctgggcgagaacccctgtaagatcgggctccaggcctccagcatcgagggcgcgtgggggtccggcgtgggcttcaccctgacctgcctggttagcctcacggagtgccccaccttcctgaccagcatcaaggcctgcgacaaggccatctgctacggggccgagtccgtgaccctgacgcggggccagaacaccgtaaaggtcagcgggaagggcgggcactccggcagcaccttcaagtgctgccacggcgaggactgctcccagatcgggctccacgccgcggccccgcacctggacaaggtgaacggcatcagcgagatggagaactccaaggtgtacgacgacggggcgccccagtgcggcataaaatgctggttcgtcaagagcggcgagtggatctccgggatcttcagcggcaactggatcgtgctgatcgtcctctgcgtgttcctgctattctccctcgtgctgctgagcatcctctgccccgtccgcaagcacaagaagtcctga

SEQ ID NO: 14973 - RNA, 3408 nt, synthetic construct; identical to SEQ ID NO: 11687
  misc_feature 1..3408: note = derived and/or modified CDS sequence (opt11) from HTNV(Aa14-172)__KT935008.1__GP
  source 1..3408: mol_type = other RNA

SEQ ID NO: 14974 - RNA, 3408 nt, synthetic construct; identical to SEQ ID NO: 11688
  misc_feature 1..3408: note = derived and/or modified CDS sequence (opt11) from HTNV(Aa14-266)__KT935013.1__GP
  source 1..3408: mol_type = other RNA

SEQ ID NO: 14975 - RNA, 3408 nt, synthetic construct
  misc_feature 1..3408: note = derived and/or modified CDS sequence (opt11) from HTNV(Aa14-272)__KT935014.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctctttcggggagaacagcgtgatcggctatgtggagctccctcccatgcccctcgccgacacggcccagatggtccccgagtccagctgctccatggacaaccaccaaagcctcaacaccatcaccaagtacacccaggtgtcctggcgggggaaagccgaccagagccagtccaaccagaatagcttcgagactgtgtccaccgaagtcgacctgaaggggacctgcgtgctgaagcacaagatggtggaggaatcgtaccgctcccgcaagagcatcacgtgctacgacctgagttgcaactctacctactgcaaacccactctatacatgatcgtccccatccacgcctgcaacatgatgaagtcctgtctgatcgccctggggccatatcgcgtccaggtggtgtacgagcggacttattgcatgaccggcgtgttgatcgagggcaaatgcttcgtgccagaccagagcgtcgtgtccatcatcaaacacgggatcttcgacatcgccagcgtgcatattgtctgcttcttcgtggcggtgaagggcaacacgtacaagattttcgaacaggtcaagaagtccttcgagtccacgtgcaacgacacagagaacaaggtgcaggggtattacatctgcatcgtcggcgggaacagcgcccccatctacgtgcctaccctggatgacttcaggtcaatggaggccttcacaggcatcttccggagcccccacggcgaagaccacgacctcgctggggaggagatcgcgacctacagcatcgtgggcccggccaacgctaaggttccccacagcgcatcgagcgacaccctctccctgatcgcctacagcgggatcccctcctatagctccctgagcatcctcacctccagcacggaagcgaaacacgttttctcccctggcctgttcccgaagctgaatcacaccaactgcgacaaaagcgccatacccctcatgtggaccggcatgatcgacctccccggctactacgaagccgttcacccctgcaccgtattctgcgtgctgtccggcccgggggccagctgcgaggcctttagcgagggcgggatcttcaacatcacgtcccccatgtgcctcgtgagcaagcagaaccgcttccggctgaccgagcagcaggtcaacttcgtgtgccaacgcgtggacgtcgacatcgtggtgtactgcaacggccagcggaaggtcatcctgaccaagaccctcgtgataggccagtgcatctatacgatcacctccctgttcagcctgcttccaggggtggcgcactccatcgcagtcgagctgtgcgtgcccggcttccacgggtgggccaccgccgccctgctcgtgaccttctgcttcggctgggtccttatccctgcgatcacgttcatcatcctgaccatcctaaagttcatcgccaatatcttccacaccagcaaccaggagaaccgcctgaaatccgtgctgcggaagatcaaggaggagttcgagaagaccaaggggagcatggtgtgcgacgtctgcaagtacgagtgcgagacatacaaggagctcaaggcccacggcgtgtcctgcccccagagccagtgcccctattgcttcacccactgcgagcccaccgaagccgccttccaggcgcactacaaggtgtgtcaggtcacgcaccgcttccgagacgatctgaagaaaaccgtgacgccccagaacttcacgccaggctgttaccgcaccctgaacctcttccggtacaagtcgcgctgctacatcttcaccatgtggattttcctgctggtgctagagagcattttatgggccgcctccgccagcgagacgcccctgacgccggtctggaacgacaacgcgcatggggtgggctccgtgccaatgcacaccgacttggagctagacttcagccttacctccagcagcaagtacacgtaccggcgcaagctgaccaaccccctcgaggaggcccagtccatcgacctgcacatcgagatcgaggagcagactatcggggtagacgtgcacgccctgggccactggttcgacgggcggctcaacctgaagacatccttccactgctacggcgcgtgcacgaagtacgagtacccctggcacaccgccaagtgccactacgagcgcgactaccagtacgagacctcctggggctgcaacccgtcagactgccccggggtgggcacggggtgcacggcgtgcggcctgtaccttgaccagctgaagcccgtaggctccgcctacaagatcatcaccatccgctacagtcggcgcgtttgcgtgcagttcggggaggagaacctctgcaagatcatcgacatgaacgactgcttcgtctcccggcatgtgaaggtgtgcatcatcgggaccgtcagcaaattctcccagggggacaccctcctgttcttcggccccctggagggcggcggcctcatcttcaagcactggtgcacgagcacgtgccagttcggggacccgggcgacatcatgagcccccgcgacaaggggttcctgtgccccgagttccccggctccttccggaaaaagtgcaacttcgcgaccaccccgatctgcgaatacgacggaaacatggtgtccggctacaagaaggtgatggccaccatcgatagcttccagtccttcaacaccagcaccatgcacttcaccgatgagagaatcgagtggaaggaccccgacggcatgctccgggaccacatcaacatcctcgtcacgaaagacatcgacttcgacaatctgggggagaacccctgcaagatcggcctgcagacatccagtatcgagggggcctggggctccggagtgggcttcaccctgacctgcctcgtgagcctcacggagtgccccaccttcctcaccagcatcaaggcgtgcgacaaggccatctgctacggagccgagtccgtcaccctgacgagggggcagaataccgtgaaggtgagcggcaagggcgggcactccgggtcaaccttcaagtgctgccacggtgaggactgctcccagatcggcctgcacgccgccgcgccgcacctcgacaaagttaacgggatcagcgagatggagaacagtaaggtgtacgacgacggcgcgccccaatgcgggatcaagtgctggttcgtcaagagcggcgagtggatctccggcatcttcagcgggaactggatcgtgctgatcgtattatgcgttttcctcctgttctccctggtgttgctgagcatactgtgccccgtgcggaagcacaaaaagtcctga

SEQ ID NO: 14976 - RNA, 3408 nt, synthetic construct
  misc_feature 1..3408: note = derived and/or modified CDS sequence (opt11) from HTNV(Aa14-362)__KT935015.1__GP
  source 1..3408: mol_type = other RNA
atgggcatatggaagtggctggttatggccagcctcgtctggcccgttctgaccctacgcaacgtgtacgacatgaagattgagtgcccgcacaccgtctccttcggggagaacagtgtgataggctacgtggagctcccgcccatgcccttagccgacacggcccagctggtcccagagtccagctgctccatggataaccaccagagcctcaacacgataaccaaatacacccaggtgtcctggcgggggaaggccgaccaaagccaatccagccagaactcttttgaggcagtgagcacggaggtcgacctgaaggggacctgcgtgctgaagcacaagatggtggaggagtcctaccgcagccggaagtccatcacgtgctacgacctgagctgcaactccacctactgcaagcccaccctgtacatgatcgtccccatccacgcctgcaacatgatgaaatcttgtctgatcgccctcgggccctaccgtgtccaggtggtgtacgagaggacgtactgcatgaccggcgtgctgatcgaaggcaagtgctttgtgcccgaccagtccgtcgtgagcataataaagcacgggatattcgacatcgcgagcgtgcacatcgtctgcttcttcgtggccgtgaagggcaacacctacaaaatcttcgagcaggtcaagaagtccttcgagagcacgtgcaacgataccgagaacaaggtgcaggggtattacatctgcatcgtcggcggaaactcagcccccatctatgtgcccaccctggacgacttccgcagcatggaggccttcaccggcatcttccggagcccccatggcgaggaccacgatctcgcgggggaggagacggccacctattcaatcgtgggcccggccaacgccaaggtcccccactccgccagctccgacaccctgtccctgatcgcgttctccggcatccccagctactctagcctctccatcctgaccagcagtacggaggccaagcacgtgttcagccccggcctgttcccgaagctcaaccacaccaattgcgacaaaggagcaatccctctgatgtggaccgggatgattgacttacctggctactacgaggccatccacccctgcaccgtattctgcgtcctctccgggccgggcgccagctgcgaggcgttctcagagggtggcatattcaacatcacgtcccccatgtgcctcgtgagcaagcagaaccgcttccggcttaccgaacagcaggtcaactttgtgtgccaacgcgtggacgtcgatatcatcgtctattgtaacggccagcggaaggtgatcttgaccaagacactggtaatcggacagtgcatctacaccatcacctccttattcagcctcctgcccggcgtagcccactccatcgctgtggagctgtgcgtgcccgggttccatggctgggcaaccgccgccctcctggtaaccttctgcttcgggtgggtgctgataccggcaatcacgttcatcattcttaccatcctgaaattcatcgccaacatatttcacaccagcaaccaggagaaccgcctcaagtccgtgctcaggaaaatcaaggaggagttcgagaagactaagggcagcatggtttgcgacgtctgcaagtacgagtgcgagacgtacaaggagcttaaggcccacggcgtgtcctgcccccagagccaatgcccctactgtttcactcactgtgagcccaccgaggccgcgttccaagcccattacaaggtgtgccaggtcacccaccgattccgggacgacctgaagaagaccgtgacgccgcagaacttcacccccgggtgctaccgtacgttgaacttgttccgctacaagtcccgctgctacatcttcaccatgtggatcttccttcttgttctggagagcatcctgtgggctgcctccgcgagcgagacgcctctaaccccggtgtggaatgacaacgcccacggcgtggggtccgtccccatgcacaccgacctcgagctggacttcagcctaacctccagcagcaagtatacgtacaggcgcaagctcactaaccccctggaggaggcccaatccatcgacctgcacatcgagatcgaggagcagaccattggcgtggacgtgcacgccttgggacactggttcgatggccggctgaacctgaagaccagcttccactgctacggtgcctgcacgaagtatgagtatccctggcacaccgcgaagtgccactacgagcgcgactaccagtacgaaacctcgtgggggtgcaacccgagcgactgccccggcgtcgggaccggctgcacggcctgcggcctctacctggaccgcctgaagcctgtggggtccgcctacaagatcattaccatccggtacagccgccgagtgtgcgtccagttcggtgaggaaaacctctgtaagattattgatatgaacgattgcttcgtgtcccgccacgtgaaggtctgcatcataggaaccgtgtccaagttctcgcagggagacaccctcctgttcttcgggcccctcgaaggcggcgggctgatcttcaaacattggtgcacgagcacttgccagttcggcgacccgggggacatcatgagccctcgggacaagggcttcctgtgccccgagttccccgggtccttccggaaaaagtgcaacttcgccaccaccccgatctgcgaatacgacggcaacatggtgtccggttacaagaaggtcatggcgaccatcgacagctttcagtccttcaacacgagcaccatgcacttcaccgacgagcgaatcgagtggaaagaccccgacggtatgctccgcgaccacatcaacatcctggtgacgaaggacatcgacttcgacaacctgggcgaaaacccctgcaagatcgggctccagacctccagcatcgagggagcgtgggggtccggcgtgggcttcacactgacatgcctcgtcagccttacggagtgccctacctttcttaccagcatcaaggcctgcgacaaagccatctgctacggggccgagtccgtcactctgacgcggggccagaacaccgtgaaggtcagcgggaaagggggccactccggcagtaccttcaagtgctgccacggcgaggactgctcccagatcgggctccacgccgcggccccgcacctggacaaggtgaacggcatcagcgaaatggaaaactccaaggtttacgacgacggggcgccccagtgcggcatcaagtgttggttcgtcaagagcggggagtggatctccgggatcttctctggtaattggatcgtgctgatcgtcctctgcgtgttcctgctattctccctcgtgctactgagcatcctctgccccgtccgcaagcacaagaagtcctga

SEQ ID NO: 14977 - RNA, 3408 nt, synthetic construct; identical to SEQ ID NO: 11691
  misc_feature 1..3408: note = derived and/or modified CDS sequence (opt11) from HTNV(Aa14-404)__KT935018.1__GP
  source 1..3408: mol_type = other RNA

SEQ ID NO: 14978 - RNA, 3408 nt, synthetic construct
  misc_feature 1..3408: note = derived and/or modified CDS sequence (opt11) from HTNV(Aa14-423)__KT935022.1__GP
  source 1..3408: mol_type = other RNA
atgggcatctggaagtggctggtgatggccagcctcgtctggccagtgctgaccctccgcaacgtgtacgatatgaagatcgagtgcccccacaccgtcagcttcggcgagaacagcgtgatcggctacgtggagctcccgcccatgcccctggctgacacggcgcagatggtccccgagtccagctgcagtatggacaaccaccagagcttaaataccatcaccaagtacacccaagtgtcctggcgggggaaggccgaccagagccagtcctctcagaactccttcgagacggtgagcaccgaggtcgacctcaaagggacctgcgtgctgaagcacaagatggtggaggagtcctaccgctcgcggaagtccatcacgtgctacgacctgagttgtaacagcacctactgcaagcccaccctctacatgatcgttcccatccacgcctgcaacatgatgaagtcctgcctgatcgccttagggccctaccgcgtccaggtggtgtatgagcggacctattgcatgaccggcgtgctcatcgagggcaagtgcttcgtaccggaccagtccgtcgtgagtatcattaagcacgggatcttcgacatcgccagcgtccacatcgtctgcttcttcgtggcggtcaaaggcaacacgtacaagatcttcgagcaggtcaagaagtccttcgaatccacgtgcaacgataccgagaacaaggtccaggggtactacatttgcatcgtcggcgggaactccgcccccatctatgtgcccaccctggacgatttccgcagcatggaagccttcacaggcatattccggagcccccacggcgaggaccacgacctggccggggaggagatcgcgacctacagcatcgtgggcccggccaacgccaaggtcccccactccgcctcgtccgacaccctcagcctgatcgcctacagcgggatcccgagctattccagcctgtccatcctcaccagctccacggaggctaagcacgtgttcagccccggccttttcccgaagctgaaccacaccaactgcgacaagtccgccatccccctcatgtggacaggcatgatcgacctgcccgggtactacgaggccgtgcacccctgcaccgtcttctgtgtgctgagcggcccgggtgccagctgcgaggcgttttccgagggcggcatcttcaatatcactagccccatgtgcctcgtatccaagcagaaccgcttccggctgaccgagcagcaggtcaacttcgtctgccagcgcgtggacgtcgacatcgtggtgtactgcaacggccagcggaaggtcatcctgaccaagaccctcgtgatcggccagtgcatctacaccatcacgagcctgttctccctgctccccggggtggcgcacagcatcgccgtcgagctgtgtgtgcccggcttccacgggtgggctaccgccgccctgctcgtgactttttgcttcgggtgggtcctgatcccggcgatcacgctgatcatcctcaccatcctaaagttcatcgccaatatcttccacacctccaaccaggagaacaggctcaagagcgtgctccggaaaataaaggaggagttcgagaagaccaaggggtccatggtgtgcgacgtctgcaaatacgagtgcgagacgtacaaggagctgaaggcccacggcgtgagctgcccccagtcccagtgcccctattgctttacccactgcgagcccaccgaggccaccttccaggcccactacaaggtgtgccaggtcacccaccgcttccgggatgacctgaagaagacggtgaccccgcagaacttcacccccggatgctaccgcaccctcaacctgttccgctacaagagccgctgctacatcttcacgatgtggatcttcctgctcgtgctggagtccatcctgtgggcggccagcgcctccgagacgcccctcaccccggtctggaacgacaacgcccacggggtgggtagcgtgcccatgcacaccgacctggagctggacttctccctgaccagcagctccaagtacacctaccgccgcaagctcaccaaccccctggaggaggcgcagagcatcgacctgcacatcgagatcgaggaacagaccatcggggtcgacgttcacgccctaggccactggttcgacgggcggctgaacttaaagacgtcattccactgctacggcgcctgcaccaagtacgaatacccctggcacactgccaagtgccactacgagcgcgactaccagtacgaaacctcctggggctgcaacccgtcagactgccccggggtgggcacggggtgcaccgcctgcggtctctacttagaccagctgaagcccgtcggcagcgcgtacaagatcatcaccatccgttactcccggcgcgtatgcgtgcagttcggggaggagaacctctgcaagatcatcgacatgaacgactgtttcgtgagccgccacgtcaaggtgtgcatcataggcaccgtctccaagttcagccagggggacacgctgctgttcttcggacctctcgagggcggcggccttatcttcaagcactggtgtacctctacgtgtcagttcggggacccgggggacatcatgagcccccgcgacaaggggttcctgtgccccgagttccccggctcctttcggaagaagtgcaacttcgcaaccaccccgctctgcgagtacgacgggaacatggtgagcggctacaagaaagtgatggccaccatcgactccttccagtcattcaacacctcaaccatgcacttcacggacgagaggatcgagtggaaagaccccgacggcatgctgcgggaccacatcaacatcctggtcaccaaggacatcgacttcgacaacctcggggagaacccctgcaagatcggcctgcagaccagctccatcgagggggcctggggcagcggggtgggcttcaccttaacgtgcttagtgagcctgaccgaatgccccactttcctgaccagcatcaaggcctgcgacaaggcgatctgctacggcgccgagagcgtcacactcacccgcgggcagaacactgtgaaggtgtccggcaagggcgggcacagtgggtccacctttaagtgctgccacggggaggactgcagccagatcggcctgcacgccgccgccccgcacctggacaaggtcaacgggatctcagagatggagaacagcaaggtgtacgatgacggcgcgccccagtgcggaatcaagtgttggttcgtcaagtccggcgagtggatcagcggaatctttagcgggaactggatcgtgctcatcgtgctgtgcgtcttcctgctgttcagcctggtgctgctcagtatcctgtgcccagtgcggaagcacaagaagtcctga

SEQ ID NO: 14979 - RNA, 3408 nt, synthetic construct
  misc_feature 1..3408: note = derived and/or modified CDS sequence (opt11) from HTNV(Aa15-56)__KU207187.1__GP
  source 1..3408: mol_type = other RNA
atgggcatctggaagtggctggtcatggccagcctcgtctggcccgtgcttaccctgcgcaacgtgtacgacatgaagatcgaatgcccccacaccgtctcctttggggagaacagcgtgatcggctacgtggagctcccgcccatgcccctggccgacacggcacagctggtccccgagtcaagctgctccatggacaatcaccagagcctcaacaccatcaccaagtacacccaggtgtcgtggcggcgcaaggccgaccagagccagtctagccagaactccttcgagacggtcagcacagaggtagacctgaagggaacctgcgtgctgaagcacaagatggtggaggagtcctaccggagccgcaagtccattacctgctacgacctcagctgcaactccacgtactgcaagcccaccctgtacatgatcgtacccatccacgcgtgcaacatgatgaaaagctgcctgatcgccctcggcccctaccgggtccaggtggtgtatgagcgcacctactgcatgacaggggccctgatcgagggcaaatgcttcgtgccggaccagtccgtggtcagcatcatcaagcatggcatcttcgatatcgcgagcgtgcacattgtgtgcttcttcgtcgcggtaaaggggaacacgtacaagatcttcgagcaggtaaagaagtcctttgaaagcacgtgcaacgacaccgagaacaaggtccagggctactacatctgcatcgtcgggggcaactccgcccccatctacgtgcccaccctggacgacttccggagcatggaggccttcaccggtatcttccgcagcccccacggcgaggaccacgacctcgcgggcgaggagaccgccacctactccatcgtggggccggccaacgctaaggtgccccactccgccagctccgacaccctgagcctgatcgcgttctccggcatccccagctactccagcctctccatcctgacgagctccaccgaggccaagcacgttttcagccccggcctgttcccgaagctcaaccacaccaactgcgacaagggcgccatccccctaatgtggaccggcatgatcgacctgcctgggtactacgaggccattcacccatgcacggtgttctgcgtgctctccggcccgggcgccagctgcgaagcgttctccgaaggcgggatcttcaacattacctcccccatgtgcctagtcagcaagcagaaccggttccgcctgaccgagcaacaggtgaacttcgtgtgccaaagggtcgacgtggacatcgtggtctactgcaacggccagcgcaaggtgatcctcaccaagacgctggtgatcggccagtgcatatacaccatcacgagtctgttcagcctcctgccgggggtcgcccactccatcgccgtggagctgtgcgtgcccggcttccatgggtgggcgaccgccgcgctcctggtgacgttctgcttcggctgggtgctgatcccggccatcacctttatcatcctcaccatcttgaagttcatcgccaacatctttcataccagcaaccaggagaaccggctgaagtccgtactacggaagatcaaggaggagttcgagaaaacgaagggtagcatggtctgcgacgtgtgcaagtacgaatgcgagacctacaaggagctcaaggcccacggggtgagttgcccccaaagccagtgcccctattgcttcacccactgcgaacccaccgaggccgcgttccaggcccactacaaggtctgccaggtgacccaccggttccgcgacgacttaaagaagacggtgacccctcagaacttcactcccggctgttaccggaccctcaacctgttccgctacaagagtcggtgctacatcttcacgatgtggatattcctgctcgttctggagagcatcctgtgggccgcctccgcgtccgagacacccctcaccccggtgtggaacgacaacgcccacggggtgggatccgtccccatgcacaccgacctggagctggacttcagcttgacgtccagcagcaagtacacctaccgccggaagctcaccaaccccctggaggaggcccagtccatcgacctgcacatcgagatcgaggagcagactatcggtgtggacgtgcacgccctcggccactggttcgatgggcgactgaacctgaagacgagcttccactgctacggcgcctgcaccaagtacgagtacccctggcacaccgcgaagtgccactacgagcgcgactaccagtacgagacctcctggggctgcaatccgagcgactgccccggggtaggcacgggatgcaccgcctgcggtctctacctggaccggctgaagcccgtgggctccgcctataagatcatcaccatcagatacagccggcgcgtgtgcgtccaatttggggaagagaacctctgcaagatcatcgacatgaacgactgcttcgtgtcccgtcacgtcaaggtgtgcattatcggcaccgtgagcaagttctctcagggggacacgcttcttttcttcggccccctcgaagggggcggcctgatcttcaagcactggtgcaccagcacctgtcagttcggggaccccggtgacatcatgagcccccgcgataaggggttcctgtgccctgagttccccggctccttccggaagaagtgtaacttcgccaccacgccgatctgcgaatacgacggaaacatggtgtccggctacaagaaagttatggcaaccatcgacagcttccagtcgttcaacaccagcaccatgcacttcacggatgagcgcatcgagtggaaggaccccgacggcatgctccgggaccatatcaacatcctggtgaccaaggacatcgacttcgacaacttgggggagaatccctgcaagatcggcctccagacctcaagcatcgagggagcgtggggctccggggtcggcttcaccctgacgtgcctggtcagcctcaccgagtgccccaccttcctgaccagcatcaaggcctgtgacaaggccatctgctacggcgccgagtccgtgacgctgacccgcgggcagaacaccgtgaaggtcagcggcaaagggggccactccgggagcacctttaagtgctgccacggcgaggactgctcccagatcggactccacgccgcggccccgcacctggacaaggtgaatggcatcagcgagatggagaacagtaaggtgtacgacgacggcgctccccagtgcgggatcaagtgttggttcgtcaagagcggcgagtggatctccggcatctttagcgggaactggatcgtgctgatcgtcctctgcgtattcctgctgttttccctcgtgctgctgagcatcctctgccccgtccggaagcacaagaagtcctga

SEQ ID NO: 14980 - RNA, 3408 nt, synthetic construct; identical to SEQ ID NO: 11694
  misc_feature 1..3408: note = derived and/or modified CDS sequence (opt11) from HTNV(CBAa11-106)__KC576787.1__GP
  source 1..3408: mol_type = other RNA

SEQ ID NO: 14981 - RNA, 3408 nt, synthetic construct
  misc_feature 1..3408: note = derived and/or modified CDS sequence (opt11) from HTNV(CBAa11-26)__KC576786.1__GP
  source 1..3408: mol_type = other RNA
atgggcatgtggaagtggctggtgatcgccagcttagtctggcccgccctaaccctccgtaacgtgtacgacatgaagatcgagtgtccgcacaccgtgtcctttggggagaacagcgtcatcggctatgtggagctcccgcccatgcccctggccgatacggcccagatggtgcccgagtccagctgctccatggacaaccaccagagcatgaacaccatcaccaaatacacccaggtcatctggcggggaaaggccgaccccggccagtccagccagaactccttcgagacggttagcaccgagatcgacctgaaggggacctgcgtgctcaagcacaagatggtcgaggagtcctaccgcagccggaagtccattacctgctacgacctgagctgcaactccacgtactgcaaaccaaccctgtatatgatcgtgcccatccacgcctgcaacatgatgaaaagctgcctcatcgctctgggcccctaccgcgtgcaggtcgtgtacgagcggacctactgcatgaccggcgtactgatcgaaggaaagtgcttcgtccccgaccagtccgtggtgagcatcatcaagcatggcatcttcgacatcgcgtccgtacacatcgtgtgcttcttcgtggcagtcaaggggaacacgtacaaacttttcgaacaggtgaaaaagagcttcgagagcacgtgcaacgacaccgagaacaaggtacagggctactatatctgcatagtcgggggcaactccgcccccatctacgtgcccaccctggatgatttccggagcatggaggcattcaccggcatcttccggtccccgcacggggaggaccacgacctggcgggcgaggagatcgccagctactccatcgtcgggcccgccaatgcgaaggtgccccacagcgccagcagcgacaccctctctctgatcgcgtacagtggtatcccctcctacagcagcctgagcatcctcacctccagcaccgaggccaagcacgtgttctccccgggcctgttccccaagctgaatcacacgaactgcgacaagagcgccatccccctcacctggaccggtatgatcgacctgcccggctactacgaggccatccacccgtgcaccgtcttctgcgtgctgagtggtcccggcgccagctgcgaggcgttcagcgagggaggcatcttcaacatcacgtcccccatgtgcctcgtgagcaagcagaatcgcttccggctgaccgagcagcaggtcaacttcgtgtgccagagggtggacatggacatcgtcgtctactgcaacgggcagcggaaggtgatcctgaccaagaccctcgtcatcgggcaatgcatctacacgatcacctccctgttcagcctgctcccaggcgtggcccactccatcgccgtggagctgtgcgtcccggggtttcacggctgggccaccgccgcgctgctcgtgaccttctgcttcgggtgggttctgatccccgccatcacgttcatcatcctgactgtactcaagttcgtggccaacatcttccacaccagcaaccaggagaaccgcctgaagtccgtgctacggaagatcaaggaggagttcgagaagaccaagggcagcatggtctgcgatgtgtgcaagtacgagtgcgagacgtataaggagctcaaggcccacggcgtatcctgcccccagagccagtgcccctactgcttcacccactgcgagccgaccgaggccgcgttccaggcccactacaaggtctgccaggtgacccatagatttcgggacgaccttaagaagaccgtgactccccagaacttcacccccggatgctaccgcaccctgaacctcttccggtacaagagtcgatgctacatcttcaccatgtgggtctttctgctgatcttggagagcgtgctttgggccgcctccgcgagcgagacgccgctgacccccgtgtggaatgacaacgcccacggcgtcgggtccgtgcccatgcacaccgacctcgaactggacttcagcctgacctccagcagcaagtacacgtaccggcgcaagctgactaacccgctcgaggaggcccagtccatcgacctgcacatagaaattgaggagcagaccatcggcgtggacgtccacgccctgggtcactggttcgacggccggcttaacctgaagaccagcttccactgctacggcgcctgcacgaagtacgagtacccgtggcacaccgccaagtgccactacgagcgcgactaccagtatgagacctcctggggttgcaaccccagcgactgccctggcgtggggaccggctgcacggcctgcggcttatacctcgaccagctgaaacccgtggggtccgcctacaagatcatcaccatccgctacagccggcgcgtctgcgtgcagttcggcgaggagaacctgtgcaagatcatcgacatgaacgactgcttcgtaagtcggcacgtgaaggtttgcatcatcgggaccgtgagcaagttctcccagggtgacaccctcctgttcttcgggccgctggaaggcggcggccttatcttcaaacactggtgcacgagcacatgccaattcggcgaccccggggacatcatgtccccacgcgacaagggcttcctgtgccccgagttcccggggagcttccggaagaagtgcaacttcgccaccacccccatctgcgagtacgacggcaacatggtctctggctacaagaaggtgatggccacgatagactctttccagtccttcaacaccagcaccatgcacttcaccgacgagcgcattgagtggaaggaccccgacggtatgctgcgggaccacattaacatcctcgtgaccaaggacatcgacttcgacaacctgggagagaacccctgcaagatcgggctgcagacctccagcatcgagggcgcgtgggggtccggtgtgggcttcaccttgacctgcctggtttctctgacggagtgcccgaccttcctcaccagcatcaaggcctgcgacaaggcgatttgttacggggccgagtccgtgaccctgacgcgcggccaaaacaccgtcaaggtgtcagggaagggcgggcactccggcagcaccttcaagtgctgccacggcgaggactgctcccagatcgggctgcacgccgcggctccccatctcgacaaggtgaacggcatcagcgaaatcgagaactccaaggtctacgacgacggggctccccagtgcggcatcaagtgttggttcgtaaagagcggcgagtggatctccgggatcttcagcgggaactggatcgtgctgatcgtgctgtgcgtctttctcctcttctccctggtcttgctgagcatcctgtgccccgtgagaaagcacaagaagtcctga

SEQ ID NO: 14982 - RNA, 3408 nt, synthetic construct
  misc_feature 1..3408: note = derived and/or modified CDS sequence (opt11) from HTNV(Fuyuan-Aa-145)__KJ857336.1__GP
  source 1..3408: mol_type = other RNA
atgggcatgtggaagtggctggtgatcgccagcctcgtctggcccgccctgtccctgcgcaacgtgtacgatatgaagatcgagtgcccgcacaccgtgtcattcggggagaactccgtcatcggttacgtggagctcccgcccatgcccctggccgacactgcccagatggtgcccgaaagctcctgcagcatggacaaccaccagtccatcaacacgatcaccaagtacacccaggtcatctggcgggggaaggccgaccccggccagagctcccaaaacagcttcgagaccgtgtccacggaggtggacctgaaggggacctgcgtcctcaagcacaagatggtggaggagagctaccgctcccgcaagagcataacctgctacgacctgtcctgcaacagcacattctgcaagcccacgctgtacatgatcgtgcccatccacgcctgcaacatgatgaagtcctgcctcatcgccctgggcccgtaccgggtacaggtggtctacgagcggacctactgcatgaccggggtcctgatcgaggggaagtgcttcgtgcccgaccagagcgtggtctccataatcaagcacggcatcttcgacatcgccagcgtgcacgtggtctgcttcttcgtcgccgtgaaggggaacacctacaaactcttcgagcaggtcaaaaagagcttcgagtccacgtgcaacgacaccgagaacaaggtgcagggctactacatctgcatcgtagggggcaacagtgcccccatctacgtgcctaccctggacgacttccgctccatggaggccttcaccggcatcttcaagagtccgcacggggaggaccatgacctggcgggcgaggagatcgcctcctacagcatcgtgggacccgccaacgccaaggtcccccactccgccagctctgacacgctcagcctgatcgcgtactccggcatcccctcctactccagcctatccatcctgaccagctccaccgacgccaagcacgtgttcagcccaggcctgttccccaagctgaaccataccaattgcgacaagtccgccatccccctcacatggacagggatgatcgacctgccgggctactacgaggcaatccacccgtgcaccgtgttctgcgtcctgagcgggcccggcgcgagctgcgaggcgttctccgaagggggcatcttcaacatcaccagccctatgtgcctcgtgtccaagcagaaccggttccgcctgacggagcagcaggtaaacttcgtctgccagcgggtggacatggacatcgtggtctactgcaacggccagcgcaaggtgatcctgaccaagaccctcgtgatcggtcagtgcatctacaccatcacgagcctgttttccctgctccccggcgtcgcccacagcatcgccgtggagctgtgcgtgcctgggttccacggctgggccaccgccgcgctgctcgtcaccttctgcttcgggtgggtgctgatccccgccgtgaccttcatcatcctgacggtcctcaagttcatcgccaacatcttccacacctccaaccaggaaaaccggctcaagagcgtgctgcgcaagatcaaggaggagttcgaaaagaccaaggggtcgatggtgtgcgacgtctgcaagtacgagtgcgagacctacaaggagctaaaggcccacggcgtgagctgcccccagtcccagtgcccctactgcttcacgcactgcgagccgaccgaggccgcgttccaggcccattacaaggtgtgccaggtcacccaccggttccgcgacgacctgaagaagaccgtgacgccccagaacttcacccctgggtgttaccggaccttgaacctcttccgctacaagagccggtgctacatcttcaccatgtgggtgttcctgctgatcctcgagtccgtcctgtgggccgctagcgcgtccgagaccccgctgacgcccgtgtggaacgacaacgcccacggcgtgggcagcgtccccatgcacaccgacctcgagctggacttctccctgaccagcagctccaagtacacctaccgccggaagctgacgaaccccctcgaagaggcgcagagcatcgacctgcacatcgagatcgaggagcagaccatcggcgtggacgtgcacgccctggggcactggttcgatggccgcctcaacctgaagacctcgttccactgctacggcgcctgcaccaagtacgagtacccgtggcacacggcgaagtgccactacgagcgggactaccagtacgagaccagctgggggtgcaacccctccgactgccccggcgtcgggaccggctgcaccgcctgcggcctttacttggaccagctgaagccagtggggagcgcctacaagatcatcacgatccgctactcccgccgggtgtgcgtccagttcggcgaggaaaacctgtgtaagatcatcgacatgaacgactgcttcgtgagccgccacgtgaaggtctgcatcatcgggaccgtgtccaagttcagccagggcgacaccctcctgttcttcgggccgttagagggcggcgggctcatcttcaagcattggtgcacctccacgtgccagttcggcgaccccggggacatcatgagcccccgggacaagggcttcttatgccccgagttcccagggtccttccgcaagaagtgcaacttcgccaccacccccatctgcgagtacgacggcaacatggtgagcggctacaagaaggtcatggccacaatcgactccttccagagcttcaacacgtccaccatgcacttcacggacgagcggatcgagtggaaggaccccgacgggatgctgcgcgaccacatcaacatcctcgtgaccaaggacatcgacttcgacaacctgggcgagaacccctgcaagatcgggctgcagacgagctccatcgagggcgcgtgggggagcggggtgggcttcaccctgacctgcctggtcagcctgaccgagtgcccgacgttcctcacctccatcaaggcctgcgacaaggccatctgctacggggccgagagcgtgaccctgacccggggtcagaacacggtgaaggtctccgggaagggcgggcacagcggctccaccttcaagtgctgccacggcgaggactgcagcaagatcgggctgcatgccgcggcgccccacctcgacaaggtgaacggcatctccgagatcgaaaacagcaaggtctacgacgacggggctccccagtgcggcatcaagtgctggttcgtgaagtccggcgagtggatcagcgggatcttctccggcaactggatcgtgctgatcgtcctgtgcgtgttcctcctgttcagcctggtgcttctgtccatcctgtgccccgtacgcaagcacaaaaagagctga

SEQ ID NO: 14983 - RNA, 3408 nt, synthetic construct
  misc_feature 1..3408: note = derived and/or modified CDS sequence (opt11) from HTNV(Fuyuan-Aa-26)__KJ857334.1__GP
  source 1..3408: mol_type = other RNA
atgggcatgtggaagtggcttgtgatcgccagcctcgtctggcccgccctgtccctgcgcaacgtgtacgacatgaagatcgagtgcccgcacaccgtgagcttcggggagaactccgtcatcggctacgtggagctgcccccaatgcccctggccgacaccgcccagatggtgccggagagctcctgcagcatggacaaccaccagtccatcaacacgatcaccaagtacacccaggtcatctggcgggggaaggccgaccccggccagagctcccagaacagcttcgagaccgtgtccacggaggtggacctgaaggggacctgcgtcctcaagcacaagatggtggaggagagctaccgctcccgcaagagcattacctgctacgacctgtcctgcaacagcacctactgcaagcccacgctatacatgatcgtgcccatccacgcctgcaatatgatgaagtcctgtctcatcgccctgggcccgtaccgggtccaggtggtgtacgagcggacctactgcatgaccggcgtcctgatcgaggggaagtgcttcgtgcccgatcagagcgtggtttccatcatcaagcacggcatcttcgacatcgcgagcgtgcacatcgtgtgcttcttcgtcgccgtcaaggggaacacctacaaactcttcgaacaggtgaaaaagagcttcgagtccacgtgcaatgatactgagaacaaggtccagggctactacatctgcatcgtcgggggcaacagcgcccccatctacgtgcccaccctggacgacttccgctccatggaggccttcaccggcatcttcaagagcccgcacggggaggaccacgacctggcgggcgaggagatcgcctcctatagcatcgtgggacccgccaacgccaaggtgccccactccgccagctccgatacgctcagcctgatcgcttactccggcatccccagctactccagcctgtccatcttaaccagctccaccgacgccaagcacgtcttcagcccgggcctgttccccaagctgaaccacaccaactgcgacaagtccgccatccccctcacgtggaccgggatgatcgacctgcccggctactacgaggccatccacccgtgcaccgtgttctgcgtgctgagcgggcccggcgcctcctgcgaggcgttctccgaagggggcatcttcaacatcaccagccccatgtgcctcgtctccaagcagaaccggttccgcctgacggagcaacaggtgaacttcgtgtgccagcgggtcgacatggacatcgtggtgtactgcaacggacagcgcaaggtgatcctgaccaagaccctcgtgatcgggcagtgcatctacaccatcacgagcctgttctccctgctccccggcgtggcccacagcatcgccgtcgagctgtgcgtcccggggttccacggctgggccaccgccgcgctgctcgtgaccttctgctttggctgggtcctgatccccgcagtgaccttcatcatcctgacggtgctcaagttcatcgccaatatcttccacacctccaaccaggagaaccggctcaagagcgtcctgcgcaagatcaaggaggagttcgagaagaccaagggctccatggtgtgcgacgtgtgcaagtacgagtgcgagacctacaaggagctcaaggcccacggcgtcagctgcccccagtcccagtgtccctactgcttcacgcactgcgagccgacagaggccgcgttccaggcccactacaaggtatgccaggtgacccaccggttccgcgacgacctgaagaagaccgtcacgccccagaacttcacccccggctgctaccggaccctgaacctcttccgctacaagagccggtgctacatcttcaccatgtgggtgttcctgctgatcctcgagtccgtgctgtgggccgccagcgcgtccgagaccccgctaacgcccgtctggaacgacaacgcccatggcgtggggtctgtgcccatgcacaccgacctcgagctggacttctccctgaccagcagctccaagtacacctaccgccggaagctgacgaaccccctcgaggaggcccagagcatcgatctgcacatcgagatcgaggagcagaccatcggcgtcgacgtgcacgccctggggcactggttcgatggccgcctcaacctgaagacctccttccactgctacggcgcctgcaccaagtacgagtacccgtggcacacggcgaagtgccactacgagagagactaccagtacgagaccagctgggggtgcaacccctccgactgccccggcgtggggaccggctgcaccgcctgcggcctgtacctcgaccagctgaagcccgtcgggagcgcttacaagatcatcacgatccgctactcccgccgggtgtgcgtgcagttcggcgaggagaacctgtgcaagatcattgacatgaacgactgcttcgtctcacgccatgtgaaggtgtgcatcatcgggaccgtctccaagttcagtcagggcgacaccctcctgttcttcgggccgctggagggcggcgggctcatcttcaagcactggtgcacctccacgtgccagttcggcgaccccggggacatcatgagcccccgggacaaaggcttcctgtgccccgagttcccggggtccttccgcaagaagtgcaacttcgccaccactcccatctgcgagtacgacggcaacatggtgagcgggtacaagaaagtgatggccaccatcgactccttccagagcttcaacacgtccaccatgcacttcaccgacgagcggatcgagtggaaggaccccgacgggatgctgcgcgaccacatcaacatcctcgtcaccaaagacatcgactttgacaacctgggcgagaacccctgcaagatagggctgcagacgagctccatcgagggcgcgtgggggagcggcgtgggcttcaccctgacctgcctcgtgagcctgaccgagtgtcccacgttcctcacctccatcaaggcctgcgacaaggccatctgctacggggccgagagcgtcaccctgacccggggccagaacacggtgaaggtgtccgggaagggcgggcacagcggctccaccttcaagtgttgccacggtgaggactgcagcaagatcgggctgcacgccgcggcgccccacctcgacaaagtcaacggcatcagtgagatcgagaacagcaaggtgtacgacgacggggctccccagtgcggaatcaagtgctggttcgtcaagtccggcgagtggatcagcgggatattctccggcaactggatcgtgctgatcgtactgtgcgtcttcctcctgttcagcctggtgctcctgtccatcctgtgccccgtgcgcaagcacaaaaagagctag

SEQ ID NO: 14984 - RNA, 3408 nt, synthetic construct
  misc_feature 1..3408: note = derived and/or modified CDS sequence (opt11) from HTNV(JS1)__KP970560.1__GP
  source 1..3408: mol_type = other RNA
atgggtatctggaagtggctggtgatggcctctctcgtctggcccgtcctgaccctgcgcaacgtgtacgacatgaagatcgagtgtccgcataccgtctccttcggaggcaacagcgttatcgggtacgtggagctcccgcccgtccccctggccgacacggcccagatggtgcccgagtccagctgctccatggacaaccaccagagcctgaacaccatcgctaagtacacccaggtgtcctggcggggcaaggccgaccagagccagtccagccagaactccttcgagaccgtcagcacggaggtggacctcaaggggacctgcgtgctgaagcacaagatggttgaggagtcctaccgcagccgtaagtccgtgacctgctacgacctgagctgcaattccacctactgcaagcccacgctctacatgatcgtgcccatacacgcctgcaacatgatgaagtcatgcctgatcgccctgggcccctaccgcgtccaggtggtgtacgagcggacctactgcatgaccggcgtcctcatcgaggggaaatgcttcgtgcccgaccagtccgtggtcagcatcatcaagcacggcatcttcgacatcgcgagcgtgcacatcgtgtgcttcttcgtcgcagtgaaggggaacacctacaagatcttcgagcaggtcaagaagtccttcgagagcacgtgtaacgacaccgagaacaaggtgcagggctattacatctgcatcgtcgggggcaactccgcccccatctacgtgcctaccctggacgacttccgcagcatggaggccttcaccggcatattccggagcccgcacggagaggaccacgacctggcgggcgaggagatcgcctcctactccatcgtggggccggccaacgccaaggtgccccacagcgcctccagcgacacgctctccctgatcgcgtacagcggcatcccctcctacagctccttaagcatcctcacctccagcaccgaggcgaagcacgttttctcccccggcctgttccctaagctgaaccacaccaactgcgacaagagcgccatccccctcatctggacggggatgatcgacctgcccggctactacgaggccgtgcacccctgcaccgtgttctgcgtcctgagcgggccgggcgccagctgcgaggcgttcagcgagggcgggattttcaacatcacctcccccatgtgcctcgtgagcaagcagaaccgctttcggctgaccgagcagcaggtaaacttcgtgtgccagcgcgtggacatggacatcgtggtttactgcaacggccagcgcaaggtgatcctgacgaagaccctcgtcatcgggcagtgcatctacaccatcacctccctgttcagtctgctccccggcgtcgcccactccatcgcggtggagctgtgcgtgcccgggttccacggctgggccacggccgcactcctcgtcaccttctgcttcgggtgggtgctgatcccggccatcaccttcatcatcctgaccgtgctcaagttcatcgccaacatcttccacacgagcaatcaagagaaccgcctgaagtccgtcctccggaagatcaaggaggagttcgagaagaccaaaggcagcatggtgtgcgacgtttgcaagtacgagtgcgagacctacaaggagctcaaggcccacggcgtctcctgcccccaaagccagtgcccctactgcttcacccactgcgagcccacggaggccgcgttccaggcccactacaaggtgtgccaggtgacccaccgcttccgggacgacctgaagaagaccgtcaccccgcagaacttcacccccgggtgctaccgcacgctgaacctcttccggtacaagtcccgctgctacatcttcaccatgtggattttcctgctggttctcgagagcatcctgtgggccgcctccgcgagcgaaacgcccctgaccccggtgtggaacgacaacgcccacggcgtcgggtccgtgcccatgcacaccgacctcgagctggacttcagcctgaccagctccagcaagtacacctaccggcgcaagctgaccaaccccctcgaggaggcccagtccattgacctccacatcgagatcgaggagcagacgatcggcgtggacgtccacgccctggggcactggttcgacggccggctcaatctgaagaccagcttccactgctacggcgcctgcaccaagtacgaatatccctggcacaccgcgaagtgccactacgagcgcgactaccagtacgagacgtcctgggggtgcaacccgtcggactgccccggcgtggggaccggctgcaccgcctgcggcctgtacctcgaccagctgaagcccgtggggtccgcctacaagatcattaccatcaggtacagccggcgcgtctgtgtgcagttcggagaggggaacctgtgcaagatcatcgacatgaacgactgcttcgtgtcccggcatgtcaaagtgtgcatcatcggcacggtgtcgaagttctcccagggggacaccctcctgttcttcggccccttggagggcgggggcctcatcttcaagcactggtgcacctccacgtgccagttcggggacccgggcgacatcatgagcccccgcgacaaggggttcctgtgtcccgagttccccggcagcttccgtaagaagtgcaatttcgccaccaccccgatctgcgagtacgacggcaacatggtctccgggtacaagaaggtgatggccaccatcgacagcttccagtccttcaacaccagcaccatgcacttcaccgacgagcgcatcgagtggaaggaccccgacggcatgctgcgagaccacatcaacatcctcgtgaccaaggacatcgacttcgacaacctgggggagaacccctgcaagatcggcctccagacctccagcatcgagggggcgtggggcagcggcgtcgggttcacgctgacctgcctcgtgtccctgaccgagtgccccaccttcctcacgagcatcaaggcctgcgacaaggccatctgctatggcgccgagtccgtgaccctgacccgcgggcagaacaccgtcaaggtgagcggcaagggcgggcactccggcagcacgttcaagtgctgccacggggaggactgctcacagatcggcctgcacgccgcggccccgcacctcgacaaggtcaacgggatcagcgagatcgagaactccaaggtgtacgacgacggcgcgccacagtgcggcatcaagtgctggttcgtcaagagcggggagtggatctccggcatcttcagcgggaactggatcgtgctgatcgtgctgtgcgtgttcctcctgttctccttggtgctcctgagcatcctgtgccccgtgcggaagcataagaagtcatga

SEQ ID NO: 14985 - RNA, 3408 nt, synthetic construct
  misc_feature 1..3408: note = derived and/or modified CDS sequence (opt11) from HTNV(LongquanAa-08-150)__JQ912803.1__GP
  source 1..3408: mol_type = other RNA
atgggcatctggaagtggctggtcatggccagcctcgtctggcccgccttcaccctgcgcaacgtgtacgacatgaagatcgagtgcccgcacaccgtgtccttcggggagaacagcgtaatcggctacgtggagctgccgcccatgcccctcgccgacacggcccagatggtgcccgagtccagctgcaacatggacaaccaccagtccatgaacacgatcaccaagtacactcaggtcagctggcgggggaaggccgaccaggcccaggcctcccagaacagcttcgaggcggtgtccgccgaggtggacctgaagggcatctgcgtcctgaagcacaagatgctcgaggagagctaccgctcccggaagtccatcacgtgctatgacctgtcctgcaacagcacttactgcaaacccaccctgtacatgatcgtgccaatccacgcctgcaacatgatgaagtcctgcctcatcgccctggggccctaccgcgtgcaggtcgtgtacgagcggacctactgcatgacgggcgtgctgctcgagggcaagtgcttcgtcccggatcagagcgtggtgtccatcatcaagcacgggatcttcgacatcgcgagcgtccacatcgtgtgcttcttcgtggctgtcaagggcaacacctacaagctgctggagcaggtcaagaagtccttccagagcacgtgcaacgacaccgagaacaaggtgcaggggtactacatctgcatcgtgggcgggaacagcgcccccatttacgtgcccaccctagacgacttccgctccatggaggccttcagcggcatcttccggtcaccccacggcgaggaccacgacctggccggggaggagatcgcgagctactccatcgtcggcccggcaaacgccaaggtgccccacagcgcctcgagcgacaccctgtccctcatcgcctacagcgggatcccctcctacagctccctgagcatcctggcgtccagcaccgaggccaagcacgtgttctcccccggcttcttcccgcagctcaaccacaccaagtgcgacaaaacggccatccccctgatctggaccggcatgatcgacctgcccggttactacgaggccatccacccctgcaccgtcttctgcgtgctcagtggcccgggggcctcctgcgaggcgttcagcgagggcgggatcttcaacatcaccagccccatgtgcctggtgtccaagcagaaccgcttccggctgacggagcagcaggtcaacttcgtgtgccagcgcgtggacgtcgacattatcgtgtactgcaacggtcagcggaaggtgatcttgaccaagaccctggtcatcggccagtgcatctacaccatcacgagcctgttctccctcctgcccggggtggcccatagcatcgccgtggagctgtgcgtccccggcttccacgggtgggccaccgccgcgttactggtgaccttctgcttcggctgggtgctgatcccggccctcaccctgatcatcctgacgatcctcaagttcatcgccaacatcttccacacgtgcaaccaggagaatcgcctgaagtccgtcctgcggaagatcaaggaggagttcgagaaaaccaaggggagcatggtgtgcgacgtgtgcaagtacgaatgcgagacctataaggagctcaaggcccacggcgtctcctgcccccagagccagtgcccctactgcttcacccactgcgagccaaccgaggcggccttccaggcccactaccgcgtgtgccaggtgacccaccggttccgcgacgacctgaaaaagaccgtcacgccgcagaacttcacccccggctgctaccggaccctgaacctctttcgctacaagtcccggtgctacatcttcaccatgtgggtgtgcctgctggtgctcgagagcatcctgtgggccgcctccgcgagcgaggtccccctgaacccggtgtggaacgacaacgcccacggggtgggctccgtcccgatgcacaccgacctggaactcgacttcagcctgacctccagctccaagtacacctaccgccggcgcctgaccaaccccctcgaggagacccagagcatcaacctgcatatcgaaatagaggagcagacgatcggggtggacgtgcacgccctgggccactggttcgacgggcgcctcaacctgaagaccagctttcactgctacggcgcatgcaccaagtacgagtatccctggcacaccgccaagtgccactacgagcgggactaccagtacgagacgtcatggggctgcaacccggcggactgcccaggcgtgggcaccgggtgtaccgcctgcggcctgtacctcgaccagctgaagcccgtgggcagcgcctacaagatcatcaccatccgctactcccgtaaggtgtgcgtacagttcggggaggagaacctgtgcaaggtgatcgacatgaacgactgcttcgtaacgcgccacgtcaaggtgtgcatcatcggcactgtgagcaagttctcccagggggacaccctcctgttcttcgggcccctggagggcgggggcctcatcttcaagcactggtgcaccagcacgtgccagttcggggatccgggcgacatcatgagcccccgggacaagggtttcctgtgccccgagttccccggcagcttccgcaagaagtgcaacttcgccaccacccctctgtgcgagtacgacgggaacatggtctccggctacaagaaggtgatggccaccatcgacagcttccagtcctttaacacgagcaccatgcacttcaccgacgagcgtattgagtggaaggaccccgacggcatgctccgcgaccatatcaacatccttgtgaccaaggacatcgacttcgacaacctgggggaaaatccctgcaagatcggcctccaaacaagttccattgagggggcgtggggctccggggtcggcttcaccctgacctgcctgatcagcctcaccgagtgccccacgttcctgacctccatcaaggcctgcgacaaagccatctgctacggcgccgagagtgtaaccctgacccggggccagaacacggtgaaggtctccggcaagggcgggcacagcgggagcaccttcaagtgctgccacggcgaggaatgctcccagatcggcctccacgcggccgccccgcacctggacaaggtgaacgggatcagcgagatcgagaacaacaaggtgtacgacgacggtgcgccccagtgcggcgtcaagtgctggttcgtgaagtccggtgagtggatcagcggcatcttctccgggaactggatcgtcctgattgtgctctgcgtgttcctgctgttcagcctcgtcctgctgtccgtgctctgccccgtgcgcaagcacaagaagtcctga

SEQ ID NO: 14986 - RNA, 3408 nt, synthetic construct
  misc_feature 1..3408: note = derived and/or modified CDS sequence (opt11) from HTNV(LongquanAa-08-157)__JQ912804.1__GP
  source 1..3408: mol_type = other RNA
atggagatctggaagtggcttgttatggccagcctcgtctggcccgcctttaccctccgcaatgtgtacgacatgaagatcgaatgcccgcacaccgtgtccttcggtgagaacagtgtcatcgggtacgttgagctgtctcccatgcccttagcggacacggctcagatggtgcccgagagctcctgcaacatggacaaccatcagagcatgaacacaatcaccaagtacacccaggtctcctggcggggcaaggccgatcaggcccaggcctcgcagaatagcttcgaggctgtgagtgccgaggtggacttaaaggggacgtgcgtcctgaagcataagatgctcgaggagagctaccgctctcggaagtccattacctgctacgacctgagctgcaactccacctactgcaagccgaccctgtatatgatcgtgcccatccacgcctgcaacatgatgaaaagctgcctcatcgccctgggcccctaccgcgtgcaggtagtctacgagcggacgtactgcatgaccggagtgctgatcgagggcaagtgctttgtccccgaccaatccgtggtcagcatcatcaagcacggcatctttgacatcgcttccgtacacattgtgtgcttcttcgtagccgtcaagggcaacacctacaagttgttcgagcaggtaaagaagtccttccagtcgacctgtaacggcacggaaaacaaggtgcaggggtactacatctgcatcgtcgggggcaattccgccccgatctacgtgcccaccttggacgacttccgcagcatggaggctttctccgggattttccggagcccccatggggaagaccacgatctggccggggaggaaattgcgtcctatagcatcgtcggccccgccaacgccaaggtgccgcactccgccagctctgacaccctctcattaatagcctactccggaatcccctcatactccagcctgtccatccttgctagctccaccgaggccaagcacgtgttcagtcccggcttcttcccccaactgaaccacacgaagtgtgacaagactgccatcccgcttacatggacgggcatgatcgatctccccgggtactatgaggccattcacccctgcacggtcttttgcgtactgtctggccccggggctagctgcgaggcgttcagcgagggcgggatcttcaacatcacctccccgatgtgcctcgtaagcaagcagaaccgcttccggctcaccgagcagcaggtcaactttgtgtgccagcgcgtagacatggacatcatcgtctactgcaatggccagcgcaaggtgatccttaccaagacgctggtgatcgggcaatgcatctataccataacgtccctcttcagccttctgcccggagtcgcccacagtatcgccgtggaactctgcgtgcccggcttccacgggtgggccaccgccgcgctgctggttacgttttgctttggctgggtgctcatccccgccctgactctgatcattctgaccatcctaaagttcatcgccaacctgttccacaccagcaaccaagagaaccgcctcaagtccgtgctgcgtaagatcaaggaggagttcgagaagacgaaggggagcatggtttgcgacgtgtgcaagtacgagtgcgagacctacaaggagctgaaggcccacggcgtgtcctgtccgcagagccagtgcccctactgcttcacccattgcgagcccaccgaagcggccttccaagcgcactaccgcgtctgccaggtaacgcaccggttccgcgacgacctcaaaaagaccgtgacaccccagaacttcacccctggatgttaccggaccttaaacctattccgctacaagtcccggtgctacatcttcacgatgtgggtttgcctcctagtgctggaaagcatcctctgggccgcctccgcgagcgaggtgcccctgaaccccgtctggaacgataacgcccacggggtcggctccgtgcctatgcacactgacctggagctggacttcagcctcacctccagcagcaaatacacttaccgccggcgcctgacgaatcccctggaggagacccagtccatcaacctccacatcgagatcgaggagcagaccatcggtgtagacgttcacgccctgggccactggttcgacggtcgccttaacttaaaaaccagcttccactgctacggcgcttgcacgaagtacgagtacccctggcacacggccaagtgccactacgagcgtgactaccagtatgagacctcctggggctgcaaccccgcggactgcccgggtgtcggcaccggctgcacggcctgcggtctgtacctggaccagctcaagcccgtcgggagcgcctataagatcatcaccatccgctactcccggaaagtgtgcgttcagttcggggaggagaacctgtgcaaggtcattgacatgaacgactgcttcgtgacccgccacgttaaagtctgcatcataggaactgtgagcaagttctcccagggggacacgctcctgttcttcggccccctggaagggggcggccttatcttcaagcactggtgcaccagcacctgtcagttcggggaccccggcgacatcatgtccccacgggacaaggggttcctctgccccgagttccccggcagcttccgcaaaaagtgcaacttcgccaccacgcccctttgcgagtatgacggtaacatggtgagtggctacaagaaagtcatggctactatcgacagcttccaatccttcaacaccagcaccatgcacttcacggacgagcggatagagtggaaggacccggacggcatgttaagagaccacataaacatcctcgtgaccaaggacatcgacttcgacaacctgggggagaacccctgcaagatcggcctgcagacctcctcgatcgagggggcgtggggctccggggtgggcttcaccctcacgtgcctgatcagcctgaccgagtgccccaccttcctcacctccatcaaggcctgcgacaaagccatctgctatggcgccgagagcgtcacgctgacccgggggcagaacaccgtaaaggtgagcggcaagggcgggcactccgggagcacctttaagtgctgccacggcgaggagtgctcccagatcgggttgcacgcagctgcaccccacctcgacaaggtcaacgggatctccgagatcgagaacaacaaggtgtacgacgacggcgccccacaatgcggggtgaagtgctggttcgtcaagtccggcgagtggataagcggcatattttccggcaactggatcgtgttaatcgtcttatgcgtgttcctcctgttcagcctcgtcctcctgtccgtcctgtgccccgtgcgcaagcacaaaaagagctga

SEQ ID NO: 14987 - RNA, 3408 nt, synthetic construct; identical to SEQ ID NO: 11701
  misc_feature 1..3408: note = derived and/or modified CDS sequence (opt11) from HTNV(LongquanAa-08-196)__JQ912805.1__GP
  source 1..3408: mol_type = other RNA

SEQ ID NO: 14988 - RNA, 3408 nt, synthetic construct
  misc_feature 1..3408: note = derived and/or modified CDS sequence (opt11) from HTNV(LongquanAa-08-235)__JQ912810.1__GP
  source 1..3408: mol_type = other RNA
atggagatctggaagtggctggtgatggccagtctcgtctggccagccttcaccctgcgcaacgtgtacgacatgaagatcgagtgcccgcacaccgtgtccttcggcgagaacagcgtcatcgggtacgtggagctcccgcccatgcccctcgccgacaccgcccagatggtgcccgagtccagctgtaacatggacaaccaccagtccatgaacaccatcaccaagtacacccaagtcagctggcggggcaaggcagaccaagcccaggcctcccagaacagcttcgaggcggtctccgccgaggtggacctgaaggggacgtgcgtcctgaagcacaagatgctcgaggagtcgtaccgctcccggaagtccatcacgtgctacgacctgtcctgcaacagcacctactgcaagcccaccctgtacatgatcgtgcccatccacgcctgcaacatgatgaagtcctgcctcatcgctctgggaccctaccgcgtgcaggtcgtgtatgagcggacctattgcatgacgggggtgctgatcgagggcaagtgcttcgtcccggaccaaagcgtggtgtccatcatcaagcatggcatcttcgacatcgcaagcgtccacatcgtgtgcttcttcgtggccgttaaggggaacacctacaagctgttcgagcaggtcaagaagtccttccagagcacgtgcaacggcaccgagaacaaggtgcaggggtactatatctgcatcgttggcgggaacagtgcccccatctacgtgcccaccctggacgacttccgctccatggaggccttcagcggcatcttccggagcccccacggcgaagaccacgacctggccggggaggagatcgcgtcctactccatcgtcggcccggcaaacgccaaggtgccccacagcgccagtagcgacaccctctccttaatcgcatacagcggcatcccgtcctacagctccctgagcatcctcgcgtccagcaccgaggccaagcacgtgttctctcccggcttcttcccgcagctgaaccacacgaagtgcgacaagaccgccatccccctgacctggaccggcatgatcgacctccccgggtactacgaggcaatccacccctgcacggtcttctgcgtgctgagcggcccgggagcctcctgcgaggcgttcagcgagggcgggatcttcaacatcaccagccccatgtgcctggtgtccaagcagaacaggttccggctcaccgagcagcaggtcaacttcgtgtgccagcgcgtggacatggacatcatcgtctactgcaacggccagcggaaggtgatcctgaccaagacgctggtgatcggccagtgcatctataccatcaccagcctcttctccctgctgcccggggtcgcccacagcatcgccgtggagctctgcgtgcccggcttccacgggtgggccaccgccgcgctgctggtcacgttctgcttcggatgggtgctcatcccggccctgaccctgatcatcctcaccatcctgaagttcatcgccaacatattccacaccagtaaccaggagaaccggctcaagagcgtgctccggaagatcaaggaggagttcgagaagacgaaggggtccatggtctgcgacgtgtgcaagtacgagtgcgagacctacaaggagttgaaggcccacggcgtgagctgcccccagtcccagtgcccctactgcttcacccactgcgagcccaccgaggcggccttccaggcccactaccgcgtctgccaggtgacgcaccggttccgcgacgacctgaagaagaccgtgaccccgcaaaacttcacccctggctgctacaggaccctcaacttgttccgctacaagagccggtgctacatcttcacgatgtgggtctgcctgctcgtgttcgagtccatcctgtgggccgccagcgcgtccgaggtgcctctgaacccggtctggaacgacaacgcccacggggtgggcagcgtgcccatgcacaccgacttggagctggacttctccctgaccagctccagcaagtacacctaccgccggcgcctgacgaaccccctcgaggagacccagagcatcaacctgcacatcgagatcgaggaacagaccatcggggtagacgtgcacgccctgggccactggttcgacgggcgcctcaacctgaagacctccttccactgctacggcgcctgcacgaagtacgagtacccctggcacaccgccaagtgccactacgagcgggactaccagtacgagacctcgtggggctgcaacccggcggactgccccggggtgggcaccggatgcacggcctgcggcctgtacctcgaccagctgaagcccgtcggctccgcctacaagatcatcaccatccgctacagccggaaggtgtgcgtgcagttcggggaggagaacctgtgcaaggtcatcgacatgaatgactgcttcgtgacccgccacgtgaaggtctgcatcatcggcaccgtgtccaaatttagccagggggacacgctcctgttcttcggccccctggagggcggaggcctcatcttcaagcactggtgcacctccacgtgccaattcggggacccgggcgacatcatgagcccccgggacaaggggttcctgtgccccgagttccccggctccttccgcaagaagtgcaacttcgccaccaccccgctgtgcgagtacgacgggaacatggtgagcggctacaaaaaggtcatggccaccatcgactccttccagagcttcaacacctccaccatgcacttcacggacgagcggatcgagtggaaggaccccgacggcatgctacgcgaccacatcaacatcctggtgaccaaggacatagactttgacaacctgggggagaacccctgcaagatcggcctccagactagctccatcgagggggcgtggggcagcggggtcggcttcaccctgacgtgcctgatctccctcaccgagtgccccaccttcctgaccagcatcaaggcctgcgacaaggccatctgctacggcgccgagtccgtcacgctgacccgtgggcagaacaccgtgaaggtgagcggcaagggcgggcacagcggatccaccttcaagtgctgccatggcgaggagtgcagccagatcggcctccacgcggccgcaccgcacctggataaggtcaacgggatctccgagattgagaacaacaaggtatacgacgacggcgcgccccagtgcggggtgaagtgctggttcgtcaagagcggcgagtggatctccggcatcttcagcgtgaactggatcgtcctgatcgtgctctgcgtgtttctgctgttctcgctcgtcctgctgagcgttctctgccccgtgcgcaagcacaagaagtcatga

SEQ ID NO: 14989 - RNA, 3408 nt, synthetic construct; identical to SEQ ID NO: 11703
  misc_feature 1..3408: note = derived and/or modified CDS sequence (opt11) from HTNV(LongquanAa-09-171)__JQ912824.1__GP
  source 1..3408: mol_type = other RNA

SEQ ID NO: 14990 - RNA, 3408 nt, synthetic construct
  misc_feature 1..3408: note = derived and/or modified CDS sequence (opt11) from HTNV(LongquanAa-09-191)__JQ912825.1__GP
  source 1..3408: mol_type = other RNA
atggagatctggaagtggctggtgatggccagcctcgtctggcccgccttcaccctgcgcaacgtgtacgacatgaagattgagtgcccgcacaccgtgtccttcggcgagaacagcgtcatcgggtacgtggagctcccccggatgcccctagccgacaccgcccagatggtgccggagtccagctgcaacatggacaaccaccagtccatgaacacgatcactaagtacactcaagtttcatggcgcggcaaggccgaccaggcccaggcctcccagaacagcttcgaggcggttagtgccgaggtggacctgaagggtacgtgcgtccttaaacacaagatgctcgaggagagctacaggtcccgcaagagcattacctgctacgacctgtcctgcaacagcacctactgcaagccgacactgtacatgatcgtccccatccatgcgtgcaacatgatgaagtcctgtctaattgccctgggcccctaccgggtgcaggtcgtgtacgagcgcacgtactgcatgaccggggtgctgatcgagggcaagtgcttcgttcccgatcagagcgtggtgtccatcatcaagcacggcatcttcgatatcgcgagcgtccacatcgtgtgtttcttcgtggccgtcaaggggaacacctacaagctgttcgagcaggttaagaaatccttccagtctacatgcaatggcacggagaacaaggtgcaggggtactacatctgcatcgtcggtggtaacagcgcacctatatacgtgcccaccctggacgacttccggagcatggaggccttcagcggcatctttcgctcccctcacggcgaagaccacgacctggccggcgaggagatcgcgagctactccatcgttggccccgccaacgccaaggttccgcacagcgcctccagcgacaccctctcgctgatcgcctacagcgggatcccctcctacagctccctgagcatcctcgcgtccagcacagaggccaagcacgtgttctcccccggcttcttcccccaactaaaccacacaaagtgcgacaagaccgccattccgctgacctggaccggcatgatcgacctccctgggtattacgaagccatccacccctgcacggtcttctgtgtgttatcaggccccggcgcctcctgcgaggcgttcagcgagggcgggatcttcaacatcaccagcccgatgtgccttgtgtccaagcaaaaccggttccggctcaccgagcagcaggtcaactttgtgtgccagcgagtggacatggacatcatcgtctactgcaacgggcagcgcaaggtgatcctcaccaagacgttagtgatcggccagtgcatctacaccatcaccagcctcttctccctgctgcccggggtagcccacagcatcgccgtggagctctgcgtgcccggctttcatgggtgggccaccgccgccctgctggtcacgttctgcttcggctgggttcttataccagcccttaccctgattatcctcacaatcctgaagtttatagcgaacatcttccacacctccaaccaggaaaaccgtctcaagagcgtgctcaggaagattaaggaggagttcgagaagacgaaggggtcgatggtctgcgacgtgtgcaagtatgagtgcgagacctacaaggagctgaaggcacacggcgtttcctgtccgcaatcccagtgtccctattgcttcacgcactgcgaaccaaccgaagcggcctttcaagcccactaccgggtctgtcaggtgacacaccgcttccgggacgaccttaagaagactgtgacgccccagaacttcaccccgggctgctaccgcaccctcaacctgttccggtacaagagccgctgctacatcttcaccatgtgggtttgcctgttggtccttgagtctatactgtgggccgctagcgcgtccgaggtgcccctcaaccccgtctggaacgacaacgcccacggggtgggcagcgtgccgatgcacaccgacctggagttagatttctccttgaccagctccagcaagtacacctaccggcgccgcctcacgaaccccctggaggagacccagagcatcaacttacacatcgagatcgaggagcaaacaatcggggtcgacgtgcacgccctcggccactggttcgacgggcggctgaatttgaagacctcgttccactgttacggcgcctgcactaaatacgagtacccatggcacaccgccaagtgtcactacgagagggactaccagtacgaaaccagctggggctgtaaccccgcggactgcccgggggtgggtaccgggtgcacggcctgcggcctctacctggaccaactgaagcccgtcggctccgcctacaagatcatcaccatccggtacagccgcaaagtatgcgtgcagttcggggaggagaacctctgtaaggtcatagacatgaatgactgctttgtgacccggcacgtgaaggtctgcattatcggaaccgtgtccaagttcagccaaggtgacacgctgctgtttttcggccccctcgagggcggcgggctgatcttcaagcactggtgcaccagtacctgccagttcggggaccccggagacatcatgtccccgcgcgacaaggggttcttatgccccgagttccccggcagctttcggaaaaagtgcaatttcgccacgacacccctctgtgaatacgacgggaacatggtgtcaggctacaagaaggtgatggccaccatcgactccttccagagttttaacacctccaccatgcacttcacggacgagcgcatcgaatggaaagacccggacggcatgctgcgggaccacatcaacatcctggtgaccaaggacatcgacttcgacaacctcggggagaatccttgcaagatcggcctgcagaccagctccatcgagggggcatggggtagcggggtgggcttcaccctgacgtgcctcatctccctgaccgagtgccccacattcctgaccagcatcaaggcctgcgacaaggccatctgctacggcgccgaatccgtcacgctcacgcgagggcagaacaccgtgaaggttagcggcaaagggggccacagcggatccaccttcaagtgttgccatggcgaggagtgcagccaaatcggcctgcacgcggccgcgccccatttagacaaggtcaatggcatttccgaaatcgagaacaacaaggtgtacgacgacggagccccgcagtgcggggtgaagtgctggttcgtaaagagcggcgagtggatttccggcatcttcagcgggaactggattgtgctcatcgtcctgtgtgtgttcctcctgttctccctggtgctgctcagcgtcctgtgccccgtgcggaagcacaagaagtcctga

SEQ ID NO: 14991 - RNA, 3408 nt, synthetic construct
  misc_feature 1..3408: note = derived and/or modified CDS sequence (opt11) from HTNV(LongquanAa-09-350)__JQ912835.1__GP
  source 1..3408: mol_type = other RNA
atggagatctggaagtggctggtgatggcctcactcgtctggcccgcctttactcgccggaacgtatacgatatgaagatcgagtgcccgcacacggtgtccttcggcgagaacagcgtcatcgggtacgtggagctgccgcccatgcccctggctgacacggcccaaatggtgcccgagtccagctgcaacatggacaaccaccagtccatgaacaccatcaccaagtacacccaagtaagctggcgcggcaaggccgaccaggcacaggcgtcccagaacagcttcgaagcggtgtccgccgaggtggatctcaagggaacgtgcgtcctgaagcacaagatgctggaggagagctaccggagtcgcaagtctatcacgtgctatgacctctcctgcaacagcacttactgcaagcccaccctgtacatgatcgtgcccatacacgcctgtaacatgatgaagtcctgcctgatcgccctcggcccataccgggtgcaggtcgtttatgagcgcacgtactgcatgacgggggtgctgatcgagggtaagtgcttcgtgccggaccagagcgtggtgtccatcatcaagcacggcattttcgacatcgcgagcgttcacatagtatgcttcttcgtggccgtcaaggggaatacctacaagctgttcgagcaggtcaagaagtccttccagagcacgtgcaacggcaccgagaataaggtgcaggggtactacatctgcatcgtgggcgggaacagcgccccgatctacgtgcccaccctcgacgatttccggtccatggaggccttcagcggcatcttccgcagcccccacggcgaggaccacgacctggccggggaggagatcgcgagctactccatcgtcggcccggccaacgctaaggtgccccactcagcctccagcgacaccctttccctcatagcctactcagggatcccctcatacagctccctgagcatcctggcatccagcaccgaggccaaacacgtgttctcccccggcttctttccgcagctcaaccacacgaagtgcgacaagaccgccatccccctgacttggaccggcatgatcgatctgcccgggtactacgaggccatccacccctgcacggtcttctgcgtgctcagcggccctggggcctcctgcgaggcgttcagcgagggcgggatcttcaacatcaccagcccgatgtgcctggtgtccaagcagaaccggttcaggctgaccgagcaacaggtcaacttcgtgtgccagcgggtggacatggacatcatagtctactgcaacggccagcgcaaggttatcctcaccaagacgctggtgatcggccagtgcatctacaccatcaccagcctgttttccctcctgcccggggtcgcccacagcattgccgtggagctgtgcgtgcccggcttccacggctgggccaccgctgcgctgctggtcacattctgcttcggctgggtgttgatcccggccctcaccctgatcatcctgaccatcctcaagttcatcgccaacatattccacacctccaaccaggagaaccggttaaagtccgtgctgcgcaagatcaaagaggagttcgagaagacgaaggggtccatggtctgcgacgtgtgcaagtacgagtgcgagacctacaaagagctcaaggcccacggcgtgagctgcccccaatcccagtgcccctactgcttcacccactgcgagcccaccgaggcggccttccaggcccactaccgggtctgccaagtgacgcaccgctttcgggacgacctgaagaagacggtgaccccgcagaacttcacccccggctgctaccgaaccctgaacctctttcggtacaagagccgatgctacatcttcacgatgtgggtatgcctgctggttctcgagtcgatcctgtgggccgccagcgcgtccgaggttcccctgaacccggtctggaacgacaacgcacacggggtgggcagcgttcccatgcacaccgacctcgaactggacttctccctgaccagctccagcaagtacacctaccggcgccgcctgacgaaccccctcgaggagacccagagcatcaacctgcacatcgagatcgaggagcagaccatcggtgtcgacgtgcacgccctgggccactggtttgacgggcggctcaacttgaagacctccttccactgctacggcgcctgcacgaagtacgagtacccctggcacaccgccaagtgccattacgaacgcgactaccagtacgaaaccagctggggctgcaacccggcagactgccccggggtgggcaccgggtgcacggcctgcggcctgtacctcgaccaactgaagcccgtcggctccgcctacaagatcatcacaatccggtacagccgtaaggtgtgcgtgcagttcggggaggagaacctgtgcaaggtcattgacatgaacgattgcttcgtcacccggcacgttaaagtctgcataatcggcaccgtgtccaagttcagccagggggacacgctcctgttcttcggccccctggagggagggggcctcatcttcaagcactggtgcacctcgacgtgccaatttggggacccgggagatatcatgagcccccgcgacaaggggttcctgtgcccggagttccccggctccttccggaagaagtgcaacttcgccaccaccccgctgtgcgagtacgacgggaacatggtaagcggttacaagaaggtcatggccaccatcgattccttccagagcttcaacacctccaccatgcacttcacggacgagcgcatagagtggaaggaccccgacggcatgctccgggaccacatcaacatcctggtgaccaaggacatcgatttcgacaacctgggggagaacccctgcaagatcggcctccagactagctccatcgagggagcgtggggcagcggggtgggcttcaccctgacgtgcctgatcagcctcaccgagtgccccaccttcctgaccagcatcaaggcctgcgataaggccatctgttacggcgccgagtccgtcacgctgacccgcggccagaacacggtgaaggtgagtggcaagggcgggcacagcgggtccaccttcaagtgctgccatggcgagaagtgcagccagatcggcctccacgcggccgccccgcacctggacaaggtcaacgggatttccgagatcgagaacaacaaagtgtacgacgacggggcgccccagtgcggggtaaagtgctggttcgtcaagagtggcgagtggatctccggcatcttcagcgggaactggatcgtgctgatcgtcctctgcgtgttcctgctgttcagtctcgtcctgctgagcgtactctgccccgtgcgaaagcataagaagtcctga

SEQ ID NO: 14992 - RNA, 3408 nt, synthetic construct
  misc_feature 1..3408: note = derived and/or modified CDS sequence (opt11) from HTNV(LongquanAa-09-489)__JQ912844.1__GP
  source 1..3408: mol_type = other RNA
atggagatctggaagtggctggtgatggctagcctcgtctggcccgccttcaccctgcgcaacgtgtacgacatgaagatcgagtgcccgcacaccgtgtcctttggcgagaacagcgtcatcgggtacgtggagctgccccggatgcccctcgcggacacggcccagatggtgcccgagtccagctgcaacatggacaaccaccagtccatgaacaccatcaccaagtacacccaggtcagctggcgcggcaaggccgaccaggcccaggcctcacagaacagcttcgaggcggtgtccgccgaggtggatctgaaggggacctgcgtcctgaagcacaagatgctcgaggaatcctaccgaagccgcaagagcattacctgctacgacctgtcctgcaacagcacctactgcaagccgaccctgtacatgatcgtgcccatccacgcctgcaacatgatgaagtcctgcctcatcgccctgggcccctaccgggtgcaggtcgtgtacgagcgcacgtactgcatgaccggggtgctgatcgagggcaagtgcttcgtccccgaccagtcggtggtgtccatcatcaagcacggcatcttcgacatcgcgagcgtccacatcgtgtgcttcttcgtggccgtcaaggggaacacctacaagctgttcgaacaggtgaagaagtccttccagagcacgtgcaacggtaccgagaacaaggtgcaggggtactacatctgcatcgtcggcgggaacagcgccccgatatacgtgcccaccctggacgacttccggtccatggaggccttcagcggcattttccgcagcccccacggcgaggaccacgacctggccggggaggagatcgcgtcctactccatcgtcggccccgccaacgccaaggtgccgcacagcgcctccagcgacaccctctccctgatcgcctacagtgggatcccctcctactcgtccctgagcatcctcgcgtccagcaccgaggccaagcacgtgttctcccctggcttcttcccccagctgaaccacacgaagtgcgataagactgccatcccgctgacctggaccggcatgatcgacctccccggttactacgaggccatccacccctgcacggtgttctgcgtgctgagcggccccggggcctcctgcgaggcgtttagcgagggcgggatcttcaacatcaccagcccgatgtgcctggtgtccaagcagaaccggttccgcctcaccgagcaacaggtcaacttcgtgtgccagcgggtcgacatggacatcatcgtctactgtaacggccagcgcaaggtgatcctgaccaagacgctggtgatcggccagtgcatctacaccataaccagcctcttctccctgctgcccggggtcgcccacagcatcgcggtggagttatgcgtgcccggtttccacgggtgggccaccgccgccctgctggtcacgttctgcttcggctgggtgctcatccccgccctgaccctgatcatcctcaccatcctgaagttcatcgccaacatcttccacacctctaaccaggagaaccggctcaagagcgtgctccgcaagatcaaggaggagttcgagaagactaaggggtccatggtctgcgacgtgtgcaagtacgagtgcgagacctataaggagctgaaggcccacggcgtgagctgcccccagtcccagtgcccctactgcttcacccactgcgagcccaccgaggcggccttccaggcccactaccgggtctgccaggtgacgcaccgcttccgggacgacctgaagaagaccgtaacgccccagaacttcaccccgggctgctaccgcaccctcaacctgttccggtacaagagccgctgctacatcttcaccatgtgggtctgcctgctcgtgctggagtccattctgtgggccgccagcgcgtccgaggtgcccctcaaccccgtctggaacgacaacgcccacggggtgggcagcgtgccgatgcacaccgacctgcagctggacttctccctgaccagctccagcaagtacacctaccggcgccgcctcacaaaccccctggaggagactcagtctatcaacctgcacatcgagatcgaggagcagaccatcggggtcgacgtgcacgccctcggccactggttcgacgggaggctgaacctgaagacctccttccactgctacggcgcctgcacgaagtacgagtacccctggcacaccgccaagtgccactacgagcgcgactaccagtacgagaccagctggggctgcaaccccgcggactgccctggggtaggcaccgggtgcacggcctgcggcctctacctggaccagctgaagcccgtcggctccgcctacaagatcatcaccatccggtacagccgcaaggtgtgcgtgcagttcggggaggagaacctctgcaaggtcatcgacatgaacgactgcttcgtgacccggcacgtgaaggtctgcatcatcggcaccgtgtccaagttcagccagggggacacgctgctgttcttcggccccctcgaagggggcggcctgatcttcaagcactggtgcacctccacctgtcagttcggggaccccggcgacatcatgagcccgagggacaaggggttcctgtgcccagagttccccggctccttccggaagaagtgcaacttcgccaccacgcccctctgcgagtatgacgggaacatggtgagcggctacaagaaggtcatggccaccatcgactccttccagagcttcaacaccagtaccatgcacttcacggacgagcgcatcgagtggaaggacccggacggcatgctgcgggaccacatcaacatcttagtgacgaaggacatcgacttcgacaacttaggggagaacccctgcaagatcgggctgcagaccagctccatcgagggggcttggggcagcggggtgggcttcaccctgacgtgcctcatctccctgaccgagtgccctaccttcctgaccagcatcaaggcctgcgacaaggcgatctgctacggcgccgagtccgtcactctcacccgcgggcaaaacaccgtgaaggtgagcggaaaagggggccatagcgggtccaccttcaagtgctgccacggagaggagtgcagccagatcggcctgcacgcggccgctccccacctggacaaggtcaacgggatatccgagatcgagaacaacaaggtgtacgacgacggcgccccgcagtgcggagtgaagtgctggttcgtcaagagcggcgagtggatctccggcatcttcagcgggaactggatcgtgctcatcgtcctgtgcgtgttcctcctgttctccctggtgctgctgagcgtcctgtgccccgtgagaaagcacaagaagtcctga

SEQ ID NO: 14993 - RNA, 3408 nt, synthetic construct
  misc_feature 1..3408: note = derived and/or modified CDS sequence (opt11) from HTNV(LongquanAa-09-541)__JQ912850.1__GP
  source 1..3408: mol_type = other RNA
atgggcatctggaagtggctggtgatggccagcctcgtctggcccgccttcaccctgcgcaacgtgtacgacatgaagatcgagtgtccgcacaccgtgtccttcggcgagaacagcgtaatcggctacgtggagctgccgcccatgcccctcgccgacaccgcccaaatggtgcccgagtccagctgcaacatggacaaccaccagtccatgaacacgatcaccaagtacacccaggtcagctggcgggggaaggccgaccaagcccaggcctcccagaacagcttcgaggcggtgtccgccgaggtggacctgaagggcatctgcgtcctgaagcacaagatgctcgaggagagctaccgctcccgcaagagcatcacgtgctacgacctgtcctgcaacagcacctactgcaagcccaccctgtacatgatcgtgcccatccacgcctgcaacatgatgaagtcctgcctcatcgcccttgggccctaccgggtgcaggtcgtgtacgagcggacctactgtatgacgggcgtgctgctcgagggcaagtgcttcgtcccggaccagagcgtggtgtccattatcaaacacggcatcttcgacatcgcgagcgtccacatcgtctgcttcttcgtagccgtcaagggcaacacctacaagctgttcgagcaggtcaagaagtcattccagagcacatgcaacgggaccgagaacaaggtccagggctactacatctgcatcgtcgggggcaacagcgcccccatctacgtgcccaccctggacgacttccggtccatggaggccttcagcggcatcttccggagcccccacggggaggaccacgacctcgccggcgaggagatcgcgtcctactccatcgtggggccggccaacgccaaggtgccccactccgcctccagcgacaccctgtccctgatcgcctacagcgggatcccctcctacagctccctctcgatcctggcgtccagcaccgaggccaagcatgtgttctcccccggcttcttcccgcagctgaaccacaccaagtgcgacaagacggccatccccctcacctggaccgggatgatcgacctgcccggctactacgaggccatccacccctgcaccgtcttctgcgtgctgagcgggccgggcgcctcctgcgaggcgttcagcgagggcgggatcttcaacatcacgagccccatgtgcctcgtgtccaagcagaaccgcttccggctgaccgaacaacaggtcaacttcgtgtgccagcgcgtggacatggacatcatcgtctactgcaacggccagcgtaaggtgatcctaaccaagaccctcgtgatcgggcagtgtatctacacgatcacaagcctgttctccctgctccccggcgtcgcccacagcatcgcggtggagctgtgtgtgcccgggttccacggctgggccaccgccgcgctgttagtcaccttctgcttcgggtgggtgctgatcccggccctgacgctcatcatcctgaccatcctgaagttcatcgccaacatcttccacacctccaatcaggagaaccgcctcaagagcgtgctgcggaagatcaaggaggagttcgaaaagaccaagggctccatggtctgcgacgtgtgtaagtacgagtgcgagacgtacaaggagctgaaggcccacggcgtgagctgcccccagtcccagtgcccctactgcttcacccactgcgagcccacagaggcggccttccaggcccactaccgcgtctgtcaggtgacccaccggttccgcgacgacctcaagaagacggtgacgccccagaacttcacccccgggtgttaccggaccttaaacctgttccgctacaagagccggtgctatatcttcaccatgtgggtctgcctcctggtgctggagtccatcctctgggccgccagcgcgtccgaggtgcccctgaacccggtctggaacgacaacgcgcacggcgtggggagcgtgcccatgcataccgacctggagctggacttctccctcaccagctccagcaagtacacctaccgccggcgcctgaccaaccccctggaggagacgcagagcatcaacctccacatcgagatcgaggagcagaccatcggcgtcgacgtgcacgccctggggcactggttcgacggccgcctgaacctcaagacctccttccactgctacggcgcttgcaccaagtatgagtacccctggcacacggccaagtgccactacgaacgggactaccagtacgagaccagctgggggtgcaacccggcggactgccccggcgtggggaccggctgcaccgcctgcggcctgtacctcgaccagttgaagcccgtcgggtccgcctataagatcatcacgatccgctacagccggaaggtgtgcgtgcagttcggcgaggagaacctgtgcaaggtcatcgacatgaacgactgcttcgtgacccgccacgtgaaggtctgcatcatcgggaccgtgtccaagttcagccagggcgacaccctcctcttcttcgggcccctggagggtggcgggctgatcttcaagcactggtgcacgtccacgtgccagttcggcgacccgggggacatcatgagcccccgggacaagggcttcctctgccccgagttccctgggtccttccgcaagaagtgcaacttcgccaccaccccgctgtgcgagtacgacggcaacatggtgagcggctacaagaaggtcatggccaccatagactccttccagagcttcaacacatccaccatgcacttcaccgacgagcggattgagtggaaggaccccgacgggatgctgcgcgaccacatcaacatcctcgtgacgaaggacatcgacttcgacaacctgggcgagaacccctgtaagatcgggctgcagaccagctccatcgagggcgcgtgggggagcggcgtgggctttaccctgacctgcctgatctccctgacggagtgccccaccttcctcaccagcatcaaggcctgcgacaaggccatctgctacggggccgagagtgtcaccctgactcggggccagaacaccgtgaaggtgagcgggaagggcgggcacagcggctccaccttcaagtgctgccacggcgaggaatgcagccagatcgggctgcatgctgccgccccgcacctcgacaaggtcaacggcatctccgagatcgagaacaacaaggtgtacgacgacggtgcgccccagtgcggcgtgaagtgctggttcgtcaagagcggcgagtggatctccgggatcttcagcggcaactggatcgtgctgatcgtcctgtgtgttttcctcctgttctccctggtgctcctgagcgtcctctgccccgtgcgcaagcacaagaagtcctag

SEQ ID NO: 14994 - RNA, 3408 nt, synthetic construct; identical to SEQ ID NO: 11708
  misc_feature 1..3408: note = derived and/or modified CDS sequence (opt11) from HTNV(LongquanAa-09-698)__JQ912854.1__GP
  source 1..3408: mol_type = other RNA

SEQ ID NO: 14995 - RNA, 3408 nt, synthetic construct
  misc_feature 1..3408: note = derived and/or modified CDS sequence (opt11) from HTNV(LongquanAa-10-393)__JQ912859.1__GP
  source 1..3408: mol_type = other RNA
atggagatctggaagtggctggtgatggcttcccttgtctggccagcctttaccctgcgcaacgtgtacgacatgaaaatcgagtgcccccacaccgtgtctttcggcgaaaacagcgtcatcggatacgtagaactgccgcccatgcccctcgccgacacggcccagatggtgcccgagtccagctgtaacatggacaaccaccagtccatgaacaccatcaccaagtacacccaggtgagctggcggggcaaggccgaccaagctcaggcctcccagaacagcttcgaggcagtgtccgccgaggtggatctgaaggggacgtgcgtcctgaagcacaagatgctcgaggagtcttaccgctcccggaagtccatcacgtgctacgatctgtcctgcaacagtacctactgcaagccgacgctgtacatgatcgtgcccatccacgcttgcaatatgatgaagtcctgcctcattgctctgggcccctaccgcgtgcaggtcgtgtatgagaggacctactgcatgaccggggtgctgatcgagggcaaatgtttcgtccctgaccagagcgtggtgtccatcatcaagcatggaatctttgacatcgcctcagtacatatcgtgtgcttcttcgtcgccgtcaaggggaatacctacaagctgttcgagcaggtcaagaaaagtttccagagcacttgcaacgggaccgagaacaaggtgcaggggtactacatctgcatcgtaggcgggaactcggcccccatttacgtccccaccctggacgacttccgctccatggaggccttctcaggcatcttccgtagcccccacggcgaagatcacgacctggcaggcgaggagatcgccagttactccatagtcggcccggcaaacgccaaggtaccccacagcgcctcctcagacactctctccctgatagcctactccgggatcccctcctactcttccctgagcatcctcgcgtccagcaccgaggccaagcacgtgttcagccccggcttcttcccgcaactcaatcacacgaagtgcgacaagaccgctatccccctgacctggaccggcatgatcgacctcccaggatactacgaggccatccacccctgcacggtcttctgcgtcctcagcggcccgggggcctcctgcgaggcgttcagcgagggcggaatcttcaacatcacctcacccatgtgcctggtttccaagcagaacaggtttcggctaaccgagcagcaggtaaacttcgtgtgccagcgagtggacatggacatcatcgtttattgcaacggccagagaaaggtgatcctgaccaagacactggtaatcggccagtgcatctacacaatcaccagtctcttctccctgctgcccggggtcgctcacagcatcgcggtggagttgtgcgtacccggcttccacgggtgggctaccgccgcgctgctggtaacgttctgcttcggccgcgtgctcatcccggccctgacgctgatcatcctcaccatcctgaagttcatcgccaacatcttccacacatctaaccaagagaaccggcttaaatccgtactacgcaagatcaaagaggagttcgagaagacgaaggggtctatggtctgcgacgtgtgcaaatacgagtgcgagacctacaaggagctgaaggcccacggcgtcagctgcccccagtcccagtgtccctactgcttcacccactgcgagcccaccgaggcggcattccaggctcactacagggtgtgtcaagttacgcaccgcttccgggatgacttaaagaagaccgtgacgccgcagaacttcacccccggctgttaccgcaccctcaacctgttccggtacaagagccgctgctacatcttcacgatgtgggtctgtctactcgtgctggaatccatcctgtgggccgccagcgcgtccgaggtgcccctcaatccggtctggaatgacaacgcccacggggtaggcagcgtgcccatgcacaccgacctggagctggacttctccctgaccagctccagcaagtacacctaccgacggcggctcacgaatcccctggaggagacccagagcatcaacctgcacatcgagatcgaggaacagaccatcggggtcgacgtgcacgcactcggccactggttcgacgggcggctgaacctgaagacgtccttccactgttacggcgcatgcacgaaatacgagtacccttggcacaccgccaaatgccactacgagcgagactaccagtacgaaaccagttggggctgcaaccctgccgactgtcccggggtgggcaccgggtgcacggcctgcggcctatacctggatcagctgaagcccgtcggctccgcctacaagatcatcaccatccggtatagccgcaaggtgtgcgtgcagttcggggaggagaacctatgcaaggtcatcgacatgaacgactgcttcgtgacccggcacgtgaaggtctgcatcatcggcaccgtgtccaagtttagccagggtgacacgctgctgttcttcggccccctcgaaggcggaggcttaatcttcaagcactggtgcacgtccacgtgtcagttcggggacccgggagacatcatgtcgcccagagacaaggggtttctgtgccccgagttccccggctccttccggaagaaatgcaacttcgccaccaccccgctttgcgagtacgacgggaacatggtgagcggctacaagaaggtcatggcgacaatcgactccttccagagtttcaatacctccactatgcatttcacggacgagcgaatcgagtggaaggaccccgacggcatgctgcgagaccacatcaacatcctggtgacgaaggacatcgacttcgacaacctcggggagaacccctgcaagatcggcctccagacctcgtccatcgagggggcgtggggctccggggtcggcttcacactgacgtgcctcatatccctgaccgagtgccccaccttcctgacctccatcaaagcatgtgacaaggccatctgctacggcgcagagtccgtcacgctcacacgaggacaaaacaccgtgaaggtgagtggcaagggcgggcacagcgggtccaccttcaaatgctgtcacggcgaggagtgcagccaaataggcttacacgcggcggcgccgcacttagacaaggtcaacggcattagcgagatcgagaacaacaaggtctacgacgacggtgcgccccagtgcggggtgaagtgctggtttgtcaagagcggcgagtggatttccggcatcttcagcggcaactggatcgtgctcatcgtcctgtgcgtgttcctcctgttctctcttgtgctgctcagcgtattgtgcccggtgcggaagcataagaagtcctaa

SEQ ID NO: 14996 - RNA, 3408 nt, synthetic construct
  misc_feature 1..3408: note = derived and/or modified CDS sequence (opt11) from HTNV(LongquanAa-10-58)__JQ912861.1__GP
  source 1..3408: mol_type = other RNA
atggagatctggaagtggctggtcatggccagcctcgtctggccagccttcaccctgcgcaacgtgtacgacatgaagatcgagtgcccgcacaccgtgtccttcggcgaaaacagcgtcatcgggtacgtggagttgccgcccatgcccctcgccgacacggcccaaatggtgcccgagtccagctgcaacatggacaaccaccagtccatgaacaccatcacgaagtacactcaggtcagctggcggggcaaagccgaccaggcccaggcatcccagaacagcttcgaggcggtgtccgccgaggtggacctgaaggggacgtgcgttctgaagcacaagatgctcgaggagagctaccgctcccggaagtctatcacgtgctacgacctgtcctgtaacagcacctactgcaagcccaccctgtatatgatcgtgcccatccacgcctgcaacatgatgaagagttgcctcatcgccctgggcccctaccgcgtgcaggtcgtgtacgagcggacctactgcatgaccggggtgctgatagagggcaagtgcttcgtcccggaccagagcgtggtgtccatcatcaagcacggcatcttcgacatcgcaagcgtccacatcgtgtgcttcttcgtggccgtcaaggggaacacctacaagttgttcgagcaggttaagaagtccttccagagcacgtgcaacggcaccgagaacaaggtgcaggggtactacatctgcatcgtgggcgggaacagcgcccccatctacgtgcccaccctggacgacttccgctccatggaggccttcagcggcatcttccggagcccccacggcgaggaccacgacctggcaggggaggagatcgcgagctactccatcgtcggcccggctaacgcaaaggtgccccacagcgcctccagcgacaccctctccctgatcgcctacagcgggatcccctcctactcatccctgagcatcctcgcgtccagcacagaggccaagcacgtcttctcccccggcttcttcccgcagctgaaccacacaaaatgcgacaagaccgccatccccctgacctggaccggcatgatcgacctccccgggtactacgaggccatccacccctgcacggtcttctgcgtgctgagcggcccgggggcctcctgcgaggcgttcagcgagggcgggatcttcaacatcaccagccccatgtgcctggtgtccaagcagaaccgcttccggctcaccgagcaacaggtcaacttcgtgtgccagcgcgtggacatggacatcatagtctactgcaacggccagcggaaggtgatcctgaccaagacgcttgtgatcggccagtgtatctacaccatcactagcctcttctccctgctgcccggggtcgcccacagcatcgccgtggagctctgcgtgcccggcttccacgggtgggccaccgccgcgctgctggtcacgttctgctttggctgggtcctcatcccggccctgacccttatcatcctaaccatcctgaagttcatcgccaacatcttccacacctccaaccaggagaatcgcctaaagagcgtgctccggaagatcaaggaggagttcgagaagacgaaggggtccatggtctgcgacgtgtgcaagtacgagtgcgagacctacaaggagctgaaggcccacggcgtgagctgcccccagtcccagtgcccctactgcttcacccactgcgagcccaccgaggcagccttccaggcccactaccgcgtctgccaggtgacgcaccggttccgcgacgacctgaagaagaccgtgacgccccagaacttcacccccggctgctaccggaccctcaacctgttccgctacaagagccggtgctatatcttcaccatgtgggtctgcctgctcgtgctggagtccatcctgtgggccgccagcgcgtccgaggtgcccctcaacccggtctggaacgacaacgcccacggggtgggcagcgtgcccatgcacaccgacttagagctggacttctccctgaccagcagtagcaagtacacctaccgccggcgcctcacgaaccccctggaggagacccagagcatcaacctgcacatcgagatcgaggagcagaccatcggggtcgacgtgcacgccctcggccactggttcgacggccgcctgaacctgaagacctccttccactgctacggcgcctgcacgaagtacgagtacccatggcacaccgccaagtgccactacgagcgggactaccagtacgagaccagctggggctgcaacccggcggactgccccggggtgggcaccgggtgcacggcctgcggcctctacctggaccagctgaaacccgtcggctccgcctacaagatcatcaccatccgctacagccggaaggtgtgcgtgcagttcggggaggagaacctctgcaaggtcatcgacatgaacgactgcttcgtgacccgccacgtgaaggtctgcatcatcggcaccgtgtccaagttcagccagggggacacgctgctgttcttcggccccctcgagggcgggggcctgatcttcaagcactggtgcacctccacgtgtcagttcggggacccgggcgacatcatgagcccccgggacaaggggttcctgtgccccgagttccccggctccttccgcaagaagtgcaactttgccaccaccccgctctgcgagtacgacgggaacatggtgagcggctacaagaaggtcatggctaccatcgactccttccagagcttcaacacctccaccatgcacttcacggacgagcggatcgagtggaaggaccccgatggaatgctgcgcgaccacatcaacatcctggtgactaaggacattgacttcgacaacctcggggagaacccctgcaagatcggccttcagaccagctccatcgagggggcctggggcagcggggtgggctttaccctgacgtgcttaatcagtctgaccgagtgccccaccttcctgaccagcatcaaggcctgcgacaaggccatctgctacggcgccgagtccgtcacgctcacccgggggcagaacaccgtgaaggtgtcaggcaagggcgggcacagcgggagcaccttcaagtgctgccacggagaggagtgcagccagatcggcctgcacgcggcggccccgcacctggacaaggtcaacggcatctccgagatcgagaacaacaaggtgtacgacgacggcgcgccccagtgcggggttaagtgctggtttgtcaagagcggcgagtggatctccggcatcttcagcgggaactggattgtgctcatcgtcctgtgcctgttcctcttattctccctggtgctcctgagtgtgctgtgccccgtccgcaaacacaagaaatcctga

SEQ ID NO: 14997 - RNA, 3408 nt, synthetic construct; identical to SEQ ID NO: 11711
  misc_feature 1..3408: note = derived and/or modified CDS sequence (opt11) from HTNV(LongquanAa-10-74)__JQ912864.1__GP
  source 1..3408: mol_type = other RNA

SEQ ID NO: 14998 - RNA, 3408 nt, synthetic construct
  misc_feature 1..3408: note = derived and/or modified CDS sequence (opt11) from HTNV(LongquanAa-10-98)__JQ912866.1__GP
  source 1..3408: mol_type = other RNA
atggaaatctggaagtggctggttatggccagcctcgtctggcccgcctttaccctgcgcaacgtgtatgacatgaagatcgagtgtccgcacaccgtgtccttcggggagaacagcgtaatagggtacgtggaactacctcccatgcccctcgccgacacggcgcagatggtgccggagagcagctgtaacatggacaatcatcagagcatgaacaccattaccaaatacacccaggtcagctggcgaggcaaggccgaccaggcccaggcctcccagaacagcttcgaggcggtgtccgccgaggtggacttaaaggggacgtgcgtattaaagcataaaatgttagaggaaagctacagatcccgcaaaagcattacctgctatgacctgtcctgcaactcaacctattgcaaacccaccctgtacatgatcgtccccatacatgcctgcaacatgatgaagtcctgcctcattgccctgggcccctatcgggtgcaggtcgtgtacgagcggacctactgcatgaccggggtactgattgagggcaaatgcttcgtcccggaccagagcgttgtctccatcattaagcacggcatcttcgacatcgcgagcgtccatatagtgtgtttctttgtggccgtcaaggggaacacctacaagctcctggaacaggtcaagaaatccttccagtccacgtgcaacgataccgagaacaaggtacaaggctactacatctgcattgtcgggggcaacagcgcacccatatacgtgcccaccctggacgacttccgttccatggaggccttcagcgggatcttccggagcccccatggcgaggaccatgatctcgccggcgaggagatcgcgtcctattccatagtcggtcccgccaacgccaaagtgccgcacagcgcctccagcgataccctgtccctgatcgcctattctggaatcccctcctactcttccctcagcattctggcgtcctccacggaggccaaacacgtgttctctcccgggttcttcccgcagctgaaccatacgaagtgcgacaagaccgccatacccctcacgtggaccggtatgatagacctgcctgggtactacgaggccattcatccctgcactgtgttctgcgtgctgagcgggccaggcgcctcctgcgaggcgttcagcgagggcggaatattcaacatcacgagcccaatgtgtctcgtgtccaaacagaaccgctttcggctgaccgagcagcaagtaaacttcgtgtgccagcgcgtagacatggacataatcgtctactgcaacgggcagcggaaggtcatattgaccaaaacgctggtcatcggccagtgcatctacaccatcacatccctgttctcccttctaccaggagtcgcccacagcattgccgtagagctgtgcgtacccgggttccacggttgggccaccgccgcgctcctcgtcactttctgcttcgggtgggtcctgatcccggccctgaccctaatcatcctgaccatcctgaagttcatcgctaacattttccacacgtcgaaccaggagaaccgcttaaagagtgtgctgcggaagatcaaagaagagttcgagaaaacaaagggctccatggtctgcgacgtgtgcaagtacgagtgcgagacctacaaggagctcaaggcccacggggtgtcttgcccccaatcccagtgcccctactgctttacgcattgcgagcccaccgaagcggccttccaggcccactaccgcgtctgccaggtgacgcaccgcttccgcgacgatctcaagaagacagtgactccccagaacttcaccccgggctgttaccgtaccctgaacctgttccgctacaagtcgcggtgttacatattcacgatgtgggtttgcctcctggtgctggagtccatcctctgggccgcaagcgctagtgaggtgcccttaaacccggtctggaatgacaacgcccacggcgtggggtctgtacccatgcacaccgacctggagctggacttttccctcacgagctcctctaagtacacgtaccgccgccgactaacgaaccctctggaggagacccagagcattaacctccacatcgagatcgaggagcagaccatcggcgtcgacgtacacgcccttgggcactggttcgacggccgcctgaacctcaaaacctcctttcactgctacggggcctgcacgaagtacgagtacccctggcacacagccaagtgccactacgaacgtgactaccagtacgaaaccagctggggttgcaatccggcggactgccccggcgtcgggaccggatgcacggcctgcgggctgtacctggaccagttaaagcccgtcggctcagcctacaagatcatcaccattcgctacagccggaaggtgtgcgttcagttcggagaagaaaacttatgcaaagtcatcgacatgaacgattgcttcgtgactcggcacgtgaaggtctgcattatcgggaccgtgtccaagttcagccagggcgacacgctcctgttcttcgggcccctggagggcggtgggctgatcttcaagcactggtgcacaagcacgtgccagttcggggatccgggggacatcatgtcgccccgggacaaaggcttcctgtgcccggagttcccggggtccttccgcaaaaagtgcaacttcgccaccaccccgctgtgtgagtacgacggtaacatggtaagcggctacaagaaggtaatggccaccatcgactcattccagagcttcaacacctccaccatgcacttcacggacgagcggatcgagtggaaggaccccgatggcatgctgcgcgaccacatcaatatcctcgtgaccaaggacatcgactttgacaacttaggcgagaacccatgtaaaataggcctccagaccagctccatagagggcgcgtgggggagcggagtggggtttaccctcacatgtctgatctccctaaccgagtgccccactttcctcaccagtatcaaggcttgcgataaggccatttgctacggggccgagtccgtcaccctgacccgggggcagaacacggtgaaggtcagcgggaagggcgggcacagtgggtccaccttcaaatgctgtcacggggaggagtgcagccagatcggcctgcatgccgccgccccgcacctagataaagtcaacggtatttccgagatcgagaataacaaagtgtacgacgatggggcgccccagtgcggcgtcaagtgttggttcgtgaaaagcggagagtggatcagcggaattttcagcggaaactggatagtgctgattgtcctctgcgtgttcctcttgttctccctagtgctcttgagcgtcctgtgccccgtgcgaaagcacaagaagtcttaa

SEQ ID NO: 14999 - RNA, 3408 nt, synthetic construct
  misc_feature 1..3408: note = derived and/or modified CDS sequence (opt11) from HTNV(LongquanAa-11-452)__KC344264.1__GP
  source 1..3408: mol_type = other RNA
atggagatctggaagtggctggtgatggccagcctcgtctggcccgctttcacactgcgtaacgtgtacgacatgaagatcgagtgtccgcacaccgtgtccttcggcgagaacagcgtcatcgggtacgtggagctgccgcccatgcccctcgccgacacggcccagatggtacccgagtccagctgcaacatggacaatcatcaatccatcaacaccattaccaagtatacccaggtcagctggcggggcaaagccgaccaagcccaggcctcccagaacagcttcgaggcggtgtccgccgaggtggacctgaagggcacatgcgtcctgaagcataaaatgctcgaggagagctaccgctcccgcaagtcgatcacgtgctacgacctgtcctgcaactcgacctactgtaagcccaccctgtatatgatcgtgcccatccacgcctgcaacatgatgaagtcctgcctcattgccctgggcccttaccgggtgcaggtcgtgtacgagcggacctattgcatgaccggggttctgatcgaggggaaatgcttcgtcccggaccagagcgtggtgtccatcatcaagcacggcatcttcgacatcgcgagcgtccacatcgtgtgcttcttcgtagcggtgaaggggaacacctacaagctcctggagcaagtcaagaagtccttccagagcacgtgcaacgacacggaaaacaaggtgcaaggctactacatctgcatcgtcgggggcaactcggcgcccatatatgtgccaaccctggacgatttccgctctatggaggccttcagcgggatcttccggagcccccacggcgaggaccacgacctcgccggcgaggagatcgcttcctattccatcatcgggccagccaatgccaaggtgcctcactctgcctccagcgacaccttatccctgatagcatacagcggtatcccctcgtacagctccctaagcattctggcgtccagcaccgaggccaaacacgtcttctcccccgggttcttcccgcagctgaatcacacaaagtgcgacaagaccgctatacccctcacctggaccgggatgatagacctacccggctactacgaagcgatacatccttgcacggtgttctgcgtcctgagcgggccgggcgcctcctgcgaggctttcagcgagggagggatcttcaacatcaccagccccatgtgtctcgtgtccaagcagaatcgcttccggctgaccgagcagcaggtcaacttcgtgtgccagcgcgtggacatggacataatcgtgtactgcaacggccagcggaaggtcatcctgaccaagacgctcgttatcggccagtgcatctacaccatcaccagcctgttctccctgctccccggagtggcgcatagcatcgccgtcgaactgtgcgtacccgggttccacggctgggccaccgccgcgctgctcgtgacgttctgtttcggatgggtcctgatcccggccctgaccctcatcatcttaaccatcctcaagttcatcgccaacatattccacacctccaaccaggaaaaccgcctcaaaagcgtgctgcggaagatcaaggaggagttcgagaagacgaagggcagcatggtgtgcgacgtctgcaagtacgagtgtgagacctacaaggagctgaaggcccacggcgtgagctgcccccaatcgcagtgtccctactgcttcacccactgcgagcccaccgaggcggccttccaggcccactaccgcgtgtgccaggtaacgcacagattcagggacgacctcaagaagaccgtgaccccgcaaaacttcacgcccgggtgctaccggaccctgaatctgttccgctacaagagccggtgctacatcttcacgatgtgggtatgcctcctggtactggagtccatcctctgggccgccagtgcctccgaagtacccctgaacccggtgtggaacgacaacgcccacggcgtcggcagcgtgcccatgcacaccgacctggagctggatttctccctgaccagctctagcaaatacacctaccgccgtcgcctgacgaatcccctcgaggagacacagagcatcaacctgcacatcgagatcgaggagcaaaccatcggcgtggatgtccacgccctggggcactggttcgatggccgcctgaacctcaagacctccttccactgctacggcgcctgcacgaagtatgagtatccctggcacaccgcgaagtgccactacgagcgggattaccaatacgagaccagctggggctgcaacccggcggactgtccaggcgtggggaccgggtgcacagcctgtgggctgtacctcgaccagctcaaacccgtgggctccgcctacaagatcatcaccatccgctacagccggaaggtctgcgtgcagttcggcgaggagaacctgtgcaaggtgatcgacatgaatgactgcttcgtcacccgccacgtgaaggtttgcatcattgggaccgtcagtaagttcagccaaggcgacacgctcctgttcttcgggccgctggaagggggcggcctgatcttcaagcactggtgcacctccacgtgccagttcggcgacccgggggacatcatgagcccccgggacaagggcttcctctgccccgagttccctgggtccttccgcaagaagtgcaacttcgccaccaccccgctgtgcgagtacgacggaaacatggttagcgggtacaagaaggtgatggctaccatcgactccttccagagctttaatacctccaccatgcacttcacggacgagcggatcgagtggaaggaccccgacggaatgctgcgcgaccacatcaacatcctagtcaccaaggacatcgacttcgacaacctgggcgagaatccctgcaagatcgggctgcagaccagcagcatcgagggcgcgtgggggtcgggcgtgggtttcaccctcacgtgcctgatttccctgaccgagtgccccaccttcctcaccagcatcaaggcctgcgacaaagccatatgctacggcgcggagtccgtgacgctgactaggggccagaacaccgtcaaggtgagcgggaagggcgggcacagcggcagtaccttcaagtgctgccacggggaggagtgtagccagataggcctgcacgcggccgccccgcacctcgataaggtgaacggcatctccgagatagagaacaacaaagtctatgatgacggggcgccccaatgcggcgtgaagtgctggttcgtcaaaagcggcgagtggatctcaggcatcttcagcggcaactggatcgtcctcatcgtgctgtgcgtgttcctcctattctcccttgtgctcctgagcgtgctgtgcccggtccgcaagcacaagaagtcgtga

SEQ ID NO: 15000 - RNA, 3408 nt, synthetic construct
  misc_feature 1..3408: note = derived and/or modified CDS sequence (opt11) from HTNV(LongquanAa-11-473)__KC344263.1__GP
  source 1..3408: mol_type = other RNA
atgggcatctggaagtggctggtgatggccagcctcgtctggcccgccttcaccctgcgcaacgtgtacgacatgaagatcgagtgcccgcacaccgtgtccttcggggagaacagcgtcatcggctacgtcgagctgccacccatgcccctcgccgacacggcccagatggtgcccgagtccagctgcaacatggacaaccaccagtccatgaacaccatcaccaagtacacccaggtcagctggcgggggaaggccgatcaggcccaagcctcccagaacagcttcgaggcggtgtccgccgaggtggacctgaagggcatctgcgtcctgaagcacaagatgctcgaggagagctaccgctcccggaagtccatcacgtgctacgacctgtcctgcaacagcacctactgcaagcccaccctgtacatgattgtgcccatccacgcctgcaacatgatgaagtcctgcctcatcgccctggggccctaccgcgtgcaggtcgtgtacgagcgaacctactgcatgaccggcgtgctgctcgagggcaagtgcttcgtcccggaccagagcgtggtgtccatcatcaagcacgggatcttcgacatcgcgagcgtccacatcgtgtgcttcttcgtggccgtcaagggcaacacctacaagctgttcgagcaggtcaagaagtccttccagagcacgtgcaacgacaccgagaacaaggtgcaggggtactacatctgcatcgtgggcggtaacagtgcccccatctacgtgcccaccctggacgacttccgttccatggaggctttcagcggcatcttccggagcccccacggcgaggaccacgatctcgccggggaggagatcgcgagctactccatcgttggcccggccaacgccaaagtgccccacagcgcctccagcgacacgctgtccctgatagcttacagcgggatcccctcctacagctccctcagcatcctggcgaactccaccgaggccaagcacgtgttcagccccggcttcttcccgcagctgaaccacaccaagtgcgacaagacggccatcccactgatctggaccggcatgatcgacctgcccgggtactatgaggccatccacccctgcaccgtcttctgcgtgctgtccggcccgggggccagctgcgaggcgttctccgagggcgggatcttcaacatcaccagccccatgtgcctcgtgagcaagcagaaccgcttccggctgacggagcagcagatcaacttcgtctgccagcgcgtggacgtggacatcatcgtctactgcaacggccagcggaaggttatcctgaccaagaccctcgtgatcggccagtgtatctacaccatcacgtccctgttcagcctgctccccggggtcgcccacagcatcgccgtggagctgtgcgtgcccggcttccacggatgggccaccgccgcgctgctcgtcaccttctgcttcggctgggtgctgatcccggccctgaccctcatcatcttgacaatcctgaagttcatcgccaacatcttccacacctcaaaccaggagaaccgcctgaagtccgtgctgcggaagatcaaggaggagttcgagaagaccaaggggagcatggtctgcgacgtgtgcaagtacgaatgcgagacctacaaggagctgaaggcccacggcgtgtcctgcccccagagccagtgcccctactgcttcacgcactgcgagcccaccgaggcagccttccaagcccattaccgcgtctgccaggtgacccaccggttccgcgacgacctcaagaagaccgtgacgccgcagaacttcacccccggctgctaccggaccctgaacttgttccgctacaagtcccggtgctatatcttcaccatgtgggtctgcctcctggtgctggagagcatcctctgggccgcctccgcgagcgaggtgcccctgaacccggtctggaacgataacgcccacggggtgggatccgtgcccatgcacactgacctggagctggacttcagcctcacgtccagctccaagtacacctaccgccggcggctgaccaaccccctggaggagacccagagcatcaacttacacatagagatcgaggagcagacgatcggggtcgacgtccatgccctcggccactggttcgacgggcgcctgaacctcaagaccagcttccactgctacggcgcctgcaccaagtacgagtacccctggcacaccgccaagtgccactacgagcgggactaccagtacgagacgtcttggggctgcaatccggcggactgccccggggtgggcaccgggtgcaccgcctgcggcctgtatctggaccagctcaaacccgtcggcagcgcctacaagatcatcaccatccgctactcccgcaaggtgtgcgtgcagttcggggaggagaacctgtgcaaggtcatcgacatgaacgactgcttcgtgacgcgccacgtgaaggtctgcatcattggcaccgtgagcaagttctcccagggggacaccctcctcttcttcggccccctggagggcggcgggctgatcttcaagcactggtgcaccagcacgtgccagttcggggacccgggggacatcatgagcccccgggacaaggggttcctctgccccgagttccccggcagcttccgcaagaagtgcaacttcgccaccaccccgctgtgcgagtacgacgggaacatggtctcaggctacaagaaggtcatggccaccattgactctttccagtccttcaatacgagcaccatgcatttcaccgacgagcggatcgagtggaaggaccccgacggcatgctgcgcgaccacatcaacatcctcgtgaccaaggacatcgacttcgacaacctgggggagaacccctgcaagatcggcctgcagacgtccagcatcgagggggcgtggggctccggggtgggcttcaccctgacctgcctgatcagtctgaccgagtgccccacgttcctcacctccatcaaggcctgcgacaaggctatctgctacggcgctgagagcgtcaccctgacccgggggcagaacacggtgaaggtgtccggcaagggcgggcactccgggagcaccttcaagtgctgccacggcgaggaatgctcccagattggcctgcacgcggcagccccgcacctcgacaaggtcaacgggatcagcgagatcgagaacaacaaggtgtacgacgacggcgcgccccagtgcggggtgaagtgctggttcgtcaaatccggcgagtggatcagcggcatcttctccgggaactggatcgtgctgatcgtcctgtgtgtgttcctcctgttcagcctggtgctcctgtccgtcctgtgccccgtgcgcaagcacaagaagtcctga

SEQ ID NO: 15001 - RNA, 3408 nt, synthetic construct; identical to SEQ ID NO: 11715
  misc_feature 1..3408: note = derived and/or modified CDS sequence (opt11) from HTNV(LongquanAa-11-642)__KC344262.1__GP
  source 1..3408: mol_type = other RNA

SEQ ID NO: 15002 - RNA, 3408 nt, synthetic construct
  misc_feature 1..3408: note = derived and/or modified CDS sequence (opt11) from HTNV(LongquanAa-11-774)__KC344257.1__GP
  source 1..3408: mol_type = other RNA
atggagatctggaagtggctggtgatggcctcactcgtctggccagccttcaccttgcgcaacgtctacgatatgaagatcgagtgcccgcacaccgtgagttttggcgagaacagcgtcatcgggtatgtggagctgccgcccatgcccctcgccgacacggcccagatggtgcccgagtccagctgcaacatggacaaccatcagtccatgaacaccatcactaagtacacacaggtgagctggcggggaaaagccgatcaggcccaagcctcccagaacagcttcgaagcggtgtccgccgaggtggacctgaaggggacgtgcgtcttaaagcacaagatgttagaggagagctacaggtccaggaagtccatcacgtgctatgacctgtcctgtaactcaacgtactgcaagcctaccctgtacatgatcgtgccaatccacgcctgcaacatgatgaagtcctgcctcatcgccctgggcccgtaccgcgtgcaagtcgtttacgagcggacctactgcatgaccggcgtgctgatcgagggcaagtgcttcgtcccggaccagagcgtggtgtccatcatcaagcatggcatcttcgatatcgcgagcgtccacatcgtatgcttcttcgtggccgtcaaggggaacacctacaagctgttcgagcaggtcaagaaatccttccagagcacgtgcaacggcaccgagaataaggtgcaggggtactacatctgcatcgtgggcgggaacagcgcacccatctacgtgcccaccctggacgatttccgctccatggaggccttcagcggcatcttccggtctccccacggcgaggaccacgacctggccggggaagagatcgcgagctactccatcgtcggcccggccaacgccaaggtgccccacagcgcctccagcgataccctctccctgatcgcctacagcgggatcccctcctacagctccctgagcatactcgcgtcgagcaccgaggcgaagcacgtgttctcccccggcttcttcccgcagctgaaccacacgaagtgcgacaagaccgccatccccctaacctggaccggcatgatcgacctgccggggtattacgaggccatccacccctgtacggtattctgcgtgctgagcggtccgggggcgtcctgtgaggcgttcagcgagggcgggatcttcaacatcaccagccccatgtgcctggtgtccaagcagaaccgcttccggctcaccgagcagcaggtcaacttcgtgtgccagcgcgtggacatggacatcatcgtctactgcaatggacagcggaaggtgatcctgacaaagacgctggtgatcggccagtgcatatatacaataaccagcctcttctccctgctacccggggtcgcccacagcatcgccgtggagctctgcgtgcccggcttccacgggtgggccaccgccgccctgctggtcacgttttgcttcggctgggtactcatcccagccctgaccctgatcatcctcaccatcctgaagttcatcgccaacatcttccatacctctaaccaggagaaccgcctcaagagcgtgctccggaagatcaaggaggagttcgagaagacgaaggggtccatggtctgtgacgtgtgcaagtacgaatgcgagacctacaaggagctgaaggcccacggcgtgagctgcccccagtcgcagtgcccctactgcttcacccactgcgagcccaccgaggcggccttccaggcgcactaccgcgtctgccaagtgacgcaccggtttcgcgacgacctgaagaagaccgtgaccccgcagaacttcacccccggctgctaccggaccctgaatctgttccgctacaagagccggtgctacatcttcacgatgtgggtctgcctgctcgtgctggagtccatcctgtgggctgccagcgcgtccgaagtgcccctcaacccggtctggaacgacaacgcccacggggtcggaagcgtacccatgcacaccgacctggagctggacttttccctgaccagctccagtaagtacacataccgccggcgcctcacgaaccctctggaggaaacccagagcatcaacctgcacatcgagatcgaggagcaaaccatcggggtcgacgtgcatgccctcggccactggttcgacgggcgcctgaacctgaagacctcattccactgctacggcgcctgcacgaagtacgagtacccctggcacaccgccaagtgccactacgagcgggactaccagtacgagaccagctggggctgcaacccggcggactgccccggggtgggcacagggtgcaccgcttgcggactctacctggaccagctcaagcccgtcggctcggcctacaagatcatcaccatccgctattcacgaaaggtgtgcgttcagttcggggaggagaacctctgcaaggtcatcgacatgaacgactgcttcgtgacccgccacgtgaaggtctgcatcatcggcacagtgtccaagttcagccagggggacacgcttctgttctttggccccctcgaaggcgggggcttgatcttcaagcactggtgcacctccacgtgtcaattcggagatccgggggacatcatgagcccccgggacaaggggtttctgtgcccggagtttcccggctccttccgcaagaagtgcaatttcgccacaaccccgctctgcgagtacgacgggaacatggtgagcggctacaagaaggtcatggccaccatcgactccttccagagcttcaacacctccaccatgcacttcacggacgagcggatcgaatggaaggaccccgacggcatgctgcgcgaccacatcaacatcctggttaccaaagacatcgacttcgacaacctcggcgagaacccctgcaagatcggcctgcagaccagctccatcgagggcgcgtggggctcaggggtgggcttcaccctgacgtgcctcatatccctgaccgagtgccctaccttcctgacgagcattaaggcctgcgacaaagccatctgctacggtgccgagtccgtcacgctcactcgggggcagaacaccgtgaaggtatccggcaagggcgggcacagcgggtccaccttcaagtgctgccacggcgagaaatgcagccagatcggcttgcacgcagccgccccgcacctggacaaagtcaacggaatctccgagatcgagaacaacaaggtgtacgatgacggcgcgccccagtgtggggtgaagtgctggttcgttaagagcggggagtggatctccggcatcttcagcggcaactggatcgtgctcatcgtcctgtgcgtgttcctcctgttctccctggttctgctcagcgtcctgtgccccgtgcgcaagcacaaaaagtcctga

SEQ ID NO: 15003 - RNA, 3408 nt, synthetic construct
  misc_feature 1..3408: note = derived and/or modified CDS sequence (opt11) from HTNV(LongquanMf-09-8)__JQ912875.1__GP
  source 1..3408: mol_type = other RNA
atggaaatctggaaatggctcgtaatggcttcccttgtatggcctgcgttcacactcagaaacgtgtacgatatgaaaatcgaatgcccacacaccgtctcctttggcgaaaactccgtcatcggatacgtagaactcccacccatgccactagccgacacagcccaaatggtcccagaatcgagctgcaacatggacaaccaccagtcaatgaatacaatcaccaaatacacgcaagtctcgtggcgcgggaaagccgaccaagctcaagcctcacaaaacagcttcgaagcggtcagcgcagaagtcgacctcaaaggaacatgtgtcctgaaacacaaaatgctcgaagagtcataccgctcacgcaagagcatcacatgctatgacctctcgtgcaactccacatactgcaagccaaccctatacatgatagtccccatacacgcgtgcaacatgatgaaaagttgcctcatagctctaggcccctaccgcgtccaggtagtatacgaaagaacgtactgcatgaccggcgtattgatagaaggaaaatgtttcgtaccagaccaatcagtcgtttccatcatcaaacacggcatattcgatatcgcatccgtccacatcgtatgcttcttcgtggcagtaaaaggaaacacctacaaactcttcgaacaagttaagaagtcattccaatcaacatgcaacgggaccgaaaacaaagtccaaggctattacatctgcatcgtcggcggcaacagcgcgcccatttacgtacccaccctcgacgatttccgctccatggaagcgttctccggcattttcagatcaccccacggcgaagaccacgatctcgctggcgaagaaatagccagctacagcatcgtaggacccgccaacgcaaaggtcccacactccgcaagctccgacaccctatcactcatcgcgtatagtgggatcccctcctactcatcgctttctatactagccagcagcaccgaggccaagcacgtattcagccccggcttcttcccccaactcaaccacaccaaatgcgataaaacggcaatccccctcacatggaccggaatgattgacctccccggctactacgaagctatacatccgtgcacagtattctgcgtcctctcaggccccggcgcatcttgcgaggccttctcggagggaggaatattcaacatcacttcccccatgtgcctcgtatcgaaacaaaatagattccggctaacggagcaacaagttaacttcgtctgtcaacgagttgacatggacataatagtatactgtaacggtcaacgaaaagtcatccttacaaaaacccttgttattggccaatgcatctataccataacatccctcttctcccttctccccggcgtcgcccattcgatcgccgtcgagctgtgcgttccgggcttccacggctgggcaaccgccgcattactcgtcacattctgtttcggatgggtactcatcccagccctaaccctcataatcctgaccattcttaagttcatcgccaacatcttccacaccagcaaccaagaaaaccgcctcaaaagtgtcctccgcaaaatcaaagaagagttcgaaaagactaagggctcaatggtatgcgatgtctgcaagtatgaatgcgaaacctacaaagaacttaaggctcacggcgtgagctgcccacagagtcaatgcccctactgcttcacacactgcgagcccacagaagcggcctttcaagcccactacagagtctgccaagtaacccacagattcagggacgacctgaagaaaactgtaacgccccaaaatttcactcccggatgctaccgcactctaaatctcttccgatataagtccaggtgctatatcttcacaatgtgggtctgccttctagtgctagaaagcatcctatgggccgcctccgcctcagaagtccctctaaaccccgtatggaatgataacgctcacggtgtaggatccgtcccaatgcacaccgaccttgaactagatttcagtttaacctcctcttccaaatacacataccgccgccggctcaccaaccctctcgaagaaacacaatccatcaaccttcacatagagatcgaagaacaaaccatcggcgtggacgtccacgcactagggcattggttcgacggccgattaaacctaaaaaccagcttccactgctacggtgcctgtaccaaatacgaatacccatggcacaccgcaaaatgccactatgagagagattatcaatatgaaacatcctggggatgcaaccccgcagactgcccaggagtcggtacggggtgcaccgcctgcggactatacctcgaccaactaaagcccgtcggatcagcatacaaaattataaccatacgttactcccgtaaggtctgcgtgcaattcggagaagagaacctttgcaaagttatcgacatgaatgactgctttgtcacccgccacgtgaaagtctgtataatcgggaccgtatccaagttttcacaaggagataccttgctatttttcggtccactcgaaggaggaggcttaatcttcaaacactggtgcacttccacatgccaattcggagaccccggcgacattatgtcaccacgcgacaaaggattcctttgcccagagttccccggatccttccggaagaaatgcaacttcgcaaccacacccctatgtgaatacgacggcaacatggtatccggttacaagaaagtaatggcaaccatcgactcctttcaatccttcaacacttcgaccatgcacttcaccgacgaacgcattgaatggaaagaccccgacggaatgctacgggatcacatcaacatcctagtcaacaaggacatagacttcgataacctaggcgaaaacccctgcaaaatcggactccaaacatcatccatcgaaggagcctggggctccggcgtgggcttcacactaacctgccttatctcactaaccgaatgtccaaccttcctaacttcaatcaaggcctgtgacaaagcgatctgctacggcgcagaatccgtcaccttgacacgcggacagaacaccgtcaaagtctccggaaaaggcgggcacagcggttcaacatttaaatgctgccacggagaagaatgctcccaaataggccttcacgcagcagcaccgcacctcgacaaagtcaatggcatatcagaaatagagaacaacaaagtctacgacgacggagccccacagtgcggcgtaaagtgttggttcgtgaaatcgggtgaatggatctcgggaatcttctccggcaactggatagtactgatagtgctatgcgtattcctcctcttctccctcgtcctactctcggtactatgcccagtgcgaaagcacaagaaatcttaa

SEQ ID NO: 15004 - RNA, 3408 nt, synthetic construct; identical to SEQ ID NO: 11718
  misc_feature 1..3408: note = derived and/or modified CDS sequence (opt11) from HTNV(ROKA14-11)__KU207203.1__GP
  source 1..3408: mol_type = other RNA

SEQ ID NO: 15005 - RNA, 3408 nt, synthetic construct
  misc_feature 1..3408: note = derived and/or modified CDS sequence (opt11) from HTNV(US8A15-1)__KU207205.1__GP
  source 1..3408: mol_type = other RNA
atgggcatctggaagtggctggtgatggccagcctcgtctggcccgtgctgaccctgcgcaacgtgtacgacatgaagatcgagtgcccgcacactgtctccttcggggagaacagcgtgatcggctacgtggagctcccgcccatgcccctggccgacacggcgcagctggtccccgagtccagctgctccatggacaaccaccagagcctcaacaccatcaccaagtacacccaggtgtcctggcgggggaaggccgaccagagccagtccagccagaactccttcgagacggtgagcaccgaggtcgacctgaagggcacctgtgtgctgaaacacaagatggtggaagagtcctaccgcagccggaagtccattacctgctacgacctcagctgcaactccacatactgcaagcccaccctgtacatgatcgtccccatccacgcctgcaacatgatgaagtcctgcctgatcgcactcgggccctaccgcgtccaggtggtgtacgagcggacctactgcatgactggcgtgctgatcgagggcaagtgcttcgtgccggaccagtccgtcgtgagcatcatcaagcacggcatcttcgacatcgccagcgtgcacatcgtctgcttctttgtggcagtgaagggcaacacgtacaaaatcttcgagcaggtcaagaagtccttcgagtcaacctgcaacgacaccgagaacaaggtgcaggggtactacatctgcatcgtcggcggtaactccgcccccatctacgtgcccaccctggacgacttccgcagcatggaagccttcacgggcatcttcaggagcccccacggcgaggaccacgacctcgccggggaggagaccgcgacctacagcatcgtgggcccggccaacgccaaggtcccccactccgccagctccgacaccctgagcttgatcgccttctccgggatccccagctactccagcctctccatcctgacgagctccaccgaggcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcctctccgggccgggcgccagctgcgaggccttcagcgaagggggcatcttcaacatcacctcccccatgtgcctggtgagcaagcagaaccgcttccggctgaccgagcagcaggttaacttcgtctgccagcgcgtggacgtggacatcgtcgtgtattgcaacggccagcggaaggttatcctcaccaagacgctggtcatcgggcagtgcatctacaccatcacctccctgttcagcctcttacccggcgtggcgcactccatcgcagtggagctgtgcgtccccggtttccacggctgggccaccgccgccctcctggtgacgttctgcttcgggtgggtgctgatccccgcgatcacttttatcatcctcaccatcctgaagttcatcgccaacatcttccacaccagcaaccaggagaaccgcttaaagtccgtcctccggaagatcaaggaggagttcgagaagacgaagggcagcatggtgtgcgacgtgtgcaagtacgagtgcgagacctacaaggaattaaaggcccacggcgtctcctgcccccagagccagtgcccctactgcttcacccactgcgagcccaccgaggccgccttccaggcgcactacaaagtctgccaggtgacccaccgcttccgggacgacctgaagaagacggtaaccccgcagaacttcacccccgggtgctaccgcaccctcaacctgttccggtacaagtcccgctgctacatcttcacgatgtggatcttcctgctcgtgctggagagcatcctgtgggccgcctccgccagcgaaacgcccctcaccccggtctggaacgataacgcgcacggcgtcgggtccgtacccatgcacaccgacctggagctggacttcagcctgacctccagcagcaagtacacctaccggcgcaagctcacaaaccccttggaggaggcccagtcgatcgacctgcacatcgagatcgaggagcagaccatcggcgtggacgtccacgccctcgggcactggttcgacggccggctgaacctgaagacgagcttccactgctacggcgcctgcaccaagtacgagtacccctggcacaccgccaagtgccactacgagcgcgactaccagtacgagacctcctgggggtgcaacccgagcgactgccccggcgtggggacgggctgcaccgcgtgcggcctctacctggaccgcctgaagcccgtggggtccgcctacaagatcatcaccatccggtacagcagacgggtctgcgtgcagttcggcgaggagaacctctgcaagatcatcgacatgaacgactgtttcgtgtcccgccacgtcaaggtgtgcataattgggaccgtgagcaagttctcccagggcgacacgctgctgttcttcgggcccctcgagggcggcgggctgatcttcaagcactggtgcaccagcacatgccagttcggcgacccgggggacatcatgagcccccgggacaagggcttcctgtgccccgagttccccgggtccttccgcaagcactgcaacttcgccactacgccgatctgcgagtacgacggcaacatggtctccggctacaagaaggtgatggccaccatcgacagcttccaatccttcaacaccagcaccatgcacttcacggacgagcggatcgagtggaaggaccccgacgggatgctccgcgaccacatcaacatcctggtgaccaaggacatcgacttcgacaacctgggcgagaacccctgcaagatcgggctccagacctccagcatcgagggcgcctgggggtccggcgtcggcttcaccctgacgtgcctggtgagcctcaccgagtgcccaaccttcctgacctcgatcaaggcttgtgacaaggccatatgctacggggccgagtccgtgacgctgacccggggccagaacaccgtcaaggtgagcgggaagggcgggcactccggcagcaccttcaaatgctgccacggcgaggactgctcccagatcgggctccacgccgccgcgccgcacctggacaaggtgaacggcatcagcgagatggagaactccaaggtctatgacgacggggcaccccagtgtggcatcaagtgctggttcgtcaagagcggcgagtggatctccgggatcttcagcggcaactggatcgtgctgaccgtgctctgcgtgttcctgctgttctccctcgtcctgttaagcatcctctgccccgtgcgcaagcataagaagtcctga

SEQ ID NO: 15006 - RNA, 3408 nt, synthetic construct
  misc_feature 1..3408: note = derived and/or modified CDS sequence (opt11) from HTNV(Lee)__D00377.1__GP
  source 1..3408: mol_type = other RNA
atgggcatctggaagtggctggtgatggccagcctcgtctggcccgtgctgaccctgcgcaacgtgtacgacatgaagatagagtgcccgcacaccgtctccttcggggagaacagcgtgatcggctacgtggaactcccgcccatgcccctggccgacacggcccagctggtccccgagtccagctgctccatggacaaccaccagagcctcaacactatcactaagtacacccaggtgtcgtggcgggggaaggccgaccagagccagtccagccagacgtccttcgagaccgtgtcgaccgaggtcgatctgaaggggacctgcgtgcttaagcacaagatggtggaggagtcctaccgcagccggaagtccatcacgtgctacgatctcagctgcaactccacctactgcaagcccaccttgtacatgatcgtccccatccacgcctgcaacatgatgaagtcctgcctgatcgccctcgggccctaccgcgtccaggtggtgtacgagcggacctactgcatgacgggcgttctgatcgaggggaagtgcttcgtgcccgaccagtccgtcgtgagcatcatcaagcacggcatcttcgacatcgccagcgtgcacattgtctgcttcttcgtcgcggtgaagggcaacacctacaagatcttcgagcaggtcaagaagtccttcgaaagcacatgcaacgacaccgagaacaaagtgcagggctactacatctgcatcgtcggcgggaatagcgcccccatctacgtgcccacgctggacgacttccgcagcatggaggccttcacaggcatcttccggtcgccccacggcgaggaccacgacctcgccggggaggagaccgcgacctacagcatcgtgggcccggccaacgccaaggtcccccactccgccagctccgacacactgagcttgatcgccttctccgggatccccagcgactcctccttatccattctgaccagttccaccgaggcgaagcacgtgttcagccccggcctgttcccgaagctcaatcacaccaactgcgacaagggcgccatccccctgatgtggactgggatgatcgacctgccgggctactacgaggccattcacccctgcaccgtgttctgtgtcctctccgggccgggcgcgagctgcgaggccttcagcgaaggaggtatcttcaacattacctatcccatgtgcctggtgtccaagcagaaccgcttccggctgaccgagcaacaggtgaacttcgtttgccagcgcgtggacgtggacatcgtcgtgtactgcaacggccagcggaaggttatcctcacaaagaccctggtcatcgggcagtgcatctacaccatcaccagcctgttctcgctcctgcccggcgtcgcgcacagcatcgccgtggagctgtgcgtccccgggttccacggctgggccacggccgccctcctggtgaccttctgcttcgggtgggttctgatcccggcgatcaccttcatcatcctcaccatcctgaagttcatcgcgaatatcttccacacgtccaaccaggagaaccggctcaagagcgtcctgcggaagatcaaggaggagttcgagaagaccaaaggctccatggtatgcgacgtgtgcaagtacgagtgcgagacctacaaggagctgaaggcccacggcgtcagttgcccccagtcccagtgcccctactgtttcacccactgcgagcccacagaggccgccttccaggcgcactacaaggtttgccaggtgacacaccgctttcgggacgacctgaagaaaaccgtaaccccgcagaacttcacccccgggtgttaccgcacgctgaacctgttccggtacaagagccgctgctacatcttcacgatgtggatattcttactcgtgctggagtctattctgtgggccgccagcgcctccgagacgcccctcaccccggtgtggaacgacaacgcgcatggcgtcgggtctgtgcccatgcacaccgatctggagctggacttctccctgaccagctccagcaagtacacctaccggcgcaagctcacaaaccccctggaagaggcccagagcatcgacctgcacatcgagatcgaggagcagacgatcggcgtggacgtccacgcactcgggcactggttcgacggcagactgaacctgaagacctccttccactgctacggcgcctgcaccaagtacgagtacccctggcacaccgccaagtgccactacgagcgcgactaccagtacgagacgagctgggggtgcaacccgtccgactgccccggagtgggcaccggctgcacagcgtgcggcctatacctggaccgcctgaagcccgtggggtctgcctataagatcatcaccatccggtactcccgccgggtctgcgtgcagtttggagaggagaacctctgcaagataatcgacatgaacgactgcttcgtgagccgccacgtcaaggtgtgtatcatcgggacggtgtccaagttcagccagggcgataccctgctgttcttcgggcccctcgagggcggcgggcttatcttcaagcactggtgcacctccacttgccagttcggcgacccgggggacataatgagcccgcgggacaagggcttcctgtgccccgagttccccgggtccttccgcaaaaagtgcaacttcgccacaaccccaatctgcgagtacgacggcaacatggtgagcggctacaagaaggtgatggccaccatcgactcattccagagcttcaacacctccacgatgcacttcaccgacgagcggattgagtggaaggaccccgacgggatgctccgcgaccacatcaacatactggtcaccaaagacatcgacttcgacaacctgggcgagaacccctgcaagatcggcctccagaccagctccatcgagggagcctgggggtcaggcgtcggctttacgctgacctgcctggtgtccctcaccgagtgtcccaccttcctgacgagcatcaaggcgtgcgacaaggcgatctgctacggggccgagagcgtgaccctgacccggggccagaacaccgtcaaggtgagtgggaagggcggacacagcggctccaccttcaaatgctgccacggcgaggattgcagccagatcgggctccacgccgccgcgccgcacctggacaaggtaaacggcatctccgagatggaaaacagcaaggagtacgacgacggggcgccccagtgcggcatcaagtgctggttcgtcaagtccggcgagtggatcagcgggatcttctccggcaactggatcgtgctgatcgtcctctgcgtgttcctgctgttctctctcgtgctactgtccatcctatgccccgtcaggaaacacaaaaagagctga

SEQ ID NO: 15007 - RNA, 3384 nt, synthetic construct
  misc_feature 1..3384: note = derived and/or modified CDS sequence (opt11) from HTNV(M)__U38177.1__GP
  source 1..3384: mol_type = other RNA
atggccagcctggtgtggccggttctcaccctgcgcaacgtgtacgacatgaagatcgagtgcccgcacaccgtgtccttcggcgagaacagcgtcatcggttacgtggagctgccgcccgtgcccttggccgacacggcccagatggtccccgagtccagctgcaacatggacaaccaccagtccctgaacaccatcaccaagtacacccaggtgagctggcggggcaaggccgaccagtcacagagctcccaaaacagcttcgagactgtgtccaccgaggtcgacctgaaggggacctgcgtgctcaagcacaagatggtggaagagagctaccgctcccgcaagagcgtcacatgttacgacctgtcctgcaacagcacctactgcaagcccaccctgtacatgatcgtgcccatccacgcctgcaacatgatgaagtcctgcctcatagccctgggcccctaccgcgtgcaggtcgtgtacgagcggagctactgtatgaccggggtgctgatcgagggcaagtgcttcgtcccggaccagtccgtcgtgagcatcataaagcacggcatctttgacatcgccagcgtgcacatcgtgtgcttctttgtggcggtcaaggggaacacctacaaaatcttcgagcaggtcaagaagtccttcgagagcacgtgcaacgacaccgagaataaggtccagggctactacatctgcattgtcgggggcaactccgcccccatctacgtgcccaccctcgacgacttccgctccatggaggccttcaccgggatcttccggagcccccacggcgaggaccacgacctggccggcgaggagatcgcgtcctactccatcgtgggggccgccaacgccaaggtgccacacagcgcctccagcgacacgctgagactcatcgcgtactccggcatccccagctactccagcctgtccatcctgaccagctccaccgaggccaagcacgtgtttagccccggcctcttcccaaagctgaaccacaccaactgcgacaagtccgccatcccgttgatctggacgggaatgatcgacctccccgggtattacgaggccgtccacccctgcaccgtgttctgcgtgcttagcgggcccggggccagctgcgaggcgttctccgagggcgggatattcaacatcaccagcccgatgtgcctggtgtccaagcagaaccggtttagactcaccgagcagcaggtcaatttcgtgtgccaacgggtggatatggacatcgtggtgtactgcaacgggcagcgcaaggtcatcctgaccaagaccctggtgatcggccagtgcatctacaccatcaccagcctcttctccctgcttcccggcgtggcccacagcatcgccgtcgagctctgcgtgcccgggttccacggctgggccacggccgcgctgctggtgaccttctgcttcgggtgggtccttatccccgccatcacgttcatcatcctgaccgtactgaagttcattgccaacatcttccacacgtccaaccaggagaaccggctcaagagcgtgctgagaaagatcaaggaggagttcgagaagaccaagggctccatggtctgcgacgtgtgcaagtacgagtgcgagacctacaaggagctgaaggcccacggggtgagctgcccgcagtcccagtgcccgtactgcttcacccactgcgagcccacggaggccgcgttccaggcccactacaaggtctgccaggtgacccaccggttccgagacgacctcaagaagaccgtgacgccccagaacttcaccccgggctgctaccggaccctgaacctgttccgctacaagagccggtgctacatcttcaccatgtggatcttcctcctggtcctggagtccatcctctgggccgccagcgcctccgagacgcccctgactcccgtgtggaacgacaacgcccacggcgtggggagcgtcccgatgcacaccgacctggagctcgacttctccctgacctctagctccaagtacacctaccgccggaagctgaccaaccccctggaggaggcccagagcatcgacctccacatcgagatcgaggagcagacgatcggcgtggacgtgcacgccctggggcactggttcgacggccgcctgaacctcaagacatcctttcactgttacggggcctgcaccaagtacgagtatccctggcacaccgcgaagtgccactacgagcgcgactaccagtacgagacgagctggggctgcaatccctccgactgcccgggcgtcgggaccggctgcaccgcctgcgggctgtacctggaccagttaaagcccgtgggcagcgcctacaagatcatcaccatccggtactcccgccgggtgtgcgtccagttcggcgaggagaacctgtgcaagatcatcgacatgaacgactgcttcgtgagccgccacgttaaggtctgcatcatcgggacggtgtccaagttcagccagggcgacaccctcctgttcttcgggcccctggagggcgggggcctgatcttcaagcactggtgcaccagcacgtgccagttcggggaccccggggatataatgagcccgcgggacaagggcttcctctgccccgagttccccgggtccttccgcaagaagtgcaacttcgccaccacccccatctgcgagtacgacggcaacatggtgtctgggtacaaaaaggtcatggccaccatcgactccttccagagcttcaacacctccacgatgcacttcaccgacgagcggatcgagtggaaggacccggacggcatgctgcgcgaccacatcaacattctggttaccaaagacatcgacttcgacaacctcggcgagaacccctgcaagatcgggctgcagaccagctccatcgagggtgcatgggggagcggcgtggggttcacgctgacctgcctcgtcagcctgaccgagtgccccaccttcctgacgtccatcaaagcctgcgacaaggccatctgctacggcgccgagagcgttacgctcacccggggccagaacaccgtgaaggtctccgggaagggagggcacagcgggtccacgttcaagtgctgccacggggaagactgcagccagatcggcctgcacgccgcggcgccccacctggacaaggtgaacggcatctccgagatcgagaacagcaaggtctacgacgacggggccccgcagtgcggcattaagtgctggttcgtgaagtccggggagtggatcagcggcatcttctccggcaactggatcgtgctcattgtcctgtgcgtgttcctcttattcagcctggttctcctctccatcctgtgccccgtccgcaagcacaagaagtcctga

SEQ ID NO: 15008 - RNA, 3408 nt, synthetic construct
  misc_feature 1..3408: note = derived and/or modified CDS sequence (opt11) from HTNV(N8)__EF077656.1__GP
  source 1..3408: mol_type = other RNA
atgggcatctggaagtggctggtgatggccagcctcgtctggcccgcctacaccctgcgcaacgtgtacgacatgaagatcgagtgcccccacaccgtgagcttcggggagaactctgtcatcggctacgtggagctaccgcccatgcccctcgcggacacggcccagatggtgcccgaatccagctgcaacatggataaccaccagtccatgaacaccatcaccaagtacacccaggtcagctggcgggggaaagccgaccaggctcaggcctcccagaacagcttcgaggcggtgtccgccgaggttgacctgaaaggcacgtgcgtcctgaagcacaagatgctcgaggagtcctaccgctcccgcaagagcatcacgtgctacgacctgtcctgcaacaacacctactgcaagccaaccctgtacatgatcgtgcccatccacgcctgcaacatgatgaagtcctgtctcatcgccctggggccctaccgggtgcaggtcatctacgagcggacctactgcatgaccggcgtgctgatcgagggcaagtgcttcgtgccggaccagtccgtcgtgagcatcatcaagcacgggatcttcgacatcgcatccgtgcacatcgtctgctttttcgtggccgtgaagggcaacacctacaaactgttcgagcaggtcaagaagtccttccagagcacgtgcaacgataccgagaacaaggtgcaggggtactacatctgcatcgtgggcgggaacagcgcccccatctacgtccccaccctggacgacttccgcagcatggaggccttctccgggatcttccggagcccccacggcgaggaccatgacctagccggggaggagatcgcgtcctacagcatcgtgggcccggccaacgccaaggtcccccactccgccagttccgacaccctcagcctgatcgcctactccgggatcccctcgtactccagcctgtccatcctcaccggcagcacggaggcgaagcatgtgttctcccccggcttcttcccgcagctgaaccacaccaagtgcgacaagaccgccatcccgctgacctggacggggatgatcgacctcccaggctactacgaggccatccacccctgcaccgtgttctgcgtcctgagcgggccgggcgcctcctgcgaggccttcagcgagggcgggatcttcaacatcacctcccccatgtgcttagttagcaagcagaaccgcttccggctcaccgagcagcaagtcaacttcgtgtgccagcgcgtggacatggacatcatcgtatattgcaacggccagcggaaggtcattttaacgaagaccctggtgatcgggcagtgcatctacaccatcaccagcttattctccttactgcccggcgtggcgcacagcatcgccgtcgagctctgcgtgcccgggttccacggctgggccacggccgccctgctggtgaccttctgcttcgggtgggtcctcatcccggcaatcaccttcatcatcctgaccgtgctgaagttcatcgccaatatcttccacacgtccaaccaggagaaccgcctccgggccgtgctgcgcaagatcaaggaggagttcgagaagaccaagggcagcatggtctgcgacgtgtgcaagtacgagtgcgaaacctacaaggagctgaaggcccacggcgtgtcctgcccccagagccagtgcccctactgcttcacccactgcgagcccacggaggcggccttccaggcccactaccgggtctgccaggtgacccaccggttccgggacgacctcaagaagaccgtgaccccgcagaacttcacccccgggtgctaccgcacgctgaacctgttccgttacaagtcgcgctgctacatcttcaccatgtgggtctgccttctggtgttagagagcatcctctgggccgcctccgcgagcgaggtgcccctgaacccggtctggaacgacaacgcccacggcgtagggtccgtgcccatgcacaccgacctggagctcgacttcagcctgacctcaagctccaagtacacgtaccggcgccgcctgacgaaccccctggaggagacccaggccatcaacctccacatcgagatcgaggagcagaccatcggcgtcgacgtgcacgccctgggtcactggttcgacggccgtctgaacctcaagacgagcttccactgctacggcgcctgcaccaagtacgagtacccctggcacacagcgaagtgccactacgagcgcgactaccagtacgagacctcctgggggtgcaacccggccgactgccccggcgtggggacgggctgcaccgcctgcggcctgtacatagaccagctgaagcccgtcgggagcgcctacaagatcatcaccatccggtacagccgcaaagtgtgcgtgcagttcggcgaggagaacctctgcaaggtcatcgatatgaacgactgctttgtgtcccggcacgtgaaggtctgcatcatcgggaccgtgagcaagttctcccagggcgacacgctcctgttcttcgggcccctcgagggcggcgggctgatatttaaacactggtgcaccagcacgtgccagttcggcgaccccggggacatcatgagcccccgcgacaagggcttcctgtgccccgagttccccgggagcttccggaagaagtgcaacttcgccaccacgcccctctgcgagtacgatggcaacatggtgtccggctacaagaaggtcatggcgaccatcgacagcttccagtccttcaacaccagcaccatgcacttcaccgacgagcgcatcgagtggaaggaccccgacgggatgctgcgggaccacatcaacatcctggtcaccaaggacatcgacttcgacaacctcggcgagaacccctgcaagatcgggctgcagacctcaagcatcgagggcgcctgggggtccggcgtgggcttcaccctgacgtgcctcgtcagcctgaccgagtgccccaccttcctgacctccatcaaggcctgcgacaaggccatctgctacggggcggagagtgtggccctcacgcgcggccagaacaccgtgaaggtctccgggaagggcgggcacagcggctcgaccttcaagtgctgccacggcgaggagtgtagccagatcgggctgcacgccgccgccccgcacctggacaaggtgaacggcatctcagaggtggagaacaacaaggtctacgacgacggggctccccagtgcggcgtgaagtgctggttcgtcaagtccggcgagtggatcagcgggattttctccggcaactggatcgtgctcatcgtgctgtgcgtcttcctccttttcagcctggtgctgctctccgtgctgtgccccgttcggaagcacaaaaagtcctga

SEQ ID NO: 15009 - RNA, 3408 nt, synthetic construct; identical to SEQ ID NO: 11723
  misc_feature 1..3408: note = derived and/or modified CDS sequence (opt11) from HTNV(Q32)__DQ371905.1__GP
  source 1..3408: mol_type = other RNA

SEQ ID NO: 15010 - RNA, 3408 nt, synthetic construct
  misc_feature 1..3408: note = derived and/or modified CDS sequence (opt11) from HTNV(Bao14)__AB127995.1__GP
  source 1..3408: mol_type = other RNA
atggggatgtggaagtggctggtgatcgccagcctcgtctggcccgccctggccctgcgcaacgtgtacgacatgaagatcgagtgcccgcacactgtgtccttcggggagaacagcgtcatcggctacgtggagctcccgcccatgcccctggccgacaccgcccagatggtacccgagtccagctgctccatggacaaccaccagagcatcaacacgatcaccaagtacacccaggtgatctggcgggggaaggccgaccccggccagtccagccagaacagcttcgagaccgtcagcacggaggtggacctgaaggggacctgcgtcctcaagcacaagatggtggaggagtcctaccgcagccgtaagtccataacctgctacgacctgagctgcaactccacctactgcaagcccacgctgtacatgatcgtgcccatccacgcctgcaacatgatgaagtcttgcctcatcgccctcggcccgtaccgggtacaggtggtgtacgagcggacctactgcatgaccggcgtactcatcgaggggaagtgcttcgtgcccgaccaatccgtggtcagcatcatcaagcacggcatcttcgacatcgcctccgtgcacatcgtttgcttcttcgtcgccgtgaaagggaacacctataagctgttcgagcaagtgaagaagtccttcgagagcacgtgcaatgacaccgagaacaaagtccagggatattacatctgcatcgtcgggggcaactccgcccccatctacgtgcccaccctggacgacttccgcagcatggaggcgttcaccggcatcttcaagtccccgcacggggaagaccacgacctggccggtgaggagatcgccagctactcgatcgtggggcccgccaacgccaaggtgccccacagcgcgtccagcgacacgctctccctgatcgcctacagcggcatcccctcctacagctccctgagcatcctcacctccagcaccgacgccaagcacgtgttctccccgggactgttccccaagctgaaccacacaaactgcgacaagagcgccatccccctcacgtggaccgggatgatcgacctgcccggctactacgaggccatccacccgtgcaccgtgttctgcgtgctgtccgggcccggcgcgagctgcgaggccttcagcgaagggggcatcttcaacatcacctcccccatgtgcctcgtcagcaaacagaaccggttccgcctgacggagcaacaggtgaacttcgtgtgccagcgggtcgacatggacatcgtggtgtactgcaacggccagcgcaaggtcatcctgacaaagacgctcgtgatcgggcagtgcatctacaccatcacgtccctctttagcctgctccccggcgtggcccactccatcgccgtcgagctgtgcgtgcccgggttccacggctgggccaccgcggccctgctcgtgaccttctgcttcgggtgggtcctgatcccagccgtgaccttcatcatcctgacggtgctcaagttcatcgccaacatcttccacaccagcaaccaggagaatcggctgaaatcggtcctgcgcaagatcaaggaggagttcgagaagaccaagggcagcatggtgtgcgacgtgtgcaagtacgagtgcgagacctacaaggagctcaaggcccacggggtgtcctgcccccagagccagtgcccctactgcttcacgcactgcgagccgaccgaggcggccttccaggcccactacaaggtgtgccaggtgacccaccggttccgcgacgacctgaagaagaccgtcacgccccagaacttcacccccgggtgctaccggaccctgaacctcttccgctacaaatcccgttgctacatcttcaccatgtgggtgttcctgcttatcttagagagcgtcctgtgggccgcgtccgccagcgagaccccgctgacgcccgtctggaacgacaatgcacacggcgtggggtccgtgcccatgcacaccgacctcgagctggacttcagcctgacgtcgagcagcaagtacacctaccgccggaagctgacgaaccccctggaggaggcccagtccatcgacctgcacatcgagatcgaggagcagaccatcggcgtcgatgtgcacgccctggggcactggttcgacggccgcctcaacctgaagaccagcttccactgctacggcgcgtgtaccaagtacgagtacccgtggcacacggccaagtgccactacgagcgggactaccagtacgagacctcctgggggtgcaaccccagcgactgccccggcgtggggaccggctgtaccgcctgtggcctgtacctcgaccagctgaagcccgtagggtccgcctacaagatcatcacgatccgctatagccgccgggtgtgcgtgcagttcggcgaggagaacctgtgcaaaatcatcgacatgaacgactgcttcgtatcccgccacgttaaggtgtgcatcatcgggactgtcagcaagttctcccagggcgacaccctcctgttcttcgggccgctggagggcggcgggctcatcttcaagcactggtgcacgagcacgtgccagttcggcgaccccggggacatcatgagcccccgggacaagggcttcctgtgccccgagttcccggggtccttccgcaagaagtgcaacttcgccaccacccccatctgcgagtacgacggcaacatggtgtccggttacaagaaggtgatggcgaccatcgacagcttccagagtttcaacacgagcaccatgcacttcaccgacgagcggatcgagtggaaggaccccgacggcatgctgcgcgaccacatcaacatcctcgtcaccaaggacatcgacttcgacaacctgggcgagaacccctgcaagatcgggctgcagacgtccagcatcgagggagcctgggggtccggcgtgggcttcaccttaacctgcctggtgagcttaaccgagtgcccgacgttcctcaccagcatcaaggcctgcgacaaggccatctgctacggggccgagtccgtcaccctgacccggggccagaacacggtgcgcgtgagcgggaagggcgggcactccggcagcaccttcaagtgctgccacggcgaagactgctccaagatcgggctgcacgcggccgcgccccacctcgacaaggttaacggcatcagcgagatcgagaactcgaaggtgtacgacgacggggcaccccagtgcggcatcaagtgctggttcgtcaagagcggcgagtggatctccgggatcttctctggcaactggatcgtgctgatcgtgctgtgcgtattcctcctgttctccctggttctcctgagcatcctgtgccccgtgcggaagcacaagaagtcctga

SEQ ID NO: 15011 - RNA, 3408 nt, synthetic construct
  misc_feature 1..3408: note = derived and/or modified CDS sequence (opt11) from HTNV(HubeiHu02)__JQ665881.1__GP
  source 1..3408: mol_type = other RNA
atgggcatctggaagtggctcgtcatggccagcctcgtctggcccgccttcgctctgcgcaacgtgtacgacatgaagatcgagtgcccgcacaccgtgtccttcggggagaacagcgtcatcggctacgttgagctgccgcccatgcccctggccgacaccgcccagatggtacccgagtcctcgtgctccatggacaaccaccagagcctgaacaccatcacaaaatacacgcagatcgtctggcgcgggaaggccgatcagtcccagagctcccagaacagcttcgagaccgtgtccacggaagtggacctgaaggggacctgcgtcctcaagcacaagatggtggaggagagctaccgctcccgcaagtccatcacgtgctacgacctgtcctgcaacagcacctactgcaagcccaccctgtacatgatagtgcccatccacgcctgcaacatgatgaagtcctgcctcatcgcgctggggccctaccgcgtccaggtggtgtacgagcggacctactgcatgaccggcgtcctgatcgagggcaagtgcttcgtgccggaccagagcgtggtctccatcatcaagcacgggatctttgacatcgccagcgtgcacatcgtgtgctttttcgtcgccgtgaagggcagcacctacaagctgttcgagcaggtcaagaaatccttcgagagtaactgcaacgacaccgagaacaaggtacaggggcactacatctgcatagtgggtgggaactcggcccccatctacgtccccaccctggacgacttccgaagcatggaggccttttccggcatcttcaagagcccccacggcgaggatcacgacttagcgggggaggaagtggcctcctacagcatcgtgggcccggctaacgccaaggtcccacactctgcgagctccgacaccctcagcctcatcgcctactccgggatccccagctattccagcctgtccatcctcaccagcctgacggaggccaagcacgtgttctcccccggcctgttcccgcagctcaaccacacaaaatgtgacaagaccgccatcccgctgacctggacgggaatgatcgacctgcccgggtactacgaggccgtgcacccctgcaccgtcttctgcgtgctcagcggcccgggggcgagctgcgaggccttctccgaaggcgggattctgaacatcaccagccccatgtgcctggtgtccaagcagaaccggttccgtctcaccgagcagcaggtaaacttcgtgtgccagagggtggacgtggacatcgtggtgtactgtaacggccagcgcaaggtcatcctgaccaagaccctggtgatcggccagtgcatctacaccatcaccagcctcttctccctgctgcccggggtggcccacagcatcgccgtggagctctgcgtgccaggcttccacgggtgggccacggcagccctgctggtgaccttctgctttggctgggtcttgatcccggccatcaccttcatcatcctgaccatcctgaagttcatcgcgaacatcttccacaccagtaaccaggagaaccggctcaagagcgtgctgcgcaagatcaaagaggagttcgagcggacaaaggggtccatggtgtgcgacgtttgcaagtacgagtgcgagacctacaaggagctgaaagcccacggcgtgtcgtgcccccagtcccagtgcccctactgcttcacccactgcgagccaacggaggcggcctttcaggcccactacaaggtgtgccaggtcacccaccgcttccgggacgacctcaagaagaccgtgaccccgcagaacttcacccccggctgctaccgcacgttaaacctgttccggtacaagagccgctgctacatcttcaccatgtgggtattcctcctggtcctggagtccatcctctgggccgcgagcgcctcggaaacgcccctgaacccggtgtggaacgacaacgcccacggagtgggcagcgtcccaatgcacacggacctggagctggacttctccctcaccagcagctccaagtacacctaccggaggaagctgaccaatcccctggaagagagccaggccatcaacctccacatcgagatcgaggagcagaccatcggggtggacgtgcacgccctgggccactggttcgacgggcggctgaacctcaaaacgtccttccactgctacggcgcgtgcaccaagtacgagtacccctggcacaccgccaagtgccattacgagcgcgactaccagtacgagaccagctggggctgcaacccgagtgactgccccggggtcggcacggggtgcaccgcctgcggcctgtacctggaccagctcaagccagtgggcagcgcctacaagattatcaccatccgctacagtcggcgcgtgtgcgtccagtttggggaggagaacctgtgcaagatcattgacatgaacgactgcttcgtgtcacggcacgtgaaggtctgcatcattggcaccgtgtccaagttcagccagggggacacgctcctctttttcggccccctggagggcggcgggcttatcttcaagcactggtgcacatctacgtgccagttcggggacccgggggacatcatgagcccgcgcgataaggggttcttgtgccccgagtttcccggctccttccggaagaagtgcaacttcgccaccaccccgatctgcgagtacgacgggaacatggtgagcggctacaagaaggtcatggcgaccatcgattccttccagagcttcaacacctccaccatgcacttcactgacgagcgcatcgagtggaaggaccccgacggcatgctgcgggaccacatcagcatccttgtgaccaaagacatcgacttcgacaacctcggcgagaacccctgcaagataggcctgcagacctccagcatcgagggggcctggggcagcggggtgggctacaccctgacgtgccttatctccctaaccgagtgccccaccttcctgaccagcatcaaagcctgcgataaggccatctgctacggcgccgagtccgtcacgctcaccagagggcagaacaccgtgaaggtgagcggcaagggcgggcactccggcagctccttcaagtgctgccacggcgaggactgcagccagatcggcttgcacgcggccgccccgcaccttgacaaagtcaacgggatctccgagatcgagaacagcaaggtgttcgacgacggcgcgccccagtgcgggataaagtgctggttcgttaaatccggcgagtggattagcggcatcttcaacgggaactggatcgtgctcatcgtgctatgcgtcttcttactgttctccctggtgttgctaagtatcttgtgcccggtgcggaagcacaagaagtcctaa

SEQ ID NO: 15012 - RNA, 3408 nt, synthetic construct
  misc_feature 1..3408: note = derived and/or modified CDS sequence (opt11) from HTNV(HV004)__JQ083394.1__GP
  source 1..3408: mol_type = other RNA
atgggtatctggaagtggctggtgatggccagcctcgtctggcccgccttcgccctgcgcaacgtgtacgacatgaagatcgagtgtccgcacaccgtgtccttcggggagaactcggtaatcggatacgtggagttgccgcccatgcccctcgccgacaccgcccagatggtgcccgaatccagctgctccatggacaaccaccagagcctcaatacgatcaccaagtacacgcagatcatctggcgggggaaggccgaccagtcccagagctcccagaacagtttcgagaccgtctccaccgaggtggatctgaaggggacctgcgtgctcaagcataagatggtcgaggagagctatcgctcccgaaagagtatcacgtgctatgacctgtcctgcaacagcacttactgcaagcccaccctgtatatgatcgttcccatccacgcctgcaacatgatgaagtcctgcctcatcgcgctggggccctaccgcgtgcaggtcgtgtacgaacgtacctactgcatgaccggcgtgctgatcgagggcaagtgcttcgtccctgaccagagcgtagtgtccatcatcaagcatgggatcttcgacatcgcctccgtccacatcgtttgctttttcgtggccgtcaagggcagcacatacaagctgtttgagcaggtcaagaagtcctttgagtcaaactgcaacgacacggagaacaaggtccaggggtactacatctgcatcgtgggcgggaactccgcccccatctacgtgcccaccctcgacgacttccgcagcatggaggcgttctccggcatcttcaagagcccccacggcgaagaccacgacctggccggtgaggaggtcgcctcctatagcatcgtgggcccggccaacgccaaggtccctcactccgcgtcttccgacactctcagcctgatcgcatattccgggatccccagctacagtagcctttccatcctcaccagctccacggaggccaagcacgtcttctcgcccggcctgttcccgcaactgaaccacaccaagtgcgacaaaaccgccatccccctaacctggacgggcatgatcgacttacccggatactacgaggcgatccacccttgcaccgtgttctgcgtgctgagcggaccgggggcgtcctgcgaggccttcagcgagggcgggatcttcaacataacctcccccatgtgcctcgtcagcaagcagaaccggttccgcctgaccgagcagcaggtcaacttcgtgtgccagcgagtggacgtggacatcgtggtctactgcaatggccagcgcaaggtgatactgactaagacccttgttatcggccagtgcatatacacaatcacttccctgttcagcctgctccccggggtcgcgcactccatcgccgtggagttgtgcgtgcccggctttcatggatgggccactgcggcccttctcgtcactttctgcttcggctgggtgctgatcccggcgataacctttatcatcctgactatcctcaagttcatcgcaaacatcttccatacgagcaatcaggagaacaagctgaagtccgtgttgcggaagatcaaggaggagttcgagcgcaccaaaggaagcatggtttgcgatgtgtgcaagtacgagtgtgaaacctacaaagagctcaaggcccatggcgtgtcctgcccacagagccagtgcccctactgtttcacccactgtgagccgacggaggcggcattccaggcccactacaaggtctgccaggtcacccaccgcttccgcgacgacctgaagaagaccgtgaccccgcagaacttcacccctggatgctaccgaacactgaacctattccggtacaagtcccggtgctacatcttcaccatgtgggtcttcctgctggtactcgaatctattctgtgggctgcctccgccagcgagacgcctctgaacccggtgtggaatgacaacgcccacggggtcggctccgtgcccatgcataccgacctcgaactggacttcagcctgaccagctccagcaagtacacctaccgccgcaagctcaccaatcctctcgaggagtcccaggccataaacctgcacatcgagatcgaggaacaaaccatcggggtggacgtccacgcactgggacactggttcgacgggcgcctcaacctgaagacgagcttccactgctacggcgcgtgcactaagtacgaatacccatggcataccgctaagtgccactacgagcgggactaccagtacgaaacctcctgggggtgtaaccccagcgactgccccggggtgggcacgggatgcaccgcctgtggcctgtacttagaccaactgaagcccgtagggtccgcctacaaaattatcaccatccgctacagcagacgcgtgtgtgtgcagttcggagaggaaaacctgtgcaagatcatcgacatgaacgactgcttcgtgtccagacatgtcaaggtgtgcatcatcggcaccgtgagcaagttctcccagggggacacgctcttgttcttcggccccctggagggcgggggcctcatcttcaagcattggtgcaccagcacatgccagttcggggacccgggcgacatcatgagcccccgggacaaggggttcctgtgcccagagttccccggtagcttccgcaaaaagtgcaacttcgccactaccccgatctgcgagtacgacggaaacatggtctccggttataagaaggtgatggcgaccatcgacagcttccagtccttcaacacgagcaccatgcatttcacggacgaacgaatcgagtggaaggaccccgatggcatgctgcgcgaccacataaacatcctcgtgacaaaggatatcgatttcgacaaccttggggagaatccctgcaagatcggcctgcagacctccagcatcgagggggcctggggctcaggggtcggcttcaccctcacgtgcctgataagcctgaccgagtgccccacgttcctcacctcaatcaaagcctgcgacaaggccatctgctacggcgccgagtccgtgacgcttacccgtgggcagaacaccgtgaaagtcagcggcaagggcgggcacagtgggagctccttcaagtgctgccacggcgaagactgtagccagatcggcctgcacgcggccgcaccgcacctcgacaaggtgaacgggatcagcgagatagagaactctaaggtgttcgacgacggggctccccagtgtgggatcaagtgctggttcgtcaagtccggagagtggatcagcggcatcttcaacgggaactggatcgtcctgatcgtcctgtgcgtattcctcctgttctccctggttctcctgtctatcctgtgccccgtccgcaagcacaagaagtcctaa

SEQ ID NO: 15013 - RNA, 3405 nt, synthetic construct; identical to SEQ ID NO: 11727
  misc_feature 1..3405: note = derived and/or modified CDS sequence (opt11) from HTNV(NC167)__AB027115.2__GP
  source 1..3405: mol_type = other RNA

SEQ ID NO: 15014 - RNA, 3408 nt, synthetic construct
  misc_feature 1..3408: note = derived and/or modified CDS sequence (opt11) from HTNV(WuhanAaJ10)__JQ665882.1__GP
  source 1..3408: mol_type = other RNA
atgggcatctggaagtggctggtgatggccagcctcgtctggcctgccttcgccctgcgcaacgtgtatgacatgaagatagagtgcccgcataccgtgtccttcggtgagaacagcgtcatcggctacgtggaactgccgcccatgcccctcgccgacaccgcccagatggtgcccgagtccagctgctccatggacaaccaccagagcctgaacacgatcaccaagtacacgcagatcatctggcgggggaaggctgaccaatctcagagctcccagaacagcttcgagaccgtctccacggaggtggacctgaaagggacctgcgtgctcaaacacaagatggtagaggagagctaccgctcccgcaagagcatcacgtgctacgacctgtcctgcaacagcacttactgcaagcccgccttatacatgatcgtgcccatccacgcgtgcaacatgatgaagtcctgtctcatcgccctggggccctaccgcgtgcaagtcgtgtacgagcggacgtactgcatgaccggcgtgctgatcgagggcaagtgcttcgtcccggatcagagcgtggtgtccatcataaagcacgggatcttcgacatcgccagcgtacacactgtgtgcttcttcgttgccgtcaagggcagcacctacaagctgttcgagcaggcgaaaaagtccttccagagtaactgcaacgacacagagaacaaggtgcaggggtactacatctgcatagtgggcgggtcctcagcgcccatctacgtccccaccctggacgacttccgttccatggaggccttcagcgggctgttcaagagccctcacggcgaggaccacgacttagcgggggaggaggtggcctcctactccatcgtcggcccggcgaatgccaaggtgccccacagcgcctccagcgacacactgtccctgatcgcctacagcgggatcccatcctatagctccctcagcatcctgacgtcgtcaacggaagccaagcacgtcttcagccccggcctgttcccgcagctcaaccacaccaagtgcgacaagaccgcgatccccctgacctggacgggcatgatcgatctgcccgggtattacgaggccgtccacccctgcacggtattctgcgttctcagcggcccaggcgccagctgcgaggccttctccgagggcgggatcttcaacatcaccagccccatgtgtctcgtctccaagcagaatcggttccggctgaccgagcagcaagtcaacttcgtgtgccagcgagtggacgtggacatcatcgtgtactgcaacggccagcgcaaggtcatcctcaccaagaccctggtgattggccaatgcatctacaccatcaccagcttgatctcactcctgccgggggtggcgcacagcatcgcggtcgagctgtgcgtgcccggctcccacgggtgggctacggccgcgctcctggtgaccttctgcttcggctgggttctgatccctgccatcaccttcatcatcctcaccatcctgaagttcatcgctaatatcttccacacgagcaaccaagagaaccggctgaagtccgtgctccgcaagatcaaggaagagttcgagcggaccaaggggagcatggtgtgcgacgtctgtaaatacgagtgcgagacatacaaggagctgaaggcacacggtgtgtcctgcccccagagccagtgcccctattgcttcacccactgcgagcccacggaggccgccttccaggcgcactacaaagtgtgccaggtcacccaccgcttccgggacgatctgaagaagacagtgaccccgcagaacttcaccccgggctgctaccgcacgctcaacttattccggtacaagtcccgctgctacatcttcacaatgtgggtgttcctcctcgtcctggagagcatcctgtgggccgcctccgccagcgagacgcccctcaacccggtatggaacgacaacgcccacggggtgggcagcgtccctatgcacaccgacctggagctggacttctccctgaccagttcctcaaagtatacttaccggcgcaagctcactaaccccctggaggagtcccaggcgatcgatctgcacatcgagatcgaagaccagaccatcggggtggatgtgcacgccctcggacattggttcgacgggcggctgaacctggagacgagcttccactgctacggcgcctgcaccaagtacgagtacccctggcacaccgccaaatgccactacgagcgcgactaccagtacgagacctcctggggctgcagcccgtccgactgccccggggtcggcacggggtgcaccgcctgcggcctctacttagaccagctgaaacccgtgggttcagcgtacaagatcatcaccatccgctactcccgacgcgtgtgcgttcagagcggggaggaaaacttgtgcaagatcatcgacatgaatgactgcttcgtgtcccggcacgtgaaggtctgcatcatcggcaccgtgagcaagttctcccaaggggacactctgctgttcttcggccccctcgagggcgggggcctgatcttcaagcactggtgcacctccacgtgccagttcggggacccgggcgatatcatgagcccccgcgacaaggggttcctgtgccccgagttccccggcagcttcaggaagaagtgcaatttcgccaccactccgatctgcgagtacgacgggaacatggtgtccggctacaagaaggttatggccaccatcgactcgttccagagcttcaacacctcgaccatgcacttcacggacgagcgcatcgagtggaaggaccgggacggcatgctccgcgaccacatcaacatcctggtgaccaaagacatcgacttcgacaacctgggggagaacccatgcaagatcggcctccaaacgagctccattgagggggcctggggcagcggtgtgggcttcacactgacgtgcctgatctccctcacagagtgccccaccttcctgaccagcatcaaggcctgcgacaaggccatctgctacggcgccgagtccgtcacgctgacccgggggcagaatacagtgaaagtgagcggcaagggcgggcactccgggagctccttcaagtgctgccacggcgaggattgcagccagatcggcctccacgccgccgcgccccacctggacaaggtcaacgggatctccgagatcgagaacagcaaggtgttcgacgacggtgctccgcagtgcgggatcaagtgctggtctgtcaagagcggcgagtggatctccggtattttctccgggaactggatcgtgctgatcgtgctctgcgtattcctcctgttctccctcgtgctgctgagtatcctctgccccgtgcgcaagcacaagaagtcttag

SEQ ID NO: 15015 - RNA, 3408 nt, synthetic construct
  misc_feature 1..3408: note = derived and/or modified CDS sequence (opt11) from HTNV(Z5)__EU074224.1__GP
  source 1..3408: mol_type = other RNA
atgggcatctggaagtggctggtgatggccagcctcgtctggcccgcctgcaccctgagaaacgtgtacgacatgaagatcgagtgcccccacaccgtgtccttcggtgagaacagcgtcatcggctacgtggagctgcctcccatgcccctcgccgataccgcccagctggtacccgagtccagctgcaacatggacaaccatcagtccatgaacaccatcacaaagtacacccaggtcagctggcgctccaaggtggaccaggcccaggcctcgcagaacagtttcgaggccgtgagcgcggaggtcgacctgaaggggacgtgcgtgctcaagcacaagatgctggaggagagttaccgcagccggaagtccatcacatgctacgacttaagctgcaactccacttactgcaagcccaccctctacatgatcgtgcccatacacgcctgcaacatgatgaagggctgcctgatcgccctggggccctaccgcgtccaggtggtgtacgagcggacctactgcatgacgggcgtgctcatcgaggggaagtgcttcgtgccggaccagagcgtggtctccatcatcaagcacgggatcttcgatatcgcctctgtgcacatcgtgtgcttcttcgtcgcggtcaagggcaacacctacaagctgttcgagcaggtcaagaagtcattccagagcacgtgtaacgacaccgagaacaaggtgcaggggtactacatctgcatcgttggcggtaactcagcccccatctgcgtccccaccctggatgacttccgctccatggaagcattcagcggcatcttccggagcccgcacggcgaggaccacgaccttgccggggaggagatcgccagctactccatagtgggcccggcgaacgccaaggtgccccacagcgcctccagcgacaccctttcgctgatcgcctacagcgggatcccctcctacagctccctcagcatcctggccggctccacagaggcgaagcacgtcttcagccccggcttcttcccgcaactgaaccacactaagtgcgacaagaccgccatccccctcacctggaccgggatgatcgacctgcctggctactacgaggccatccacccctgcacggtgttctgcgtgctgtccgggccgggcgccagctgcgaggccttctccgagggcgggatcttcaacatcaccagccccatgtgtctcgtcagcaagcagaaccgcttccggctgaccgagcagcaagtaaacttcgtgtgccagcgcgtcgacatggacataatcgtgtactgcaatggccagcggaaggtgatcctgaccaagacgctcgtcatcgggcagtgcatttataccatcacctccctgttctcccttctccccggcgtagcacactccatagccgtggagctgtgcgtccccgggttccacggctgggccaccgccgccctgctcgtgacgttctgcttcgggtgggtgcttatcccagcgatcacctttgtcatcctgaccatcctcaagtttatcgccaacatctttcacacaagcaaccagggcaaccgactgaagtccgtgctgaagaaaatcaaggaggagttcgagaagacgaagggcagcatggtgtgcgacgtctgcaagtacgagtgcgagacctacaaggagctcaaggcccacggcgtgtcctgcccccagagtcagtgcccgtattgcttcacccactgtgagcccaccgaggccgcgttccaggcccactaccgcgtgtgccaggttacgcacagattccgggacgacctgaagaaaaccgtgaccccgcagaacttcacccccggctgctaccgcaccctcaacctcttccggtacaaatcccgttgctacatcttcacgatgtgggtctgcctgctggtcctcgagtctatcctgtgggccgcctccgccagcgaggtgcccttgaacccgatctggaacgacaacgcgcacggggtgggctccgtccccatgcacaccgacctcgagctggacttcagcctgacctccagctccaagtacacctaccggcgccggctgacgaaccccctcgaggaaacccaggcgatcaacctgcacatcgagatcgaggagcagaccatcggggtggacgtgcacgccctgggccactggttcgacggccgcctcaacctgaagaccagcttccactgctacggggcctgcacgaagtacgagtacccctggcacaccgccaaatgccactatgagcgcgactaccagtacgagaccagctggggctgcaacccggcggattgtcccggggtcggaaccggctgcacggcctgtgggctgtacctcgaccagctgaagccagtgggctccgcctacaagatcatcaccatccggtatagccgcaaggtgtgcgtccagttcggggaggaaaacctgtgtaaggtgatcgacatgaacgactgtttcgtgtcccggcacgtcaaggtctgcatcatcggcaccgtgagcaaattctcccagggggacacactcctgttcttcggccccctggagggcgggggcctcatcttcaagcactggtgcacgagcacgtgtcagttcggggacccgggcgacattatgagcccccgcgacaaggggttcctgtgccccgagttccccggctccttccggaagaagtgcaactttgccaccaccccgctgtgcgagtacgacggcaacatggtctccggatacaaaaaggtgatggccaccatcgatagcttccagtccttcaacaccagcaccatgcacttcaccgacgagcgcatcgagtggaaggaccccgacggcatgctccgggaccacatcaatatcctggttacgaaggacatcgacttcgataatctgggggagaacccctgcaaagtcggcctccagacctccagcatcgagggagcgtggggctccggcgtgggattcaccctgacctgcctggtgagcctcacggagtgccccaccttcttaacctccatcaaggcctgcgacaaggccatctgctacggcgcggagagcgtcaccctgacgcgcgggcagaacaccgtgaaggtgtccggcaagggcgggcacagcggaagcaccttcaagtgctgccacggggaggagtgttcccagatcggcctccacgcggccgccccgcacctggacaaggtcaacgggatcagcgagatagaaaacaacaaggtgtatgacgacggcgcgccccagtgcggcgtcaagtgctggttcgtgaagtccggggagtggatcagcggcatattctccgggaactggatcgttctgatcgtcctctgtgtgttcctgctgttcagcctcgcactgctgtccgtgctctgccccgtccggcgccataagaagtcctga

SEQ ID NO: 15016 - RNA, 3408 nt, synthetic construct
  misc_feature 1..3408: note = derived and/or modified CDS sequence (opt11) from HTNV(ZLS-12)__FJ753399.1__GP
  source 1..3408: mol_type = other RNA
atgggcatctggaagtggctgatcatggccagcctcgtttggcccgcctacaccctgcgcaacgtctacgacatgcggatcgagtgtccgcacaccgtgagcttcggggagaacagcgtgatcggctacgtcgagctgccgcccatgccgctcgccgacacgtcccagatggtgcccgagagctcctgcagcatggacaaccaccagtccctgaacaccatcaccaagtacacccaggtgagctggcgcgggaaggccgaccagtcccaggccagccagaactccttcgaggccgtcagcgccgaggtggacctgaagggcacgtgcgtgctcaagcacaagatgctggaggagtcctaccggagccgcaagtccatcacgtgctacgacctaagctgcaactccacctactgcaagcccaccctctatatgattgtccccatccacgcgtgcaacatgatgaagtcctgcctgatcgccctggggccataccgggtgcaagtggtgtacgagcgcacctactgcatgaccggcatcctcatcgagggcaagtgcttcgtaccggaccagagcgtggtcagcatcatcaagcacggtatcttcgacatcgccagcgtacacatcgtgtgcttcttcgtcgccgtgaagggcaacacctacaagctgttcgaacaggtcaagaagtccttccagagcacgtgcaacgacaccgaggacaaggtgcaggggtactatatctgcatcgcgggcgggaactccgccccaatctacgtgcccactctggacgatttccggagcatggaggccttctccggcatcttcaagagcccccacggcgaggaccacgacctcgccggagaggagatcgcctcctacagcatcgtgggcccggcgaacgccaaggtcccgcactccgccagctccgacaccctgagcctgacagcctactccgggatccccagctactccagcctctccatcctgacgagctccaccgaggccaagcacgtgttcagccccggcttcttccctcagctgaatcacaccaagtgcgacaagaccgcgatccccctcatgtggacgggcatgatcgacctgcccgggtactacgaggccatccacccctgcaccgtcttctgcgtgctgagcggcccgggggcgtcctgcgaggccttcagcgaaggcgggatcttcaacataacctcccccatgtgcctcgtgagcaagcagaaccgcttccggctgaccgagcagcaggtcaacttcgtgtgccagcgcgtggacatggacatcgtcgtgtactgcaacggccagcggaaggttatcctgacgaagaccctcgtcattggccagtgcatctacaccatcacctccctgttcagcctgctccccggggtggcccactccatcgccgtggagctctgcgtccccggctttcacggatgggccacggccgccctgctcgtgaccttctgcttcggatgggtgctgatcccggcgatcaccttcatcatcctgacaatcctcaaattcatcgcgaacatcttccacacgtctaaccaggagaatcgcctgaaatccgtactgcggaagatcaaggaggagttcgagaagaccaaggggagcatggtgtgcgacgtgtgcaagtacgagtgcgagacctacaaggagctcaaggcccacggcgtctcctgtccccagagccagtgcccctactgcttcacccactgcgagcccacggaggccgccttccaggcgcactaccgcgtgtgccaggtgacccaccggttccgcgacgacctgaagaagaccgtcaccccgcagaacttcacccccggctgctaccggacgctgaacctcttccgctacaagtcacggtgctacatcttcaccatgtgggtgttcctgttagtgctcgagagcatcctgtgggctgcctccgccagcgaggtccccctgtccccggtgtggaacgacaacgcccacggggtcggcagcatccccatgcacaccgacctcgagctggacttcagcctgacctccagttccaagtacacgtaccgacggaagctgaccaaccccctcgaggagacccaggcgatcaacctgcacatcgagatcgaggagcagaccatcggggtcgacgtgcacgccctgggccactggttcgatgggcgcctcaacctgaagaccagcttccactgctacggcgcctgcacaaagtacgaatacccctggcacaccgccaagtgccattacgagcgcgactaccagtacgagacctcctggggctgcaaccccgccgactgccccggggtgggcacggggtgcaccgcgtgcggcctgtacctcgaccagctgaagcctgtcggctcagcctacaagatcatcaccatccggtactcccgccgggtgtgcgtgcagctgggggaggagaacctctgcaaaatcatcgacatgaacgactgcttcgtcagccgccacgtgaaggtttgtatcatcggcaccgtctccaagttcagccagggggacacgctgctgttcttcggccccctcgagggcgggggcctgatctttaagcactggtgcacctccacgtgccagttcggggatccgggcgacattatgagcccccgggacaaggggttcctgtgccccgagttccccggctccttccgcaagaagtgcaacttcgccaccaccccgctttgcgagtacgacgggaacatggtgtccggctacaagaaggtgatggctaccatcgactcctttcagagcttcaacacctccacgatgcacttcacggacgagaggatcaagtggaaggaccccgacggcatgctgcgcgaccacatcaacatcctggtcaccaaggacatcgacttcgacaacctcggggagaacccctgcaagatcggcctgcagaccagcgccatcgagggggcgtggggctccggggtgggcttcaccttgacgtgcctcgtgagcctgaccgagtgccccaccttcctgacgagcatcaaggcgtgcgacaaggccatctgctacggcgccgagtccgtcacgctcacccgggggcagaacaccgtcaaggtgagcggcaagggcgggcactccgggagcctgttcaagtgctgccacggggaggagtgctcccagatcggcctgcacgcggccgccccgcacctcgacaaggtcaatgggatcagcgaaatcgagaacaacaaggtgtacgacgacggcgcgccccagtgcggggtgaagtgctggttcgtcaagtccggcgagtggatcagcggcatcttctccgggaactggatagtgctgatcgtgctttgcgtcttcctcctgttctctctggtgctcctgtccgtcctgtgccccgtgcgcaagcataagaagtcctga

SEQ ID NO: 15017 - RNA, 3408 nt, synthetic construct; identical to SEQ ID NO: 11731
  misc_feature 1..3408: note = derived and/or modified CDS sequence (opt11) from HTNV(ZLS6-11)__FJ753397.1__GP
  source 1..3408: mol_type = other RNA

SEQ ID NO: 15018 - RNA, 3408 nt, synthetic construct
  misc_feature 1..3408: note = derived and/or modified CDS sequence (opt11) from HTNV__AB030232.1__GP
  source 1..3408: mol_type = other RNA
atgggcctgtggaagtggctcatcatggccgtgctggtctggccctgcttcgccctgcgcaacgtgtacgacatgaagatcgagtgcccgcacaccgtgaacttcggggagaacagcgtcgtcggctacgtggagctcccgcccatgcccatcgcggacatcacccaaatgatgcccgagtccagctgctccatggacaaccaccagtcgctgaacacgatcaccaagtacacccaggtctcctggcggaagaaggccgacagggcccagagctcccagaccagcttcgaaacggtgtccagcgaggtggactttaaggggacctgcgtcctgaagcataaaatggtggaggactcctaccggagccgcaagtccatcatctgctacgacctcagctgtaactccaccttctgcaagcccaccctgtacctgatcgtgcccgtccacgcctgcaacatgatgaagtcctgcctcatcgctctgggcccctaccgggtgcaggacgtgtacgagcgcacgtactgcatgagcggggtcctgctcgagggcaagtgcttcgtgccggaccggagcgtggtctccatcatcaagcacggcatcttcgacatcgcgagcgtgcacatcgtgtgcttcttcgtcgccatcaaggggagcacctacaagatcctggagcaggtcaagaagtccttcgagctgacctgcaacgacaccgacaacaagatccagggctattacatctgcctcgtcgggggcaacagcgcccccatctacgtgcccacgctggacgacttccgttcaatggaggcgttcgcggggatcttcaagagcccccacggtgaggaccacgacctggccggcgaggaggtggcctcctacagcatcgtggggccggccaacgccaaggtgccccactccgcgagcgccgacaccctctccctggtggccttcagcggcatcccctcctacagctccttcagcgtcctgaccggatccacagacgcccggcacgtgttcagtcccggctttttcccgcagctcaaccagacgcgctgcgacaagaccgccatccccctgacctggaccggcatgatcgacctgcccggctactacgaggcggtgcatccctgcacggtcttctgcgtgctctccggcccgggggccagctgcgaggccttctccgagggcgggatcttcaacatcaccagccccatgtgcctggtgagcgagcagaaccggttccgctccagcgagcagcaggttaacttcgtgtgccagcgggtggacatggacatcgtcgtatactgcaatggccagaagaaggtgatcctgaccaagaccctcgtgatcggccagtgcatctacacgatcacctccctgttcagcctgcttcccggggtggcgcactccatcgccgtggagctgtgcgtccccggcttccacgggtgggcgaccgccgccctgctcgtaaccttctgcttcggctgggtgctgatcccggccgtcacgctggtgatcctcaccatccttaagttcatcgccaacattttccacaccagcaaccaggagaaccgcctgaagtccgtgctcaagaagatcaaagaggagttcgagaagaccaaagggagcatggtctgcgacgtatgcaaatacgagtgcgagacgtataaggagctgaaggcgcacggcgtgtcctgcccccagagccagtgcccctactgcttcacccactgcgagcccaccgaggccgccttccaggcgcattacaaagtctgccaggtgacccaccggttccgcgacgacctgaagaagacggtgaccccgcagaacttcactcccggctgctaccggaccctcaacctgttccgctacaagtcccggtgctacatcttcaccatgtgggtcttcctgctgatcctggagagcatcctgtgggcggcctccgccagcgagacgccctccacgccgatctggaacgacaacgcccacggggtgggcagcatccccatgcataccgacctcgagctcgacttctccctgaccagcagctccaagtacacgtaccgccggaagctgaccaaccccctcgagaagacccaggccgtggacctgcacatcgagttagcggtccagactatcggggtggacgtgcacgctctcggccactggtttgacgggcgcctgaacctgaagacgagctttcactgctacggcgcctgcaccaagtacgagtatccctggcacaccgccaagtgccactacgagcgcgattaccagtacgagacctcctggggctgcaacccggccgattgcccgggcgtcggcacggggtgcaccgcgtgcggcctctacctggaccagttaaagcccgtgggcagcgcctacaagatcatcaccatcaagtactcccggcgcgtctgcgtccagttcggggaggaaaacctatgcaaggtgatcgatatgaacgactgcttcgtgagccggcacgtcaagatctgcatcatcggcaccgtgtccaagttcagccagggggacacgctgctgttcttcggccccctcgagggcgggggcctgatattcaagcactggtgcacctccacgtgccagttcggggacccgggcgacatcatgagcccccgcgacaaagggttcctgtgccccgagttccccggcagcttccggaagaagtgcaacttcgccaccaccccggtgtgcgagtacgacgggaacatggtcagcggctacaagaaggtgatggccaccatagactccttccagagcttcaacacctccatgatgcacttcaccgacgagcgcatcgagtggaaggacccggacggcatgctccgggaccacatcaacatcctggtgacgaaggacatcgacttcgacaacttaggggacaacccctgcaaggtcggcctccagaccagcgccatcgagggggcgtggggctccggagtgggcttcaccctgacctgccaggtgagcctgacggagtgccccaccttcctcacctccatcaaggcctgcgacaaggccatctgctacggcgccgagagcatcaccctgacgcgcgggcagaacacagtcaaggtgagcggcaagggcggacactccggaagcaccttcaagtgctgccacggcgaggagtgctcccagatcggcctgcacgcggccgccccgcacctcgacaaggtcaacgggatcagcgagatggaaaactccaaggtgtacgacgacggcgcccccgagtgcgggatcaagtgctggttcgtcaagagcggcgaatggatctccggcatcttcaacgggaactggatcgtgttaatcgtgctgtgcgccttcctcatcttcagcctggtgctgctctccctgctgtgccccgtccggaagcacaagaaagcctga

SEQ ID NO: 15019 - RNA, 3408 nt, synthetic construct; identical to SEQ ID NO: 11733
  misc_feature 1..3408: note = derived and/or modified CDS sequence (opt11) from HTNV__AB620032.1__GP
  source 1..3408: mol_type = other RNA

SEQ ID NO: 15020 - RNA, 3408 nt, synthetic construct; identical to SEQ ID NO: 11734
  misc_feature 1..3408: note = derived and/or modified CDS sequence (opt11) from HTNV__D25532.1__GP
  source 1..3408: mol_type = other RNA

SEQ ID NO: 15021 - RNA, 3408 nt, synthetic construct; identical to SEQ ID NO: 11735
  misc_feature 1..3408: note = derived and/or modified CDS sequence (opt11) from HTNV__L08753.1__GP
  source 1..3408: mol_type = other RNA

SEQ ID NO: 15022 - RNA, 3408 nt, synthetic construct
  misc_feature 1..3408: note = derived and/or modified CDS sequence (opt11) from HTNV__M14627.1__GP
  source 1..3408: mol_type = other RNA
atggggatctggaaatggctggtgatggccagcctcgtctggcccgtgctaaccctgcgcaacgtgtacgacatgaagatcgaatgcccgcacacggtctccttcggggagaatagcgtgatcggctacgtggagctcccgcccgtacccctggccgacacggcccagatggtgcccgagtccagctgcaacatggacaaccaccagtccctgaacacgatcacgaagtatacccaggtaagctggcgggggaaggcggaccagtctcagagctcccagaacagcttcgagacggtctccaccgaggtggacctcaagggtacctgcgtgctgaagcacaagatggtcgaggagagctaccgctcccgtaagagcgtaacctgctacgacttgtcctgcaacagcacttattgcaagcccaccctttacatgatcgtgcccatacacgcctgcaacatgatgaaaagctgtctgatcgccctggggccgtatcgcgtccaggtggtgtacgagaggtcctactgtatgaccggcgtcctcatcgagggcaagtgtttcgtgccggaccagtccgtggtcagcatcatcaagcacgggatcttcgacatcgccagcgtgcatatcgtgtgcttcttcgtcgctgtgaagggcaacacctacaagatcttcgagcaagtcaaaaagtccttcgagagcacttgcaacgacacggagaacaaagtccaggggtactacatatgcatcgtgggcggaaattccgcacccatctacgtccccaccttagacgacttccgcagcatggaggccttcaccgggatcttccggagcccccacggcgaggaccacgacctggcaggggaggaaatcgcatcctactccatcgtgggtccggccaatgccaaggtgccccacagcgccagtagcgacaccctctccttaatcgcctactcagggatcccctcctacagttccctgagcatcctcacctcatctaccgaggcgaagcacgtgttctcccccggcctgtttccgaagctgaaccacaccaactgcgacaagagcgccatccccctcatctggacgggcatgattgacctgcccgggtactacgaggccgtgcacccctgcaccgtgttctgcgtccttagcggcccgggcgctagttgcgaggccttcagcgaaggcgggatcttcaatatcacatcacccatgtgcctcgtgagcaagcagaaccggttccggctcaccgagcagcaggtcaacttcgtgtgtcagagggtggacatggacatcgtcgtctactgcaacggacaacggaaagtgatactgacgaagaccctcgtgataggccagtgcatctataccatcacctccctgttctctttactccccggggtcgcccactccatcgccgtggagctctgcgtgcccggcttccacgggtgggccacggccgccctgttagtcaccttctgcttcggatgggtgctgatcccggcgatcaccttcatcatcttgacagtcctcaagttcatcgccaatatcttccacacgagtaaccaagagaaccgcctgaagtccgtcttacgcaagatcaaggaggagttcgagaagaccaaggggagcatggtatgcgacgtgtgtaaatacgagtgcgagacctacaaagagctcaaggcccacggcgtgtcctgcccacagagccaatgcccctactgcttcacccactgcgagcccacggaggccgccttccaagcacactacaaagtgtgccaggtgacccatagattccgtgacgacctgaagaaaaccgtcaccccacagaacttcacgcccggctgctaccgcacactgaacctcttccggtacaagtcccgctgctacatcttcaccatgtggatcttcctgttagtgctcgagagcatcctgtgggccgcctccgccagcgagacgccactgaccccggtgtggaacgacaacgcgcacggggtcggctccgtgcccatgcacaccgacctcgagctggacttctccctgacctctagtagcaagtacacctaccggcgcaagctgaccaaccccctcgaggaggcccagtcaatcgacctgcacatcgagattgaggagcagactatcggggtggacgtccacgccctgggccactggttcgacgggcggctcaacctaaagaccagcttccactgctacggcgcctgcacgaaatacgagtacccctggcacaccgccaagtgccactacgagcgcgactaccagtacgaaacgtcctggggctgcaacccgtccgactgccccggggttggcaccgggtgcaccgcgtgcggactgtacctcgatcagcttaagcccgtgggatccgcctacaagatcatcaccatccgctacagccggcgcgtatgcgtgcagttcggggaggagaacctgtgcaagatcatcgacatgaatgactgctttgtgtcccggcacgttaaggtgtgcattatcggcacggtaagcaagttctcccagggggataccctccttttcttcggccccctggagggcgggggcctaatcttcaaacactggtgcacctccacgtgccagttcggggacccgggcgacatcatgagcccccgcgacaaggggttcctgtgccccgagttccccggcagcttccggaaaaagtgcaacttcgccaccaccccgatctgcgagtacgacggtaacatggtctccggctacaagaaggtgatggccactatcgacagcttccagtccttcaatacctcgaccatgcattttacggacgagcgcatcgagtggaaggacccggatggcatgctccgggaccacatcaacatccttgtgaccaaggacatagatttcgacaacctgggggagaacccatgcaagattggcctgcagacctcctcgatcgagggcgcctggggcagcggggtcggcttcacgctgacgtgcctggtatccttgaccgagtgcccgacctttctcacgagcataaaggcgtgcgacaaggcgatctgctacggggccgagtccgtgacattaacccgcggtcaaaataccgttaaggtgagcggcaaaggcggccactccgggagcacgttccggtgctgccacggggaggactgctcccagatcggcctgcacgccgccgcgccgcacctcgacaaggtcaacgggatctcagagatagaaaactccaaggtgtacgacgacggcgcgccccagtgcggtatcaagtgctggttcgtcaagagcggcgagtggatttccggcatcttcagtgggaactggatcgtgctgatcgtgctatgcgtgttcctgctgttctccctggtgctcctgagcatactgtgccccgtgcgcaagcataagaagtcatga

SEQ ID NO: 15023 - RNA, 3408 nt, synthetic construct
  misc_feature 1..3408: note = derived and/or modified CDS sequence (opt11) from HTNV__EU074672.1__GP
  source 1..3408: mol_type = other RNA
atgggcatctggaagtggctggtgatggcgagcctcgtctggcccgccttcgcgctgcgcaacgtgtacgacatgaagatcgagtgcccgcacaccgtgtcgttcggggagaacagcgtcatcggctacgtggagctgccgcccatgcccctcgccgacaccacgcaaatggtgcccgagtccagctgctccatggacaaccaccagagcctgaacaccattactaagtatacccagatcatctggcgggggaaggccgaccagtcccagagctcccagaacagcttcgagacggtctccaccgaggtggacctgaagggtacctgcgtgctcaagcacaagatgatcgaggaaagctaccgctcccgtaagtcaatcacgtgctacgacctgtcctgcaacagcacctactgcaagcccacgctgtacatgatagtccccatccacgcctgcaatatgatgaagtcctgcctcatcgctctggggccctaccgggtccaggtagtgtacgagcggacctactgcatgaccggcgtgctgatagagggcaagtgcttcgtgccggaccagagcgtcgtgtccatcatcaagcatggaatcttcgacatcgcgagcgtgcacatcgtctgcttcttcgtggccgtgaaggggaatacgtacaagatcttcgagcaagtcaagaagtccttcgaaagcaactgcaacgacaccgagaacaaggtgcaggggtactacatctgcatcattggcgggaacagctcccccgtgtacgtccccaccctcgacgacttccgcagcatggaggcgttctccggcatcttccggagcccccacggcgaggaccacgacctggccggggaggaggtggcgtcctacagcatcgttggcccggccaatgccaaggtgccccactccgccagctccgacaccctggggctcatcgcttacagcggcatcccctcctatagctccctgagcatcctgacgtccagcaccgaggcgaagcacgtgttctcgcccggcctctttccgcagctcaaccacaccaagtgcgacaagaccgccatccccctgacgtggaccgggatgatagacctccccggctactacgaggccatccacccctgcaccgtcttctgcgtgctgagcgggccgggcgccagctgcgaggccttctccgagggcggcatcttcaacatcaccagccccatgtgcctggtgtccaagcagaaccgcttccggctcacggagcagcaggtcaacttcgtgtgtcagcgcgtggacgtcgacatcatcgtgtactgcaacggccagcggaaggtgatcctgaccaagaccctggtcatcgggcagtgcatctacaccatcacgagcctcttctccctgctgcccggcgtggcgcacagcatcgccgtggagctctgcgtccccgggttccacggctgggccaccgccgccctgctggtgaccttctgcttcgggtgggtgctcatcccggcgatcacctttatcatcctgacgatcctgaagtttatagccaacatcttccacacctccaaccaggagaaccgcctcaagagcgtcctgcggaagatcaaggaggagttcgagcgcaccaagggctccatggtgtgcgacatttgcaagtacgagtgcgagacctaccgggagctgaaggcccacggcgtaagctgcccgcagtcccagtgcccctattgcttcacccactgcgagcccaccgaggccgccttccaggcgcactacaaggtctgccaggtgacccaccgcttccgggacgacctcaagaaaaccgtaaccccgcagaacttcacgcccgggtgctaccgcaccctcaacctgttccggtacaagagccgctgctacatcttcaccatgtgggtcttcctcctggtgctggagtctatcctctgggccgccagcgcctccgagatccccctgaacccggtgtggaacgacaacgcgcacggcgtcgggtctatcccaatgcacaccgacctggagctcgacttttccctgacgagcagctccaagtacacctaccggcgcaagctgaccaaccccctagaggaaagccaggccatcgacctccacgtggagatcgaggagcagaccatcggcgtggacgtccacgccctggggcactggttcgacggccgcctgaacctcaagacgtccttccactgctacggcgcctgcaccaagtacgagtacccctggcacaccgccaagtgccactacgagcgggactaccagtacgagaccagctgggggtgcaacccgtctgactgccccggcgtggggacgggctgcaccgcgtgcggcctgtacctggaccagctcaaacccgtggggagcgcctacaagatcatcaccatccgctactcccggcgcgtctgcgtgcagttcggcgaggagaacctgtgcaagatcatcgacatgaacgactgcttcgtaagccggcacgtcaaagtgtgcatcatcgggaccgtgtccaagttcagccagggcgacacgctgctgttcttcgggcccctggagggcggcgggctgatcttcaagcactggtgcacctccacgtgccagttcggcgacccgggggacatcatgagcccccgcgacaagggcttcctctgcccggagttccccgggtccttccggaagaagtgcaacttcgccaccaccccggtctgcgagtacgacggcaacatggtcagcggctacaagaaggtgatggccaccatcgactccttccagagcttcaacacctccaccatgcacttcacggacgaaagaatcgagtggaaggaccccgacggcatgctgcgggaccacatcaacatccttgtcaccaaggacatcgacttcgacaacctcggcgagaacccctgcaagatcggcctgcagaccagctccatcgagggcgcctgggggagcggcgtgggcttcaccctgacgtgcctcatcagcctgaccgagtgctccaccttcctgaccagcatcaaggcgtgcgacaaggccatctgctacggggccgagtccgtgacgctcacccgcggccagaacaccgtcaaggttagtgggaagggcgggcattccggcagctccttcaagtgctgccacggcgaggagtgcagccagatcgggctgcacgccgccgctccccacctggacaaggtgaacggcatctccgagatggagaactcaaaggtcttcgacgacggggccccgcagtgcggcatcaagtgctggttcgtgaagtccggcgagtggatcagcgggatcttctccggcaactggatcgtgctcatcgtcctgtgcgtgttcttactcttcagcctggtcctgctctccatcctgtgccctgtgcggaagcacaagaagtcctga

SEQ ID NO: 15024 - RNA, 3408 nt, synthetic construct
  misc_feature 1..3408: note = derived and/or modified CDS sequence (opt11) from HTNV__GQ120966.1__GP
  source 1..3408: mol_type = other RNA
atggagatctggaagtggctggtgatggccagcctcgtctggcccgccttcactctgcgcaacgtgtacgacatgaagatcgagtgcccacacaccgtgtccttcggcgagaacagcgtcatcgggtacgtggagctgccgcccatgcccctcgccgacacggcccagatggtgcccgagtcctcatgcaacatggacaaccaccagtccatgaacaccatcaccaagtacacccaggtcagctggcggggcaaggccgaccaggcccaggcctcccagaacagcttcgaggccgtgtccgccgaggtggacctgaaggggacgtgcgtcctgaagcacaagatgctcgaggagagctaccgctcccgcaagagcataacctgctacgacctgagttgcaacagcacctactgcaagcccaccctgtacatgatcgtgcccatccacgcctgcaacatgatgaagtcctgcctcatcgccctgggcccctaccgggtgcaggttgtgtacgagcggacgtactgcatgaccggggtgctgatcgaaggcaagtgcttcgtcccggaccagagcgtcgtgtccatcatcaagcacggcatcttcgacatcgcgagcgtccacatcgtgtgcttcttcgtggccgtaaaggggaacacctacaaactcttcgaacaggtgaagaagtccttccagagcacgtgcaacggcaccgagaacaaggtgcaggggtactacatctgcatcgtcggcgggaacagcgcccccatctacgtgcccaccctggacgatttccgatccatggaggcgttcagcggcatcttccggagcccccacggcgaggaccacgacctggccggggaggagatcgcgagctactccatcgtcggcccggccaacgcaaaggtgccccacagcgcctccagcgacaccctctccctgatcgcctacagcgggatcccatcctacagctccctgagcatcctcgcgtccagcaccgaggccaagcacgtgttctcccccggcttcttcccgcagctgaaccacacgaagtgcgacaagaccgccatccccctgacctggaccggtatgatcgatctccccgggtactacgaggccatccacccctgcacggtcttctgcgtgctgagcggcccgggagcttcctgtgaggcgttcagcgagggcgggatctttaacatcaccagcccgatgtgcctggtgtccaagcagaaccgcttccggctcaccgagcagcaggtcaacttcgtgtgccagagagtggatatggacatcatcgtctactgcaacggccagcggaaggtgatcctgacaaagacgctggtaataggccagtgtatctacaccatcaccagcctcttctccctgctgcccggggtcgcccacagcatcgccgtggagctctgcgtgcccggcttccacgggtgggccaccgcggcgctgctggtcacgttctgcttcggatgggtgctcatcccggccctgaccctgatcatcctcaccatcctgaagttcatcgccaacatcttccacacctccaatcaggagaatcgcctcaagagcgtgctgcggaagatcaaggaggagttcgagaagacgaaggggtccatggtctgcgacgtgtgcaagtacgagtgcgagacctacaaggagctgaaggcccacggcgtaagctgcccccagtcacagtgcccctactgcttcacccattgcgagcccaccgaagcggccttccaggcccactaccgcgtctgtcaggtgacgcaccggttccgcgacgacttgaagaagaccgtgaccccgcagaacttcacccccggctgctaccggaccctcaacctgttccgctacaagagccggtgctacatcttcacgatgtgggtatgcctgctcgtgctggagtccatcctgtgggccgccagcgcgtccgaggtgcccctcaacccagtctggaacgacaacgcccacggggtgggcagcgtgcccatgcacaccgacctggagctggacttccccctgacctcctcttccaagtacacgtaccgccggcgcctcacgaaccccctggaggagacccagtcgatcaacctgcacatcgagatcgaggagcagaccatcggggtcgacgtgcacgccctcggccactggttcgacgggcgcctgaacctgaagaccagcttccactgctacggcgcctgtacgaagtacgagtacccgtggcacacagccaagtgccactacgagcgggactaccagtacgagacctcctggggctgcaatcccgcggactgccccggggtgggcaccgggtgcacggcctgcggcctctatctggaccagctgaagcccgtcggcagcgcctacaaaatcatcaccatccgctactcccggaaggtgtgcgtgcagttcggggaggagaacctctgcaaggtcatcgacatgaacgactgcttcgtgacccgccacgtgaaggtctgcatcatcggcaccgtgagcaagttctcacagggggacacgctgctgttcttcggcccgctcgaagggggcggcctgatcttcaagcactggtgcacgtccacctgtcagttcggggaccctggcgacatcatgagcccccgggacaaggggttcctgtgccccgagttcccgggctccttccgcaagaagtgcaatttcgccaccacgcccctctgcgagtacgacgggaacatggtgtccggctacaagaaggtcatggccaccatcgacagcttccaatccttcaacaccagcaccatgcacttcacggacgagcggatcgagtggaaggaccccgacggcatgctgcgcgaccacatcaacatccttgtgaccaaggacatcgacttcgacaacctcggggagaacccctgcaagatcggcctgcagacctccagcatcgagggggcgtggggctccggggtgggcttcacgctgacgtgcctcatcagcctgactgagtgcccgaccttcctgacctccatcaaggcttgcgacaaggccatctgctacggagccgagagcgtcacgctcacccgggggcagaacaccgtgaaggtgtccggcaaagggggccacagcgggagcaccttcaagtgctgccacggcgaggagtgctcccagataggcctgcacgcggccgcgccccacctggacaaggtcaacgggatctcggagatcgagaacaacaaggtgtacgacgacggcgctccccagtgcggggtgaagtgctggttcgtcaagtccggcgagtggatctccggtatcttctccgggaactggatcgtgctcatagtcctgtgcgtgttcctcctgttcagcctggtgctgttgtccgtcctgtgccccgtccgcaagcacaaaaagagctga

SEQ ID NO: 15025 - RNA, 3408 nt, synthetic construct
  misc_feature 1..3408: note = derived and/or modified CDS sequence (opt11) from HTNV(CGAa1011)__EF990927.1__GP
  source 1..3408: mol_type = other RNA
atggaaatatggaagtggctcgtcatggccagcctagtctggcccgcactcgctctccggaacgtccacgacatgaaaatcgaatgcccacacacggtttcctttggtaaaaactccgttatcggatacgtcgaactcccacctatgcctctcgcagacacaatccaaatggtccccgaatcctcatgctcaatggacaaccaccagtcgctttccaccgttaccaaatacacacaagtgtcatggcggggcaaagcagaccaagcacagtcaaaccagactagcttcgaaaccgttagcgtagaagtcgaccttaaaggaacctgcgtgctcaaacacaagctcgtcgaagaatcctaccgctcccgcaaaagcctcacgtgctacgacctctcttgcaactcgacctactgcaaacctaccctctacatgatagtcccaattcacgcctgcaatatgatgaagtcctgcatcattgcgctcggaccccacagagtccaagtagtatatgaaaggacctactgcatgaccggagtcctcttagaaggaaaatgcttcgtacctgatcagagcgtagtaggcatagtcaaacacggtatcttcgacattgcgtccgtccacatcgcctgcttcttcgtcgccatcaccggcaacacctacaaactcttcgagcaagttaaaaagagctttggtactacctgcaacgacaccgaaaacaaagtccaaggatactacatttgcatccttggcggaaactctcctcccatctacgttcccacccttgacgacttccgctctatggaggccttttcaggtatcttcaaaagcccacacggcgaggaccacgatctagcaggagaggagatcgcttcatatagcatagtgggccccgccaatgccaaagtcccacattcagcctcctccgacaccctatctctcatcgccttctccggcatcccctcctattcaagcctctccatcctcacctcctcaacagaagccaaacacgtcttctcacccggactcttccctcaactaaaccatacaaaatgcgacaaaaccgccatacccctcacatggaccggcataatcgacctccccggatattatgaggcggtgcacccatgcaccgtgttctgtgtactatccggtccgggcgcaagctgcgaagccttcagcgagggaggcatattcaacatcacctcacccatgtgccttgtatcgaaacaaaaccgtttccgcctaaccgaacaacaagtcaactttgtatgtcagcgagttgacatggacatcgtcgtctactgtaacggacagcgcaaagtcatcctcactaaaacgcttgtgatcggtcaatgcatatacaccatcacttcactcttcagcctcctaccaggcgttgcccattccattgccgtcgaactatgcgtcccaggtttccacggctgggccaccgcagctcttttaatcaccttctgcttcggatgggtcctaatccccgccttaaccttcatcgtactgacagttctcaagttcatagcgaacatcttccacaccagcaaccaagagaaccgactaaaaatggtcctaaagaaaatcaaagaagagttcgagcgtacaaaaggttccatggtttgcgacatctgcaaatatgaatgcgaaacatacaaagaactcaaagctcacggcgtatcatgccctcaatcccagtgcccctattgcttcacgcattgcgaacccaccgaatccgcattccaagcccactaccgcgtatgccaagtcacacaccgattccgagatgacctcaagaaaaccgtaacaccccaaaacttcacccccggctgctaccgaacccttaacctattccgttacaaatcacgatgctacatcttcaccatgtggatttgcttgctggtcctcgagagcatcctctgggccgcctcggcctctgaaatccccctgtcacccacctggaacgataacgcgcacggcgttggcagcatccccatgcacaccgacctcgaactcgacttctcgcttacctctagctctaaatatacctaccgtcgaaaactgaccaaccctctcgaagaatcccaagccgtcaacttccacgtagaaattgaggagcaagccatcggggtagacgtacatgccctcggccactggtttgacggccgcctcaatctaaagacctccttccactgctacggtgcatgcaccaaatacgaatacccttggcacaccgcaaagtgccactacgaaagagattatcaatacgaaacctcctggggctgcaatccatctgattgccctggagtcggcaccggttgcaccgcctgcggactctacctcgaccaactcaaacccgtagggtccgcatacaaaatcattaccattcgatactcacgaagagtctgcgtgcaattcggcgaggaaaacctatgcaaagttatcgatatgaacgactgtttcgtcagccggcacgtcaaagtatgcatcatcggaactgtttccaaatttagtcaaggagacaccctcctattcttcggtccactcgaaggagggggactcatatttaaacactggtgcaccagcacctgtcaattcggcgaccccggcgacatcatgagcccgcgcgacaaaggcttcttatgccccgagttccccgggtcatttcgaaagaaatgcaacttcgccaccacaccagtctgtgaatacgacgggaacatggtcagcggctacaaaaaggtcatggcaacaatcgattccttccaatcctcaaacacctctacaatgcacttcaccgacgaacggatagaatggaaagaccctgacggaatgctccgcgaccatatcaacatcctagtcacgaaggacatagacttcgacaacctcggagaaaacccttgcaaaatcggtctacagacaagctccatcgagggcgcatggggatcaggcgtcggcttcaccctaacctgcctcatctccctcactgagtgcccaaccttcctcacctccattaaggcctgcgacaaggcgatttgctacggtgccgagagtgtcactctcacacgtggccaaaacactgtcaaagtatccggaaaaggaggacacagcggttccaccttcaagtgctgccacggcgaagactgttcacaatccggcctccacgccgcggctccccacctcgacaaagtaaacggtatatccgagattgaaaactccaaagtatacgacgatggagcgccacagtgtggcgtaaaatgttggttcgtcaaatctggtgaatggatctcaggaatcttcagcggaaactggatcgtccttatagtcctttgtgttttcctcctcttctccctcgttctcctctcaatcctatgccccgtcagaaaacacaaaaagtcctaa

SEQ ID NO: 15026 - RNA, 3408 nt, synthetic construct
  misc_feature 1..3408: note = derived and/or modified CDS sequence (opt11) from HTNV(CGAa2)__EU092223.1__GP
  source 1..3408: mol_type = other RNA
atggagatctggaagtggctggtgatggccagcttggtctggcccgccctcgccctgcgcaacgtgcacgacatgaagatcgagtgtccgcacaccgtgtccttcggcaagaacagcgtcatcggctacgtggagctcccacccatgcccctggccgacaccatccagatggtccccgaatcttcttgctccatggacaaccatcaaagcctgtcaacggtcaccaagtacacccaagtgtcttggcggggcaaggccgaccaggcccagccctcccagaccagcttcgagacggtgtccgtcgaggtggacctcaaggggacctgcgtgctgaagcacaagctggtcgaggaaagctaccgctcccggaagtccctgacctgctacgacctctcgtgcaacagcacctactgcaagccaacgctgtacatgatcgtgcccatccatgcctgcaacatgatgaagtcctgcatcatcgccctcggcccgcaccgcgtgcaggtcgtgtacgagcggacctactgtatgaccggggtgttactggagggcaagtgcttcgtgcccgaccagagcgtggtgtccatcgtccgccacggcatcttcgacatcgccagcgtgcacatcgcctgctttttcgtggccatcaccggtaacacgtacaaactcttcgagcaggtcaaaaagagcttcggcacgacctgcaacgacaccgagaacaaggttcaggggtactatatctgcatcctgggcgggaactccccgcccatctacgtcccgaccctggacgacttccggagcatggaggcgttcagcggcatcttcaagagcccccacggcgaagaccacgacctcgccggggaggagatcgcctcctacagcattgtgggccccgcgaacgccaaggtgccccactccgcgagctccgacaccctgagcctgatcgccttctccgggatcccaagctacagcagcctctccatcctgaccagctcgaccgaggccaagcacgtcttcagccccggcctgttcccccagctcaaccatacgaagtgcgacaagaccgccattccccttacctggaccggcatcatcgacctgccggggtactacgaagccgtgcacccctgtacggttttctgcgtcctgtccggccccggggctagctgcgaggccttcagcgagggcgggatcttcaacataacctcccccatgtgcctggtgagcaagcagaaccgcttccggctgacagaacaacaggtgaacttcgtctgtcagcgggtggacatggacatcgtggtctactgcaacggccagcggaaggtgatcctcactaagacgctggtgatcggccagtgcatctacaccatcacctccctgttctcgctcctgccgggagtcgcccactctatcgccgtggagctgtgcgttcccggcttccacggctgggccaccgcggccctcctgatcacgttctgcttcggctgggtcctgatccccgccctcaccttcatcgtgctcaccgtgctgaagttcatcgccaacatctttcacacaagcaaccaagagaaccgcctcaagatggtcctgaagaagatcaaggaggagttcgagcggacgaaggggtccatggtgtgcgacatctgcaagtacgagtgcgagacctacaaggagctgaaggcccacggcgtgagctgcccgcagtcccagtgcccgtattgcttcacacactgtgagcccaccgagtcagcgttccaggcgcactaccgcgtctgccaggtaacccaccggttccgcgacgatctcaagaagacggtgacgccccagaacttcaccccgggctgctaccggaccctgaacctgttccgctacaagtcccggtgctacatcttcaccatgtggatctgcttactggttctggagagcatcctgtgggccgcttccgcgagcgagatccccctcagccctacctggaacgacaacgcccacggtgtcggcagcatccccatgcacacggacctggagctggacttctccctcaccagcagctccaagtacacgtaccgccggaagttgaccaacccgctggaggaaagccaggcagtgaactttcacgtcgaaatcgaggagcaggccatcggcgtggacgtacatgccctcggccactggtccgacggacgcctgaacctgaagaccagcttccactgctacggcgcgtgcaccaagtacgagtacccctggcacacggccaagtgccactacgagcgcgactaccagtacgagacctcctggggctgcaaccccagcgactgccccggggtcggcaccggatgcaccgcctgcggcctctacctggaccagctgaagccggtgggctccgcctacaagatcatcacgatacggtacagtcgccgtgtgtgcgttcagttcggggaggagaacctctgcaaggtgatcgacatgaacgactgcttcgtgtcccgccacgtcaaggtctgcatcatcggcaccgtctcgaagttctcccagggggacacgttgctgttcttcggccccctcgaagggggcggcctgatcttcaagcactggtgcaccagcacgtgccagttcggggaccccggtgacatcatgagcccccgggacaaggggtttctgtgcccggagttccccggcagcttccgcaagaagtgcaacttcgccaccacccccgtctgcgaatacgacgggaacatggtgtccggctacaagaaggtgatggcgaccatcgacagcttccagagtagcaacacgtccaccatgcactttaccgacgagcggatcgaatggaaggaccccgacggcatgctccgcgaccatatcaacatcctggtcaccaaggacatcgacttcgacaacctgggggagaatccatgcaagatcggcctccagaccagctcaatcgaaggggcctggggctctggggtgggcttcaccctgacctgcctgatcagcctcaccgagtgccccacgttcctgacctctatcaaggcctgcgacaaggccatctgctacggtgcagagtctgtgaccctgacccgggggcaaaacacggtcaaggtatccggcaagggagggcacagcgggtccaccttcaagtgttgtcacggcgaggactgcagccagtccggcttacacgcggccgcgccccacctcgataaggtgaacgggatcagcgagatagagaactccaaggtctacgacgacggcgcgccccagtgcggggtgaagtgctggttcgtcaagagcggagagtggatctccggcatcttcagcgggaactggatcgtgctgatcgtcctctgcgtcttcctgctgttctcactcgtgctgctgagcatcctctgcccggtgcgcaagcacaagaagtcctga

SEQ ID NO: 15027 - RNA, 3408 nt, synthetic construct
  misc_feature 1..3408: note = derived and/or modified CDS sequence (opt11) from HTNV(CGAa31MP7)__EF990925.1__GP
  source 1..3408: mol_type = other RNA
atgggcatatggaagtggctggtgatggccagcctcgtctggcccgccttcgccctgcgaaacgtgtacgacatgaaaatcgagtgtccgcacactgtgtcgttcggggaaaattcagtcatcggctatgttgagctgccgcccatgcccctcgccgacaccacgcagatggtacccgagtcctcgtgctcgatggacaaccaccagagcctgaacaccatcaccaagtacacccagatcatctggcgggggaaggccgaccagtcccagagctcccagaacagcttcgagacggtctccacgggcgttgacctgaaggggacatgcgtgctcaagcacaagatgatcgaggagagctaccgctcccgcaagagcatcacgtgctatgacctgtcctgcaacagcacctattgcaagcccaccctgtacatgatcgtccccatccacgcctgcaacatgatgaagagttgcctcatcgcccttggcccctatcgcgtccaggtggtgtacgagcggacctactgcatgactggcgtgttgatcgaggggaagtgcttcgtgccggaccagagcgtcgtgtccatcatcaagcacggcatcttcgacattgcgagtgtgcacatcgtatgcttcttcgtggccgtgaaggggaacacgtacaaaatcttcgagcaagtcaagaaatccttcgagagcaactgcaacgacaccgagaacaaggtgcagggatactacatctgcatcatcgggggcaacagctcccccgtctacgtccccacccttgacgacttccgcagcatggaggccttttcaggcatcttccgaagcccccacggggaggaccatgacctggccggcgaggaggtggcgtcctacagcatcgtcgggccggccaacgccaaggtgccccactccgccagctccgacaccttgggcctcatcgcctacagcggcatcccctcatacagcagtctgagcatcctgacgtccagcaccgaggccaagcacgtgttctcccccggcctgttcccgcagctgaaccacacgaagtgcgacaagaccgccatccccctgacatggaccggcatgatcgacctccccgggtactacgaggcaattcacccctgcaccgtcttctgcgtactgagcggcccgggcgccagctgcgaggcgttctccgagggtggcatctttaacatcaccagccccatgtgtctggtttccaagcagaatcgcttccggctcacggagcaacaggtcaacttcgtgtgccagcgcgtggacgtcgacatcatcgtgtactgcaacgggcagcggaaagtcattttgaccaagaccctggtcatcggccagtgcatctacaccatcacgagcctcttctccctgcttcccggggtggcgcatagcatcgccgtggagttgtgcgtccccggcttccacgggtgggccaccgccgccctgctggtgaccttctgcttcggctgggttctcatcccggcgatcaccttcatcatcctgacgatcctgaagttcatcgctaatatcttccacaccagcaatcaggagaaccgcctcaagagcgtattgcggaagatcaaggaagagttcgagcgcaccaagggcagtatggtgtgtgacatatgcaagtacgagtgcgagacctacaaggagctgaaggcccacggagtgagctgcccccagtcccagtgcccctactgcttcacgcactgcgagcccacggaggccgccttccaagcgcactaccgggtctgccaggtaacccaccgcttccgagacgacctcaagaagaccgtgaccccgcagaacttcacgcccggctgctaccgcaccctgaacctgttccggtacaagagtcgctgctacatattcaccatgtggatctgcctcctggtcctggagtccatcctctgggccgccagcgcctccgagatccccctcaacccggtgtggaacgacaatgcgcacggggtgggcagcatccccatgcacaccgacctggagctcgacttctcgctgacgagcagcagtaagcacacctaccggcgcaagctgaccaaccccctggaggaaagccaggcgatcgacctacacgtcgagatcgaggagcagacgatcggggtggacgtgcacgccctgggccactggttcgacggcaggctgaacctcaagacgtccttccactgctacggggcctgcaccaagtatgaatacccatggcacaccgccaagtgccactacgagcgggactaccagtacgagacctcctggggctgcaacccgtccgactgccccggggtcggcacgggctgcaccgcgtgcgggctgtacctggatcagctcaagcccgtgggcagcgcctacaagatcatcaccatacgctactcccggcgcgtgtgcgtccagttcggggaggagaacctgtgcaaggtgatcgatatgaacgactgcttcgtgagcaggcacgtcaaggtgtgcatcatcggcaccgtgtccaagttcagccaaggggacacactcctctttttcggcccactggagggcgggggcctgatcttcaagcactggtgcacctccacgtgccagttcggggacccgggcgacatcatgagcccccgcgataaggggttcctctgccccgagttccccggctccttccgaaagaagtgcaacttcgccacgacgccggtctgcggctacgacgggaacatggtaagcggctacaagaaggtgatggccaccatcgactccttccagagcttcaacacctccaccatgcacttcacggacgagcgcatcgagtggaaggacccagacgggatgctgcgggaccacatcaacatcctggtcaccaaggacatcgacttcgacaacctcggcgagaatccctgcaagatcgggctgcagaccagctccatcgagggcgcatggggcagcggcgtgggcttcaccttgacgtgcctcatcagcctgaccgagtgtcccaccttcctgacatccatcaaggcgtgcgacaaggccatctgctatggggccgagagcgtgacgctcacccgcggccagaacacggtcaaggtgtccgggaagggcggacacagcgggtccactttcaagtgctgccacggcgaggactgcagccagtccgggctccacgccgccgcgccgcacctggacaaagtgaacggcatcagcgaaatcgagaactccaaagtatacgacgacggcgcgccccagtgcggaatcaaatgctggtttgtcaaatccggcgagtggatctccgggatcttcagcggcaactggatcgtgctcatcgtgctgtgcgtgttccttctgttctccctggtcctgctcagcatcctgtgccccgtccggaagcacaagaagtcatga

SEQ ID NO: 15028 - RNA, 3408 nt, synthetic construct
  misc_feature 1..3408: note = derived and/or modified CDS sequence (opt11) from HTNV(CGAa4MP9)__EF990929.1__GP
  source 1..3408: mol_type = other RNA
atggagatctggaagtggctggtgatggccagcctcgtctggcccgcccttgcccttcgcaacgtatacgacatgaagatcgagtgcccccacaccgtgtccttcggcgagaactcggtcctcgggtacgtggagctgcccccgatgcccctggccgacaccatccagatggtgccggagtccagctgctccatggataaccaccagagcatgtccacggccaccaagtatacccaggttagctggcggggcaaggccgatcaggcccagtccagccaaacctccttcgagacggtcagcgtggaagtcgacctcaaggggacctgcgtgttgaagcacaagatggtggagaagtcctaccgcagccggaagtcccttacctgctacgacctcagctgcaactccacctactgcaagcccacgctgtacatgatcgtccccatccacgcctgcaacatgatgaagtcctgcatcatcgccctggggccctatcgcgtccaggtggtctacgagcggacctactgcatgaccggggtgctcctggagggcaagtgcttcgtgccggaccagtccgtcgtgtcaatcgtgaagcatagcatcttcgacatcgcctccgtccatatcgcctgcttcttcgttgcgatcacaggcaacacgtacaagctgatcgaacaggtgaagaccagcttcgggacaacctgcaacgacacggaggacaaggtccagggctactacatctgcatcctcgggggcaactccccacctatctacgtgcccaccctggacgacttccgcagcatggaggccttttccgggatcttccggagcccgcacggcgaggatcacgacctggccggcgaggagatcgcctcctacagcatcgtcgggcccgccaacgcgaagataccccactccgcctcgtccgacaccctcagcctgatcgccttctccggcatccccagctattcctccctgtccatcctcaccagctccacggaggccaagcacgtgttcagcccggggctgttcccacagctgaaccacaccaagtgcgacaagaccgccatccccctcacctggacgggcatcatcgacctgcccggctattacgaggcggtgcatccttgcaccgtcttctgcgtgctaagcggacccggcgcctcctgcgaggccttcagcgaaggcggcatcttcaacatcacctcccccatgtgcctcgtgagcaagcagaaccgcttccggctgaccgagcagcaggtaaactttgtgtgccagcgcgtggacatggacatcgtcgtgtactgcaacgggcagcggaaagtgatcctgacgaagaccctcgtcatcggccagtgcatctacaccatcacctccctgttcagcctgctccccggcgtcgctcactccatcgccgtggagctctgcgtgccggggttccacggctgggcgacggccgccctgctcgttacattctgcttcgggtgggtcctgatccctgccatcaccttcgtcgtgctgaccgttctcaagttcatcgctaacatctttcacacgagcaaccaggagaaccgcctcaagatggtcctaaagaagatcaaggaggagttcgagaagaccaagggctccatggtgtgcgacatctgcaagtacgagtgcgagacctacaaggagcttaaggcgcacggggtgagctgcccccagtctcagtgcccctattgcttcacccattgcgagccgaccgagagcgccttccaggcgcactaccgggtctgccaggtgacacaccgtttccgcgaggacctaaagaagaccgtaacgccccagaacttcacccctggctgctaccgcaccctgaacctcttccggtacaagtcccgctgctacatcttcaccatgtggatcttcctgctggtcctcgagagcatcctgtgggccgcgtccgccagcgagacccctctgtcccccacctggaacgacaacgcccacggcgtgggctctatccccatgcatacggacctggagctcgactttagcctgacctccagctctaagtacacctaccggcgcaagctgaccaacccgctcgaggaggcccaggccgtgagcttccacgtcgagatcgaggagcagacgatcggcgtggacgtgcacgcgctggggcactggttcgatggccgactgaacctcaagacctccttccactgctacggggcctgcaccaagtacgagtacccgtggcacaccgcaaagtgccactacgagagagattaccagtacgagacgagctggggctgcaacccctccgactgccccggcgtagggaccggctgcaccgcctgtgggctgtacctggaccagctcaagccggtgggcagcgcctacaagatcatcactatccggtactcccggcgcgtgtgcgtacaattcggcgaggaaaacctgtgcaaggtgatcgacatggacgactgcttcgttagcaggcacgtcaaggtgtgcatcatcggtacggtgtccaagttctcccagggtgacaccttgctctttttcgggccgctggagggcgggggcctgatatacaagcactggtgcacgtccacgtgccagttcggagaccccggggacatcatgagccccagagataagggcctcctgtgccccgaatttcctgggtccttccggaagaagtgcaacttcgcgaccacccccgtctgtgagtacgacggcaacatggtaagcgggtacaagaaggttatggccaccatcgattccttccagagcatcaatactagcacgatgcacttcaccgacgagcgcatcgagtggaaggaccctgacggcatgctgcgggaccacatcaacatcctcgtcaccaaggacatcgacttcgacaacctgggcgagaacccctgcaagatcgggctgcagaccagcagcatcgaaggcgcctgggggtccggcgttgggtttacgctgacctgcctcatcagcctgaccgagtgcccgaccttcctcacgtccatcaaggcctgcgacaaggccatctgctacggcgcggagagcgtgacactgacgcgcggacagaacaccgtcaaggtgtccgggaaaggcgggcacagcggctccacattcaagtgctgccacggggaggactgcagccagtccggcctgcacgccgccgccccgcacctggacaaggtcaacggcatcagcgagatggagaactccaaggtgtacgacgacggggcgccccagtgcggaatcaagtgctggtttgtcaagagcggggagtggatctccggcatcttcagcggcaactggatcgtgctgatcgtgctgtgcgtgttcctcctgttctccctggtcctcctcagcatactgtgccccgtgagaaagcacaagaagtcctga

SEQ ID NO: 15029 - RNA, 3408 nt, synthetic construct
  misc_feature 1..3408: note = derived and/or modified CDS sequence (opt11) from HTNV(CGAa4P15)__EF990928.1__GP
  source 1..3408: mol_type = other RNA
atggaaatctggaaatggctggttatggcctcgctagtatggcccgcactcgcactccgcaacgtttacgacatgaaaatagagtgcccgcataccgtgtccttcggcgaaaactccgtactaggatacgtcgagttgccccctatgcccctcgcggacacgatacagatggtcccggaaagctcctgcagtatggacaatcaccaaagcatgtcgaccgcaaccaaatacacccaagtgtcctggcgcggcaaggccgaccaagcacagagctcgcaaacctcgttcgaaaccgtctcggtagaagtcgacctcaaaggtacctgcgttctcaagcacaagatggtcgaaaaatcataccgctcgcgcaaaagcctgacgtgctacgatttaagctgcaactcaacctactgtaaacccactttgtacatgatcgtacccatccacgcatgcaacatgatgaagtcctgcataatcgcactaggcccctacagagttcaggtagtctacgaaagaacgtactgcatgaccggagtactgctcgaaggcaaatgtttcgtgccagaccagtcagtcgtctccatcgtcaagcactccatattcgacatagcatcggtacacatcgcttgcttctttgtcgcgatcaccgggaacacctacaaactcttcgagcaagtaaaaaccagcttcgggacaacctgcaacgacactgaagacaaagtccaaggctactacatatgcatactcggaggaaactcgccacccatatacgttcccacgctagacgactttcgctccatggaggccttctccggcatctttcgctcaccccacggagaggaccacgacctggcgggagaggagatcgcttcctattcaatcgtcggacccgcaaacgcgaaaataccccactccgcatcttccgacaccctctcgctcatagccttttccggcataccttcttattcatccctctcgatactcacatccagcacagaagcaaaacatgtcttcagcccgggtctcttcccacaactaaaccacaccaaatgcgacaaaaccgccatccccctaacctggaccggcatcatagacctccccgggtactacgaagcggttcatccttgtacagtgttctgcgtactaagcggacccggcgcctcatgcgaagccttcagcgagggcggcatcttcaacataacctcccccatgtgcctggtctcaaaacaaaaccgtttccgactaaccgaacaacaagtcaactttgtttgccagcgagtagacatggacatcgtcgtctactgtaacggacaaagaaaggtcatactaacgaaaaccctcgtaatcgggcaatgcatctacacaatcacctcactcttctcacttctgcctggtgtcgcgcactccatcgcagtcgaactttgcgtccccggcttccatgggtgggcaacagctgccctcttagtcaccttctgtttcggctgggtcctaatccccgccatcaccttcgtcgtcctaacagtacttaagttcatcgccaacatcttccacactagcaaccaagagaaccgcctgaagatggttctcaaaaagatcaaggaggagttcgagaaaaccaaaggatcgatggtctgcgacatatgtaaatacgaatgcgaaacttacaaggaactcaaagcccacggagtaagctgcccacaatcccaatgcccatactgtttcactcactgcgaacccaccgaatcggcctttcaagcacactaccgcgtatgccaagtgacgcaccgcttcagggaagacctcaagaaaaccgttacaccccagaacttcaccccgggctgctatcgcaccctgaacctattccgatacaaaagcagatgctacatttttacgatgtggatattcctcctcgtactagaatccatactctgggcagccagcgcaagcgaaacacccctaagccccacatggaacgacaacgcccacggagtcgggtccatccccatgcacaccgacctagaactagacttctcacttaccagcagctctaaatacacttacagacgtaagctcactaacccgcttgaagaggcacaagcagtatccttccacgtggagatcgaggaacagacaataggcgtcgacgtccacgcactaggccactggttcgacggacgcctcaacctaaagacctcattccactgttacggtgcctgcacaaaatatgaatacccctggcacacggcgaaatgccactacgaacgcgattatcaatacgaaacgtcgtggggctgcaatccctctgactgcccaggagtcggaaccggctgcaccgcctgcggcctttacctcgaccaattaaagccagttggatccgcgtataaaataatcacgattagatactcccgccgggtctgcgtccaattcggtgaagaaaatctctgcaaagtcatagacatggacgactgcttcgtatcacgccacgtcaaagtgtgtatcatcggcacagtctcgaaattcagccaaggagacacactcctcttcttcgggcccctagaaggcggcggcctaatcttcaaacattggtgcaccagcacatgccaattcggcgaccccggcgacatcatgtccccacgcgataaagggttcctatgccccgagttccccggtagcttccgcaagaaatgtaactttgcaaccacccccgtttgcgaatacgacggcaacatggtctccggctataagaaagttatggcaaccatcgattcatttcaatcgataaacacaagcactatgcacttcactgacgagaggattgaatggaaagaccccgatggaatgctccgagaccacataaacatcctcgtaacaaaagatatcgatttcgacaaccttggcgaaaacccctgcaaaataggcttacagacatcctcgattgaaggcgcgtggggatccggggtcggtttcaccctgacgtgcctcatctccctaacagagtgcccaacgttcctaacctctatcaaggcatgcgataaagcgatctgctacggtgccgaatcggtcaccctcacacgcggacaaaacacggtcaaagtatcaggcaaaggcggacacagcggatctacgtttaaatgctgccacggagaagactgctcacagtcgggcctccatgccgccgcgccccacctcgacaaagtcaacgggatctccgaaatggaaaactcaaaagtatacgacgatggagccccacaatgtggcatcaaatgctggttcgtcaaaagcggcgaatggataagcggcatattctcaggaaactggatcgtgttaattgtcttatgcgtcttcctcctcttcagtttggtcctcctaagcatactatgccccgtccgaaaacacaagaaatcctag

SEQ ID NO: 15030 - RNA, 3408 nt, synthetic construct
  misc_feature 1..3408: note = derived and/or modified CDS sequence (opt11) from HTNV(CGAa75)__EU092224.1__GP
  source 1..3408: mol_type = other RNA
atggagatctggaagtggctggtgatggccagcctcgtctggcccgccctagccctgcgaaacgtgcacgacatgaagatcgagtgcccgcacaccgtgtccttcggcaagaacagcgtcatcgggtacgtggagctcccgcccatgcccctggccgacaccatacagatggtgcccgagtccagctgctcaatggacaaccaccagtctctgtccacggtcaccaagcacacccaggtgagctggcggggcaaggccgatcaggcccagtccagccagacctccttcgagacggtgagcgtcgaggtggacctcaaggggacttgcgttctgaagcacaagctggtcgaggagtcctaccgcagccggaagtccctgacctgctacgacctgagctgcaactccacctactgcaagcccacgctgtacatgatcgtccccatccacgcctgcaacatgatgaaaagctgcatcatcgcgctcggcccccaccgcgtgcaggtcgtgtacgagcggacctactgcatgaccggggtgctgctggagggcaagtgcttcgtcccggaccagtccgtggtgagcatcgtccgccacggtatcttcgacattgccagcgtgcacatcgcctgcttcttcgtggccatcaccgggaacacgtacaagctgttcgagcaggtcaagaagtccttcggcacgacctgcaacgacaccgagaacaaggtgcaggggtactacatctgcatcctcggcgggaacagcccgcccatctacgttcccaccctggacgacttcagatccatggaggcgttcagcggcatcttcaagagtccccacggcgaggaccacgacctcgcaggggaggagatcgcctcgtactccatcgtgggccccgccaacgccaaggtgccccacagcgcgtctagcgacaccctgtccctgatcgccttcagcgggatcccctcctacagctccctcagcatcctgacctccagcaccgaagccaagcacgtcttctccccgggcctgttcccccagctcaatcacacgaagtgcgacaagaccgccatccccctgacctggaccggtataatcgacctgcccgggtactacgaggccgtgcacccgtgcacggtgttctgcgtcctcagcggccccggggcgagctgcgaagccttctccgaaggcgggatcttcaacatcaccagccccatgtgcctggtctccaagcagaaccgcttccggctgaccgagcaacaggtgaacttcgtctgccagcgcgtggacatggacatcgtggtctactgtaacggccagcggaaggtgatcctcaccaagacgctggtgatcggccagtgcatctacaccatcaccagcctgttctccctcctgcccggagtcgcccacagcatcgccgtggagctctgcgtgccgggcttccatgggtgggccaccgcggccctcctgatcacgttctgcttcggctgggtcctgatccccgccctcaccttcatcgtgttaaccgtgctgaagttcatcgccaacatcttccacacctccaaccaagagaaccgcctcaagatggtcctgaagaagatcaaggaggagttcgagcggacgaaggggagcatggtgtgcgacatctgcaagtacgagtgcgagaccaacaaggagctgaaggcccacggcgtgtcctgcccccagagccagtgcccctactgcttcacccactgcgagccgaccgagtccgcgagtcaggcccactaccgcgtctgccaggtgacccatcggttccgcgacgacctcaagaagacggtgacgccccagaacttcacccccggctgctaccggacccttaacctgttccgctacaagtccaggtgctacatcttcaccatgtggatatgcctcctggtcctggagagcatcctgtgggccgcctccgcgagcgagatcccgctctcccccacctggaacgacaacgcccacggggtgggcagcatccccatgcacaccgacctggagctggacttcagcctcacctccagctccaagtatacgtatcgccggaagctgactaaccccctggaggagagccaggccgtgaacttccacgtcgagatcgaggagcaggccatcggggttgacgtgcacgccctcggccactggttcgacgggcgcctgaacctgaagacctccttccactgctacggcgcctgcaccaagtacgagtacccgtggcacacggccaagtgccactacgagcgcgactaccagtacgagaccagctggggctgcaacccctccgactgccccggggtcggcaccgggtgcaccgcctgcggcctctacctggaccagctgaagcccgtgggcagcgcctacaagattatcactatccggtactcccgccgggtgtgcgtccagttcggggaggagaacctctgcatcgtgatcgatatgaacgactgcttcgtgtcacgccacgtcaaggtgtgcatcatcggcaccgtgtccaagttcagccagggggacaccctgctgttcttcggcccgctggaagggggcggcctgatcctgaagcactggtgcacctccacttgccagttcggggatccaggcgacatcatgagcccccgggacaaggggttcctctgccccgagttcccgggctcctttcgcaagaagtgcaacttcgccaccacccccgtctgcgagtatgggggcaacatggtgagcggctacaagaaggtgatggcgaccatcgactccttccagagcttcaacacgtccaccatgcacttcaccgacgagcggatcgagtggaaggaccccgacgggatgctgcgcgaccacatcaacatcctggtcaccaaggacatcgacttcgacaaccttggcgagaacccctgcaagatcgggctgcagacgtcgagcattgagggcgcctgggggtccggcgtgggcttcaccctgacctgcctcatcagcctgaccgagtgcccgacgttcctgacttccatcaaggcctgcgataaggccatctgctacggggccgagagcgtgaccctcacccggggccaaaacacggtcaaggtgtccgggaagggcgggcactccggctccaccttcaagtgctgccacggcgaggactgcagccagtccgggctgcacgcggccgcgccccacctggacaaggtgaacggcatcagcgagatcgagaactccaaggtctacgacgacggggctccccagtgcggcataaagtgctggttcgtgaagtccggcgagtggatctccgggatcttcagcggcaactggatcgtcctcatcgtgctgtgcgtgttcctcctcttcagcctggtcctgctcagcatcctgtgccccgtgcgcaagcataaggagtcctga

SEQ ID NO: 15031 - RNA, 3408 nt, synthetic construct
  misc_feature 1..3408: note = derived and/or modified CDS sequence (opt11) from HTNV(CGHu2)__EU363819.1__GP
  source 1..3408: mol_type = other RNA
atgggcatctggaagtggctggtgatggccagcctcgtctggcccgccttcgccctgcgcaacgtgtacgacatgaagatcgagtgcccgcacacagtgtccttcggggagaacagcgtcatcggctacgtggagctgccgcccatgcccctggccgacaccacgcagatggtgcccgagtccagctgctccatggacaaccaccagagcctgaacactatcaccaagtacacccagatcatctggcgggggaaggccgaccagagtcagagctcccagaacagcttcgaaacggtctccaccggcgtggacctgaaggggacctgcgtgctcaagcacaagatgatagaggagagctaccgctcccgcaagagcatcacgtgctacgacctgtcctgcaacagcacctactgcaagcccaccctgtacatgatcgtccccatccacgcctgcaacatgatgaagtcctgcctcatcgccctgggcccctaccgggtccaggtggtgtacgagcggacctactgcatgaccggcgtgctgatcgaggggaagtgcttcgtgccggaccagagcgtggtgtccatcatcaagcacggcatcttcgacatcgcgagcgtgcacatcgtctgcttctacgtggccgtgaaggggaacacgtacaagatcttcgagcaggtcaagaagtccttcgagagcaactgcaacgacaccgagaacaaggtgcagggctactacatctgcatcatcgggggcaacagctccccagtgtacgtccccaccctcgacgacttccgcagcatggaggccttctccggcatcatccggagcccccacggggaggatcacgacctggccggcgaggaggtggcgtcctactcaatagtcgggcccgccaacgccaaggtgccccactccgccagctccgacaccctgggtctcatcgcctacagcggcatcccctcctacagctccctgagcatcctgacgtccagtaccgaggcgaagcacgtgttctccccaggactgttcccgcagctgaaccacaccaagtgcgacaagaccgccatccccctgacgtggaccggcatgatcgacctcccagggtactacgaggccatccacccctgcaccgtcatctgcgtactgagcggcccgggggccagctgcgaggccctgtccgagggcggcatcttcaacatcaccagccccatgtgcctcgtgtccaagcagaaccgtttcaggctgacggagcagcaggtcaacttcgtgtgccaacgcgtggacgtcgacatcatcgtgtactgcaacggccagcggaaggtgatcctgaccaagaccctcgtcatcggccaatgcatctacaccatcacgagcctgttctccctcctccccggggtggcgcacagcatcgcggtggagctgtgtgtccccggcttccacgggtgggccactgccgccctgctcgtgaccttctgcttcggctgggtgctgatcccggcgatcaccttcatcatcctgaccatcctcaagttcatcgccaacatattccacacctccaaccaggagaaccgcctcaagagcgtcctgcggaagatcaaggaggagttcgaacgcaccaagggatccatggtgtgcgacatctgcaagtacgaatgcgagacctacaaggagctcaaggcccacggggtgagctgcccccagtcccagtgcccctactgcttcacgcactgcgagcccaccgaggccgcattccaggcgcactatcgggtctgccaggtgacccaccgcttccgggacgacctgaagaagaccgtgacccctcagaacttcacgcccgggtgctaccgcaccctgaacctcttccggtacaaaagccgctgctacatcttcaccatgtggatctgcctgctggtcctcgagtccattctgtgggccgccagcgcctccgagatccccctgaacccggtgtggaacgacaacgcgcacggggttggcagcatccccatgcacaccgacctcgagctggacttctccctgaccagcagctccaagcacacctaccggagaaagctcaccaaccccctcgaggagagccaggccatcgacctgcacgtcgagatcgaggagcagaccatcggggtggacgtgcacgccctgggccactggttcgacggccgtttaaacctgaagacgtcctttcactgctacggggcctgcaccaagtacgagtacccctggcacaccgccaagtgccactacgagcgggactaccagtacgagaccagctgggggtgcaacccgtccgactgccccggggtcggcacgggctgcaccgcgtgcgggctgtacctcgaccagctgaagcccgtcggcagcgcctacaagatcatcaccatccgctactcccggcgcgtgtgcgtccagttcggggaggagaacctttgcaaggtgatcgacatgaacgactgcttcgtgagccggcacgtaaaggtgtgcatcataggcaccgtgtccaagttcagccagggggacacgctcctgttcttcggccccctagagggcgggggcctcatcttcaagcactggtgcacctccacgtgccagttcggggacccgggcgacatcatgagccccagggacaaggggttcctgtgccccgagttccccggatccttccggaagaagtgcaacttcgccaccaccccggtctgcggctacgacgggaacatggtgagcggttacaagaaggtgatggccaccatcgactccttccagagcttcaacacctccaccatgcacttcacggacgagcgcatcgagtggaaggaccccgacgggatgctgcgggaccacatcaacatcctcgtcaccaaggacatcgacttcgacaacctgggcgagaatccgtgcaagatcgggctgcagacgagctccatcgagggcgcctggggcagcggggtgggcttcaccctcacgtgcctgatcagcctgaccgagtgccccacgttcctcacatccatcaaggcgtgcgacaaggccatctgctacggggccgagagcgtgacgctgacccgcggacagaacaccgttaaggtgtccgggaagggaggccacagcgggtccaccttcaaatgctgccacggcgaggactgcagccagtccgggctgcacgccgccgcgccgcacctcgacaaggtgaatggcatcagcgagatagagaactccaaggtctacgacgacggcgctccccagtgcggcatcaaatgctggttcgtcaagagcggcgagtggatctctgggatcttctcgggcaactggatcgtgctgatcgtgctgtgcgtgttcctcctgttctccctggtcctcctaagcatcctgtgcccagtgcggaagcacaagaagtcctga

SEQ ID NO: 15032 - RNA, 3408 nt, synthetic construct
  misc_feature 1..3408: note = derived and/or modified CDS sequence (opt11) from HTNV(CGHu3)__EU363818.1__GP
  source 1..3408: mol_type = other RNA
atggagatctggaagtggctggtgatggccagcctcgtgtggcccgccctggcgctacgcaacgtgcacgacatgaagatcgagtgcccccacaccgtgtccttcggcaagaacagcgtcatcgggtacgtggagctgcccccgatgcccctggccgacaccatccagatggtgccggaatccagctgctccatggacaaccaccaaagcctgtccactgccaccaagtacacccaggtcagctggcggggcaaggccgatcaggcccagtccagccagacctccttcgagacggtgagcgtggaggtcgacctcaaggggacctgcgtgctgaagcacaagctggtggaggagtcctaccgcagccggaagtctctcacatgctacgacctgagctgcaactccacctactgcaagcccacgctgtacatgatcgtccccatccacgcgtgcaacatgatgaagtcctgcatcatcgccctcggcccccaccgcgtccaggtggtgtacgagcggacctactgcatgaccggagtgctgctggagggcaagtgcttcgtgccggaccagtccgtcgtgagcatcgtgcgccacggcatcttcgacatcgccagcgtccacatcgcctgcttcttcgtggcgatcaccgggaatacgtacaagctgttcgagcaggtaaagaagtccttcggcacgacctgcaacgacaccgagaacaaggtccaggggtactacatctgcattctgggcgggaacagcccgcccatctacgtgcccaccctggacgacttccgatccatggaggccttcagcggcatcttcaagagcccccacggcgaggaccacgacctcgcgggggaggagatcgcctcctactccatcgtcggccctgccaacgcgaaggttccccacagcgcctccagcgacaccttgtccctgatcgccttcagcgggatccccagttacagctccctctctatcctgacctccagcacagaggccaagcacgtgttctccccgggccttttcccccagctcaaccacacgaagtgcgacaagaccgccatccccctgacctggaccggcatcatcgacctgcccgggtactacgaggcggtccacccgtgcacggtgttctgcgtgctcagcggccccggggccagctgcgaggccttctccgagggcgggatcttcaacatcactagccccatgtgcctggtctccaagcagaaccgcttccggctgaccgagcaacaggtgaacttcgtgtgccagcgcgtggacatggacatcgtggtctactgcaacggccagcggaaggtcatcctcaccaagacgctggtgatcggccagtgcatttacaccctgaccagcctcttctccctgctgcccggggtggcgcacagcatcgccgtcgagctctgcgtgccgggcttccacgggtgggcaaccgccgccctgctgatcacgttttgcttcggctgggtgctcatccccgccttaaccttcatcgtactgaccgtgctcaagttcatcgccaacatcttccacacctctaaccaggaaaaccgccttaagatggtgctgaagaagatcaaggaggagttcgagcggacgaaggggagcatggtctgcgacatctgcaagtatgagtgcgagacctacaaggagctcaaggcgcacggcgtgtcctgcccccagagccagtgcccttactgcttcacccactgcgagccgaccgagtcagccttccaggcccactaccgcgtgtgccaggtcacccaccggttccgcgacgacctgaagaagacggtgacaccccagaacttcacccccggctgctaccggaccctgaacctcttcaggtacaagagccggtgctacatcttcaccatgtggatctgcctgctggtgctggagtccatcctttgggcggcgagcgcctccgagatcccgctttcacccacctggaacgacaacgcccacggggtcggctccatccctatgcacaccgacctggagctcgacttcagcctcactagctccagcaagtacacgtatcgccggaagctgaccaaccccttggaggagtcccaggccgtgaacttccatgtggagatcgaggagcaggccatcggggtcgacgtgcacgcgctgggccactggttcgacgggcgtctgaaccttaagaccagcttccactgctacggcgcctgcaccaagtacgagtacccgtggcatacggccaagtgccactacgagcgcgactaccagtacgagacctcctggggctgcaacccgagcgactgccccggggtgggcaccgggtgcaccgcctgcggcctgtacctggaccagctcaagcccgtcggctccgcctacaagatcatcacgatccggtacagccgccgggtatgcgtgcagttcggggaggagaacctgtgcaaggtcatcgacatgaacgactgcttcgtgtcccgccacgtgaaggtctgcatcatcggcaccgtgagcaagttctcccagggggacactctcctcttcttcggaccgctggaagggggcggcctgatcttcaagcactggtgcaccagcacgtgccagttcggggaccccggcgacatcatgagcccccgggacaaggggttcctctgccccgagttcccgggctccttccgcaagaagtgcaacttcgcgaccacccccgtgtgcgagtacgacgggaacatggtctccggctacaagaaggtgatggccaccatcgacagcttccagtccttcaacaccagcaccatgcacttcaccgacgagcggatcgagtggaaggaccccgacggcatgctgcgcgaccacatcaacatcctggtaaccaaggacatcgacttcgacaacctcggggagaacccctgcaaggtcgggctgcggacgtccagcatcgagggggcctggggcagcggtgtgggcttcaccctgacctgcctcatctccctgaccgagtgcccgacgttcctgaccagcatcaaggcctgcgacaaggccatatgctacggtgcggagtccgtgacccttacccgcgggcagaacacggtcaaggtgagcggcaaagggggccactccgggagcaccttcaaatgctgccacggcgaggactgctcccagagcggccttcacgccgccgccccgcacctggacaaggtgaacgggatctccgagattgagaatagcaaggtgtacgacgacggcgcgccccagtgcgggataaagtgctggttcgtgaagtccggcgagtggatctccggcatcttctccgggaactggatcgtcctcatcgtgctgtgcgtgttcctcctcttcagcctggtcttactcagtatcctgtgccccgtgcggaagcacaaaaagagctga

SEQ ID NO: 15033 - RNA, 3408 nt, synthetic construct; identical to SEQ ID NO: 11747
  misc_feature 1..3408: note = derived and/or modified CDS sequence (opt11) from HTNV(CGHu3612)__EF990923.1__GP
  source 1..3408: mol_type = other RNA

SEQ ID NO: 15034 - RNA, 3408 nt, synthetic construct
  misc_feature 1..3408: note = derived and/or modified CDS sequence (opt11) from HTNV(CGHu3614)__EF990922.1__GP
  source 1..3408: mol_type = other RNA
atgggcatctggaagtggctggtgatggccagcctcgtctggcccgccttcgccctgcgcaacctgtacgacatgaagatcgagtgcccgcacaccgtgtccttcggggaaaacagcgtgaccggctacgtcgaactcccgcccatgccactggccgatacgacccagatggtgccggagtccagctgctccatggacaaccaccagagcctgaacaccatcaccaagtacacgcagatcatctggcgggggaaggccgaccagtcccagagctcccagaacagcttcgagaccgtgtccaccgaggtcgatctcaaggggacgtgcgtgctgaagcacaagatgatcgaggagagctaccgctcccgcaagagcatcacgtgctacgacctgtcctgcaacagcacctactgcaagcccaccctctacatgatcgtgccaatccacgcctgcaacatgatgaagtcctgcctgatcgccctggggccctaccgcgtccaggtggtgtacgagcggacctactgcatgacgggagttctcatcgagggcaagtgcttcgtgccggaccagagcgtcgtctccatcatcaagcacgggatcttcgacatcgcgagcgtgcacatcgtgtgtttcttcgtggccgtgaagggcaacacctacaagatcttcgagcaggtcaagaagaccttcgaaagcaactgcaacgacaccgagaacaaggtccaggggtactacatctgcatcatcggcggaaactccagccctgtgtatgtgcccacgctggacgacttccgctccatggaggcattcagcggcatcttccggagcccccacggcgaggaccacgacctggccggggaggaggtcgcgtcctactccatcgtgggcccggccaacgctaaggtcccccacagcgcctccagcgacaccctcgggctgatcgcctactccagcatcccctcctacagctccctgagcatcctcacatccagcaccgaggcgaagcacgtcttctcccccggcttgttcccgcagctgaaccatacgaagtgcgacaagaccgccatccccctcacctggaccggcatgatcgacctgcccgggtactacgaggccatccacccctgcacggtcttctgcgtgctgagcggcccgggcgccagctgcgaggccttctccgagggcgggatcttcaacatcgcgagccccatgtgcctcgtgtccaagcagaacagattccggctgaccgagcagcaggtcaacttcgtgtgccagcgcgtggacgtggacatcatcgtctactgcaacggccagcggaaggtgatcctgaccaagaccctcgtgatcggccagtgcatctacacgatcacaagcctgttctccctgctccccggcgtcgcccacagcatcgcagtggagctctgcgtgcctggcttccacgggtgggccactgccgcgctgctcgtcaccttctgcttcggctgggtgctgatccccgccatcacgttcatcatcctgaccatcctcaagttcatcgccaacatcttccacacctccaaccaggagaaccgcctcaagagcgtgctgcggaagatcaaggaggagttcgagcgcaccaaggggtccatggtctgcgacatctgcaagtacgagtgtgagacgtacaaggagctcaaggcccacggcgtgagctgcccccagtcccagtgcccctactgcttcacccactgcgagcccacggaggccgcgttccaggcccactacaaggtatgccaggtcacccaccggttccgcgacgacctgaagaagaccgtgacgccgcagaacttcaccccgggctgctaccggaccctgaacctcttccgctacaagagccggtgctacatcttcaccatgtgggtgttcctgctagtcctcgagtccatcctgtgggccgccagcgcatccgagatccccctgaacccggtgtggaacgacaacgcccacggggtggggagcatccccatgcacacggacctcgagctggatttctccctgaccagcagctccaagtacacctaccgtcggaagctgaccaaccccctcgaggagagccaggccatcgacctgcacgtcgagatcgaggagcagacgatcggggtggacgtgcacgccctgggccactggttcgacgggcgcctcaatctgaagacctccttccactgctacggcgcctgcacaaaatacgagtacccctggcacaccgctaagtgtcactacgagcgcgactaccaatacgagacgagctggggctgcaacccgtctgactgccccggcgtcggcaccgggtgcaccgcctgcggcctgtacctcgaccagctgaagcccgtgggcagcgcctacaagatcatcaccatccggtactcccgccgggtgtgcgtgcagtttggggaggagaacctgtgcaagatcatcgacatgaacgactgcttcgtgagccgccacgtgaaggtctgcatcatcggcacggtgtccaagttcagccagggggacacccttcttttcttcggccccctggagggcgggggcctcatcttcaagcactggtgcaccagcacgtgccagttcggggacccgggcgatatcatgagcccccgggacaaggggttcctgtgccccgagttccccggctcgttccgcaagaagtgcaacttcgccaccaccccggtatgcgagtacgacgggaacatggtcagcggctacaagaaggtgatggccaccatcgactccttccagagcttcaacacctccacgatgcacttcaccgacgagcggatcgagtggaaggaccccgacggcatgctgcgcgaccacatcaacatcctcgtgaccaaggacatcgacttcgacaacctgggtgagaacccctgcaagatcggcctgcagaccagctccatcgagggggcgtggggcagcggggtcggcttcacgctgacctgcctgatcagcctgacagaatgctccaccttcctcacgagcatcaaggcctgcgacaaggccatctgctacggcgccgagagcgtgacactaacccgggggcagaataccgtgaaggtcagcggcaagggcgggcactccgggagctccttcaagtgctgccacggcgaggagtgcagccagatcggcctgcacgccgcagcgccccacttggacaaggtgaacgggatctccgagatggagaacagcaaggttttcgacgacggcgccccgcagtgcgggatcaagtgctggttcgtgaagtccggcgaatggatcagcggcatcttctccgggaactggatcgtgctgatcgtgctgtgcgtcttcctcctgttcagcctggtgctcctatccatcttatgccccgtccgcaagcacaagaagtcctga

SEQ ID NO: 15035 - RNA, 3408 nt, synthetic construct; identical to SEQ ID NO: 11749
  misc_feature 1..3408: note = derived and/or modified CDS sequence (opt11) from HTNV(CGRn15)__EU363814.1__GP
  source 1..3408: mol_type = other RNA

SEQ ID NO: 15036 - RNA, 3408 nt, synthetic construct; identical to SEQ ID NO: 11750
  misc_feature 1..3408: note = derived and/or modified CDS sequence (opt11) from HTNV(CGRn2616)__EU363816.1__GP
  source 1..3408: mol_type = other RNA

SEQ ID NO: 15037 - RNA, 3408 nt, synthetic construct; identical to SEQ ID NO: 11751
  misc_feature 1..3408: note = derived and/or modified CDS sequence (opt11) from HTNV(CGRn2618)__EU363817.1__GP
  source 1..3408: mol_type = other RNA

SEQ ID NO: 15038 - RNA, 3408 nt, synthetic construct
  misc_feature 1..3408: note = derived and/or modified CDS sequence (opt11) from HTNV(CGRn45)__EU092225.1__GP
  source 1..3408: mol_type = other RNA
atggagatttggaagtggttggtgatggccagcctcgtctggcccgccctcgcactgcgcaacgtgcacgacatgaagatagagtgcccccacacagtgagcttcggcaagaacagcgtcatcgggtacgttgagctcccgcccatgcccctggccgacaccatccagatggtgcccgagtccagctgctccatggacaaccaccagtcgctgtccacggtcaccaagtacacccaggtgagctggcggggcaaggccgaccaggcccagtcctcccagacctccttcgaggccgtgagcgtcgaggtggacctcaaggggacctgcgtactgaagcacaagctggtcgaggagtcctaccgcagccggaagtccctgacctgctacgacctcagctgcaattccacctactgcaaacccaccctgtacatgatcgttcccatccacgcgtgcaatatgatgaagtcctgcatcatcgccctcggcccccaccgcgtgcaggtcgtgtatgagcggacgtactgcatgacgggggtgctgctggagggcaagtgcttcgtcccggaccaatccgtggtgagcatagtacgccacggcatttttgacatcgccagcgtgcacatcgcctgcttcttcgtggctattaccgggaacacctacaagttattcgagcaggtcaagaagtcctttggcacgacctgcaacgacaccgagaacaaggtgcaggggtactacatatgcatcctaggcgggaacagcccgcccatctacgtccccaccctggacgacttccggtcgatggaggccttcagcggcatattcaagtcaccccacggcgaggaccacgacctcgccggagaagagatcgcctcctactccatagtgggtcccgctaacgcgaaggtgccccacagcgcctctagcgacacgctgtccctgatcgccttcagcgggatcccctcctacagctccctcagcatcctgacctccagcaccgaggccaagcacgtcttctccccgggcctcttcccccagctcaaccacaccaaatgcgacaagacggccatccccctgacctggaccggcattatcgacctgccggggtactacgaggctgtgcatccgtgcaccgtgttctgcgtcttaagcggccctggggcctcctgcgaggccttctccgagggcgggatcttcaacatcacgagccccatgtgcctggtgtccaagcagaaccgcttccggctgaccgagcagcaggtcaacttcgtgtgtcagcgcgtggacatggatatcgtagtctactgcaatggccagcggaaggtgatcctcaccaagaccctagtgatcggccagtgcatatatacgataaccagcctcttctccctcctgcccggggtcgcccacagcatcgccgtggaactgtgcgtgccgggcttccacgggtgggcgactgccgccctcctgatcaccttctgctttggctgggtcctcatccccgccctcacgttcatcgtgctgaccgtgctgaaattcatcgccaacatcttccacaccagcaaccaggagaatcgcctcaagatggtcctgaagaagatcaaggaggagttcgagcggacaaaggggtccatggtgtgcgacatctgcaagtacgagtgcgagacgtacaaggagctgaaagcgcacggcgtgtcctgcccccagagccaatgtccctactgcttcactcactgcgagccgacggagtcggccttccaggcccactaccgcgtctgccaggtgacccaccggttccgcgacgacctcaagaagaccgtgacgccacagaacttcacgccgggctgctaccggacccttaacctgttccgctataagagccggtgctacatcttcaccatgtggatctgcctcctggtcctggagtccatcctctgggccgcgagcgcctccgagataccgctcagccccacgtggaacgacaacgcccacggggttggctccatccccatgcacaccgacctggagctggacttcagcctcacctcatctagcaagtacacctaccgccggaagctgacgaaccccctggaagaatcccaggccgtcaacttccacgtcgagatcgaggagcaggcgatcggggtggacgtgcacgcgctcggccactggttcgacgggcgcctgaacctgaagaccagcttccactgttacggcgcctgcaccaagtacgagtacccgtggcacacagccaagtgccactacgagcgcgaccaccagtacgagacctcatggggctgcaaccccagtgactgccccggcgttggcaccgggtgcaccgcctgcggactctacttggaccagctgaagcccgtgggcagtgcctacaagatcataaccatccggtacagccgccgggtgtgcgtccagttcggcgaggaaaacctctgcaaggtgatcgatcgtaacgactgctttgtgtcccggcacgtcaaagtttgcataatcggcacggtgagcaagttctcccaaggcgacaccctgctgttcttcggcccgcttgagggcggtggcttgatcttcaagcactggtgcacctccacgtgtcagttcggggacccgggcgacatcatgagccccagagataaggggttcctatgccctgagttcccgggcagcttccggaagaagtgcaacttcgccaccacccccgtctgcgagtacgacgggaacatggtgtccggctacaagaaggttatggccactatcgacagctttcagtcctttaacaccagcacgatgcacttcaccgacgagcgcatcgagtggaaggaccccgacggcatgctccgggaccacatcaacatcctggtcacgaaggacatcgatttcgacaacctgggggagaacccctgcaagatcggcctccagacctccagcatcgagggggcctggggcagcggggttggcttcacgctgacctgcctgatctccctcaccgagtgtccgactttcctgactagcatcaaggcctgcgacaaggccatctgctacggcgcggagtccgtgaccctgacccgcgggcagaacacagtcaaggtgagcggcaagggcgggcactccgggtcgacgttcaagtgctgccacggcgaggactgctcccagagcggactccatgccgccgccccgcacctggataaggtgaacgggatctccgagatcgaaaacagcaaggtctatgacgacggcgcgccccagtgcgggatcaagtgctggttcgttaagtccggcgagtggatctctggcatcttctccgggaactggatcgtcctgatcgtattgtgcgtgttcctgctgttcagcctcgttctgctgtccatcctctgcccggtgcggaagcacaagaagtcctga

SEQ ID NO: 15039 - RNA, 3408 nt, synthetic construct; identical to SEQ ID NO: 11753
  misc_feature 1..3408: note = derived and/or modified CDS sequence (opt11) from HTNV(CGRn53)__EF990921.1__GP
  source 1..3408: mol_type = other RNA

SEQ ID NO: 15040 - RNA, 3408 nt, synthetic construct; identical to SEQ ID NO: 11754
  misc_feature 1..3408: note = derived and/or modified CDS sequence (opt11) from HTNV(CGRn93MP8)__EF990919.1__GP
  source 1..3408: mol_type = other RNA

SEQ ID NO: 15041 - RNA, 3408 nt, synthetic construct
  misc_feature 1..3408: note = derived and/or modified CDS sequence (opt11) from HTNV(CGRn93P8)__EF990918.1__GP
  source 1..3408: mol_type = other RNA
atgggcatctggaagtggctggtgatggccagcctcgtctggcccgcctacaccctgagaaacgtgtacgatatgaagatcgagtgcccgcacaccgtcagcttcggggagaacagcgtcatcggctacgtggaactgccgcccattcccctcgccgacacgacccagatggtgcccgagagtagctgctccatggataaccaccagagcctgaacaccatcaccaagtacacacaggtctcctggcgggggaaggccgaccaggcccaggccagccagaactccttcgaagccgtgagcgcggaggtggacctgaaggggacctgcgtcctcaagcacaagatgctggaggagtcctaccgcagccgaaagtccatcgcctgctacgacctgagctgcaactccacctactgcaagcccaccctctacatgatcgtgcccatccacgcctgcaacatgatgaagtcctgcctgatcgccctggggccccaccgcgtgcaggtcgtgtacgagcggacgtactgcatgaccggtgtgctaatcgagggcaagtgcttcgtcccggaccgcagcgtggtgagcatcatcaagcacgggatcttcgacatcgcgtccgtccacatcgtgtgcttcttcgttgccgtcaagggcaacaactacaagatcttcgagcagatcaagaagtccttcgagagcacgtgcaacgacaccaagaacaaggtgcaagggtactacatctgcatcgtgggcgggaacagcgcccccatctacgtccccaccctggacgacttccggagcatggaggccttctccggcatcttccgcagcccccacggcgaggaccacgacctggcaggggaggagatcgcgtcctacagcatcgtgggcccggccaacgccaaggtcccccacagcgccagctccgacacgctcagcctgaccgcctactccgggatccccagctactccagcctgtccatcctcgcgggcagcgccgaggccaagcatgtgttctcccccggcttctttccgcagctgaaccacaccaagtgcgacaagacggccatccccctgatgtggaccgggatgatcgacctccccggctactacgaggccatccacccctgcaccgtgttctgcgtcctgagcgggccgggcgcgtcctgtgaggccttcagcgagggaggcattttcaacatcactagccccatgtgcctggtgtccaagcagaaccggttccgcctcacggagcagcaggtcaacttcgtgtgccagcgggtggacatggacatcatcgtgtactgcaacggccagcgcaaggtcatcctgaccaagaccctggtgatcgggcagtgcatctacaccatcacgagcctcttcagcctgctgcccggtgtggcccacagcatcgccgtcgagctctgcgtgcccgggttccacggctgggccaccgcggccctgctggtgaccttctgtttcgggtgggtcctcatcccggccatgacctttatcgtgctgacgatcttaaagttcatcgccaacatcttccacacctccaaccaggagaacaagctcaagagcgtgctgcggaagatcaaggaggagttcgagaaaaccaagggctccatggtctgcgacgtgtgcaagtacgagtgcgagacctacaaggagctgaaggcgcacggcgtgagctgcccccagtcccagtgcccctactgcttcacgcactgcgagcccaccgaggccgcctttcaggcccactaccgtgtctgccaggttacccaccggttcagggacgacctcaagaagacggtgacgccgcagaacttcacccccgtctgctaccggaccctgaacctgttccgctacaagagccggtgctacatcttcaccatgtgggtgttcctcctagtgctggagtccatcctctgggccgcgagcgcctccgagatccccctgaacccggtctggaacgacaacgcccacggggtgggcagcgtgcccatgcacaccgacctggagctcgacttctccctgacgagctccagcaagtacacctaccgccggaagctgaccaaccccctggaggagagccaggccatcaacctccacattgagatcgaggagcagaccatcggggtcgacgtgcacgccctgggccactggttcgacgggcgcctgaacctcaagacgtccttccactgctacggcgcgtgcaccaaatacgagtacccctggcacaccgccaagtgccactacgagcgcgactaccagtacgagacgagctggggctgcaacccctccgactgccccggggtgggcacgggctgcaccatctgcggcctgtacctggaccagctcaaacccgtcggcagcgcctacaagatcatcaccatccggtactcccgccgggtgtgcgtgcagttcggggaagagaacctgtgcaaggtcatcgacatgaacgactgcttcgtgagccgccacgtgaaggtctgcatcatcggcaccgtgtccaagttcagccagggggacacgctgctgttcttcggccccctggagggcgggggcctgatcttcaagcactggtgcacctccacgtgccagttcggggatccgggcgacatcatgagcccccgggacaaggggttcctctgccccgagttccccggctccttccgcaagaaatgcaacttcgccaccaccccggtgtgcgagtacgacgggaacatggtcagcggctacaaaaaggtgatggccaccatcgactcatttcagagcttcaacacctccaccatgcacttcacggacgagcggatcgagtggaaggatcccgacggcatgcttcgcgaccacatcaacattctggtgaccaaggacatcgacttcgacaacctcggggagaacccctgcaaaatcggcctgcagaccagctccatcgagggagcgtgggggtctggggtcggcttcaccctgacgtgcctcatctccctgaccgagtgccccaccttcctgaccagcattaaggcctgcgacaaggccatctgctacggcgccgagagcgtgacgctgacccgggggcagaacaccgtgaaggtctccggcaagggcgggcacagcgggtccaccttcaagtgctgccacggcgaggactgcagccagtccggcctgcacgcggccgccccgcacctggacaaggtgaacgggatcagcgagatcgagaactccaaggtgtacgacgacggggcgccccagtgcgggataaagtgctggttcgtcaagagcggcgagtggatctccggcatcttctccgggaactggatcgtgctcatcgtcctgtgtgtgttcctcctcttctccctggtgctgctcagcatcctgtgccccgtcagaaagcacaagaagtcctga

SEQ ID NO: 15042 - RNA, 3408 nt, synthetic construct
  misc_feature 1..3408: note = derived and/or modified CDS sequence (opt11) from HTNV(CGRni1)__EU363815.1__GP
  source 1..3408: mol_type = other RNA
atgggcatctggaagtggctggtgatggccagcctcgtatggcccgccttcgccctgcgcaacctgtacgacatgaagatcgagtgcccacacaccgtgtccttcggggagaacagcgtgaccggctacgttgagctcccgcccatgccccttgccgacacgacccagatggtgcccgagtccagctgttccatggacaaccatcagagcctgaacaccatcactaagtacacgcaaatcatctggagagggaaggccgaccagtcccagagctcccagaacagcttcgagaccgtatccaccgaggtcgacctcaagggtacctgcgtgctgaagcacaaaatgatcgaggagagctaccgctcccgcaagagcataacgtgctacgacctgtcctgcaactctacctactgcaaacccaccctctacatgatcgtgcccatccacgcgtgcaacatgatgaagtcctgcctgatcgccctcggaccctaccgcgtccaagtggtgtacgagcggacctactgcatgacgggcgtcctcatcgagggcaagtgcttcgtgccggaccagagcgtggtgtccataatcaagcacgggatcttcgacattgccagcgtgcacatcgtgtgtttctacgtcgccgttaagggtaatacctataagatcttcgagcaggtcaagaaaaccttcgagagcaactgcaatgacaccgagaacaaggtccaggggtactacatctgcatcatcggcgggaactccagtcccgtgtacgtaccgacgctggacgacttccggagcatggaggcattcagcggcatcatccggagcccccacggcgaggaccacgaccttgcgggggaggaggttgcgtcatacagtattgttgggccggccaacgccaaggtcccccactcagcctccagtgacaccctcgggctgatcgcctacagttcgatcccaagttatagctccctgagcatcctcacatccagcaccgaggccaagcacgtgttctcccccgggctgttcccgcagctaaaccatacgaaatgcgacaagaccgccatccccctcacctggaccggcatgatcgacctgcccgggtactacgaggccatccacccctgtaccgtgttctgcgtgctgagcggcccgggcgccagttgcgaggcattctccgagggcgggatcttcaacatcgcgagccccatgtgcctcgtcagtaagcaaaaccggttccggctgaccgagcagcaggtcaacttcgtgtgccagcgagtggatgtggacatcatcgtctactgcaacggccaacggaaggtgatcctgaccaagaccctggtgattggccagtgcatctacacgatcaccagcctgttctccctgctccccggagtcgcccacagcatcgccgtggagctgtgcgtgcccggcttccacgggtgggccacggccgccctgctcgtcaccttctgcttcggatgggtgctgatcccggctatcaccttcatcatcctgactatcctcaagttcatcgccaacatcttccacacctccaaccaggagaatcgcctcaagagcgtgctgagaaagataaaggaggagttcgagcgcaccatgggctccatggtctgcgacatatgcaagtacgagtgcgagacgtacaaggagctcaaggcccatggagttagttgcccacagtcccaatgtccctactgcttcacccactgtgagcccaccgaggctgcgttccaggcccactacaaggtgtgccaggtcacccaccgcttccgcgacgacctgaagaagaccgtgactcggcagaacttcacccccggctgctaccgcacactgaacctcttccggtacaagagccgctgctacatcttcaccatgtgggtattcctgatcgtcctggagtcgatcctctgggccgcctctgcgtccgagatcccacttaaccccgtgtggaacgacaacgcccatggtgtgggcagcatcccaatgcacacggacctggagctcgacttttcgctgactagcagctccaagtacacgtaccggcgcaagctgaccaacccactggaggagagccaggccatcgacctccatgtcgagatagaggagcagacgatcggggtggacgtccacgcactaggccactggttcgatgggcgtttaaacctcaagacctccttccactgctacggcgcctgcaccaagtacgagtacccctggcacaccgctaaatgccactatgagcgggactaccagtacgagacaagctggggctgcaacccctccgactgtccaggggtcggtaccgggtgcaccgcctgcggtctgtacctagaccagctcaagcccgtcggcagtgcctacaaaatcatcaccatccgctactcccggcgtgtgtgcgtccagttcggggaggagaacctgtgcaagatcatcgacatgaacgactgcttcgtgagccggcacgtgaaggtctgtatcatcgggactgtgtccaagttcagccagggggacaccctcttgttctttggtcccctggagggcgggggcctgatcttcaagcactggtgcaccagcacgtgccagttcggggacccaggcgatatcatgtcaccgcgggacaagggattcctctgccccgagttccccggctccttccggaagaagtgcaactttgccaccacccccgtatgcgagtacgacgggaacatggtgagcggctacaagaaagtcatggccaccatcgactccttccagagcttcaacacctccacgatgcacttcaccgacgagcgcatagagtggaaagacccggacggcatgctgcgggaccatattaacatcctggtcacaaaggacatcgacttcgacaacctcggggagaatccctgcaagatcggactgcagaccagctctatcgaaggtgcttggggcagcggggtcgggtttacactgacctgcctcatcagcctgaccgagtgctcaaccttcctgacatcgatcaaggcctgtgataaggccatctgctacggcgctgagtcggtgaccctcactcgcgggcagaacaccgtgaaggtcagcggcaagggcgggcactccggaagcagcttcaagtgctgccacggcgaggaatgtagccagatcggcctgcacgccgcggcgccgcacctggataaggtgaacgggatctccgagatggagaacagcaaagtgttcgacgacggcgcgccccagtgcgggatcaagtgctggttcgtcaagtccggggagtggatcagcgggatcttctccgggaactggattgtgctcattgtactgtgcgtcttcctcctgttcagcttagtgctgctctccatcttatgcccggtccggaagcataagaagtcctga

SEQ ID NO: 15043 - RNA, 3408 nt, synthetic construct
  misc_feature 1..3408: note = derived and/or modified CDS sequence (opt11) from HTNV(Aa10-434)__KU207160.1__GP
  source 1..3408: mol_type = other RNA
atgggcatctggaagtggctggtgatggccagcctagtctggcccgtgctgaccctgagaaatgtgtacgacatgaagatcgagtgcccgcacaccgtctccttcgggggcaacagcgtgatcgggtacgtggagctcccgcccatgcccttagccgacaccgcgcagctggtccccgagtccagctgttcaatggacaaccaccagtctctcaacaccatcaccaagtacacccaggtgtcctggcggggcaaagccgaccagagccagtccagccagatttccttcgaaacggtgagcactgaggtagacctgaaggggacctgcgtgctgaaacacaagatggtcgaggagtcctaccgcagccggaagtcaataacctgctacgacctcagctgcaacagtacgtactgcaagcccacactctacatgatcgtccccatccacgcttgtaacatgatgaaaagctgcctgatcgcactcggcccctaccgcgttcaggtggtctacgagagaacctactgcatgaccggcgtgctgatcgagggcaagtgcttcgtgcctgaccagtccgtcgttagcatcatcaagcatggcatcttcgatatcgccagcgtgcacatcgtctgcttcttcgtggcggtgaagggtaacacgtacaagatcttcgagcaggtcaagaagtccttcgagagcacatgcaacgacaccgagaacaaggtacagggctactacatctgcatcgtcgggggcaattccgcccccatctacgtgcccaccctggacgacttccgcagcatggaggccttcacgggcatcttccggagcccccacggggaggaccatgacctcgccggcgaggagaccgcgacctactccattgtggggccggcaaacgccaaggtcccccactccgctagctccgacaccctgagcctgatcgcgttctccgggattcccagctactccagcctctccatcctgactagctccaccgaggcgaagcacgtgttcagcccaggcctgttcccgaaactcaaccacaccaactgtgacaagggcgccatccccctgatgtggaccggcatgatcgacctgcccgggtactacgaggccatccacccctgcaccgtgttctgcgtcctctccggcccgggggccagctgcgaggcctttagcgagggcggcatcttcaacatcacctccccgatgtgcctggttagcaagcagaaccgcttccggctgaccgagcaacaggtgaacttcgtatgccagcgcgtggacgtggacatcgtggtgtactgcaacgggcagcggaaggtgatactcaccaagaccctggtcatcggccagtgcatatacacgatcacctcgctgtttagcctcctgcccggggtggcgcactccatcgctgtggagctgtgcgtccccggtttccacgggtgggccaccgccgcactcctggtgacgttctgtttcggctgggtgctgatcccggcaatcaccttcatcatcctcacaatcctgaagttcattgccaacatcttccataccagcaaccaggagaaccgcctgaagtccgtcctccgaaagatcaaggaggagttcgagaagacgaagggcagcatggtgtgcgacatctgcaagtacgagtgcgagacctacaaggagctgaaagcccatggggtgtcctgcccccagagccagtgcccctactgcttcacccactgcgagcccaccgaagccgccttccaggcgcactacaaggtctgccaagtgacccaccgcttccgggacgacctgaagaagacggtgactccgcagaacttcacccccggctgctaccgcaccctaaacctgttccggtacaagtccaggtgctacatcttcacgatgtggatcttcctgctcgtcctggagagcatcctgtgggccgcctccgccagcgagactcccctcaccccggtgtggaacgacaacgcgcacggggtgggcagtgtccccatgcacaccgacctggagctggactttagcctgacgtccagcagcaagtacacctatcggcgcaagttgaccaaccccctggaggaggcccagtccattgacctgcacatcgaaatcgaggagcagaccatcggggtggacgtgcatgccctcggccactggttcgatggccggctgaacctgaagaccagcttccactgctacggagcgtgcaccaagtacgaatacccctggcacaccgccaagtgccactacgagagggactaccagtacgagacctcctggggctgcaacccgagcgactgccccggtgtcggcacgggctgcaccgcgtgcgggctctacctggaccgcttaaagcctgtgggctccgcctacaagatcatcacgatccgttacagccggcgggtgtgcgtccagttcggggaggagaacctctgcaagatcatcgacatgaacgactgcttcgtgtccaggcacgtgaaggtgtgcatcatcggcaccatcagcaaattctcccagggggacaccctgctgttcttcggccccctcgagggagggggcctcatcttcaagcactggtgcacctcaacctgccagttcggggaccccggcgatattatgagcccccgggataaggggttcctgtgccccgagttccccggctccttccgcaagaagtgcaacttcgccacgacgccgatctgcgaatacgacggcaacatggtgtccgggtacaagaaggtgatggccaccatcgacagcttccagtccttcaacaccagcaccatgcacttcactgacgagcgtatcgagtggaaggaccccgacggcatgctccgtgaccacatcaacatcctggtaaccaaggacatcgacttcgacaacttgggggagaacccctgcaagataggcttacaggcctcgagcatcgagggggcgtggggctccggcgtcgggttcacactgacctgcctggtgagcctcacggagtgccccaccttcctgaccagcatcaaggcctgcgacaaggctatctgctacggcgccgagtccgtcaccctgacgcgggggcaaaacaccgtgaaggtgagcggcaagggaggccactccggcagcacattcaagtgctgccacggggaggactgctcccagatcggcttacacgccgctgccccgcacctggacaaggtcaacgggatcagcgaaatggagaactccaaggtgtacgacgacggcgctccccagtgcggcatcaagtgctggttcgtgaagtctggggagtggatatccggcatcttcagcgggaactggatcgtcctgatcgtgctctgtgtcttcttactgttctccctcgtgctgctgagcatcctctgccccgtgcgcaagcacaagaagtcctaa

SEQ ID NO: 15044 - RNA, 3408 nt, synthetic construct
  misc_feature 1..3408: note = derived and/or modified CDS sequence (opt11) from HTNV(Aa10-518)__KU207161.1__GP
  source 1..3408: mol_type = other RNA
atgggcatctggaagtggctggtgatggccagcctcgtctggcccgttctgaccctgcgtaacgtgtacgacatgaagatcgagtgcccgcacaccgtctcattcggggagaactctgtgatcggctacgtggagctcccgcccatgcccctggccgacacggcccagctggtccccgagtccagctgctccatggacaaccaccagagcctcaacaccatcaccaagtacacccaggtgtcctggcgggggaaggccgaccagagccagtcctcccagaactccttcgagacggtgagcaccgaggttgacctgaagggtacctgcgtgctgaagcacaagatggtggaggagtcctaccgcagccggaagtccattacctgctacgacctcagctgcaactccacgtactgcaagcccaccctgtacatgatcgtccccatccacgcctgcaacatgatgaagtcctgcctgatcgccctcgggccctaccgcgtccaggtggtgtacgagcggacctactgcatgaccggcgtgttgatcgagggcaagtgcttcgtgccggaccagtccgtcgtctcgatcatcaagcacggtatcttcgacatcgccagcgtgcacatcgtctgcttcttcgtagcggtgaagggcaacacgtacaagatcttcgagcaggtcaaaaagtccttcgagagcacgtgcaacgacaccaagaacaaggtgcaggggtactacatctgcatcgtcggcgggaactccgcccccatctacgtgcccaccctggacgacttccgtagcatggaggccttcaccggcatcttccgcagcccccacggcgaggaccacgacctcgccggggaggagaccgcgacctacagcatcgtgggcccggccaacgccaaggtcccccactccgccagctccgacaccctgagcctgatcgccttctccgggatccctagctactccagcctctccatcctgactagctccacagaggcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcttgtccgggccgggcgccagctgtgaggccttctccgagggcgggatcttcaatatcacctcccccatgtgcctggtgagcaagcagaaccgcttccggctgaccgagcagcaggtcaacttcgtgtgtcagcgcgtggacgtggacatcgtcgtgtactgcaacggccagcggaaggtgatcctcaccaagacgctggtcatcggacagtgcatctacaccatcaccagtctgttcagcctcctgcccggcgtagcgcactccatcgccgtggagctgtgcgtccccgggttccacggctgggccaccgccgccctcctggtgacgttctgcttcgggtgggtgctgatcccggcgatcaccttcatcatcctcaccatcctgaaattcatcgcaaacatcttccacaccagcaaccaggagaaccgcctgaagtccgtcctccggaagataaaggaggagttcgagaagacgaagggcagcatggtgtgcgacatctgcaagtacgagtgcgagacctacaaggagctgaaagcccacggagtgtcctgcccccagagccagtgcccctattgcttcacccactgcgagcccaccgaggccgccttccaggcacactacaaggtctgccaggtgacccatcgcttccgggacgacctgaagaagacggtgaccccacagaacttcacccccgggtgctaccgcaccctcaacctgttccggtacaagtcccgctgctacatcttcacgatgtggatcttcctgctcgtcctggagagcatcctgtgggccgcctccgcctccgagacccctctcaccccggtgtggaacgacaacgcgcacggtgtggggtccgtccccatgcacaccgacctggagctggacttcagcctgacgtccagcagcaagtacacctaccggcgcaagctcaccaaccccctggaggaggcccagtccatagacctgcacatagagatcgaggagcagaccatcggcgtggacgtgcacgccctcggtcactggttcgacggccggctgaacctgaagacgagcttccactgctacggcgcctgcaccaagtacgagtacccctggcacaccgccaagtgccactacgagcgcgactaccagtacgagacctcctgggggtgtaatccgagcgactgccccggcgtcgggacgggctgcactgcgtgcggcctctacctggaccgcctgaagcccgtcggttccgcctataagataataaccatccggtacagccgccgggtctgcgtccagttcggcgaggagaacctctgcaagatcgtggacatgaacgactgcttcgtgtcccgccacgtcaaggtgtgcatcatcgggaccgtcagcaagttctcccagggcgacacgctgctgttcttcgggcccctcgagggcggcgggctgattttcaagcactggtgcacctcgacctgccagttcggcgacccgggggacatcatgagcccccgggacaagggcttcctgtgccccgagttccccgggagctttcgcaagaagtgcaacttcgccaccacgccgatctgcgagtacgacggcaatatggtctccggctacaagaaggtgatggccaccatcgacagcttccagtccttcaacaccagcacaatgcacttcacggacgagcggatcgagtggaaggaccccgacgggatgctccgcgaccacatcaacatcctggtgaccaaagacatcgatttcgacaacctgggcgagaacccctgcaagatcgggctacagacctccagcatcgagggcgcctgggggtccggcgtcggcttcaccctgacgtgcctggtgagcctcaccgagtgccccaccttcctgaccagcatcaaggcgtgcgacaaggccatctgctacggggccgagtcagtgacgctgacccggggccagaacaccgtcaaggtgagcgggaagggcgggcactccggcagcaccttcaagtgctgccacggggaggactgttcccagatcgggctccacgccgccgcgccgcacctggacaaggtgaacggcatcagcgagatggagaactccaaggtctacgacgatggggcgccccagtgtggcatcaagtgctggttcgtgaagtccggcgagtggatctccgggatcttcagcggcaactggatcgtcctgatcgtgctctgcgtgttccttcttttctccctcgtcctgctgagcatcctctgccccgtgcgcaagcacaaaaagtcctga

SEQ ID NO: 15045 - RNA, 3408 nt, synthetic construct
  misc_feature 1..3408: note = derived and/or modified CDS sequence (opt11) from HTNV(Aa13_3)__KX687227.1__GP
  source 1..3408: mol_type = other RNA
atgggcatctggaagtggctggtgatggcctccctcgtctggcccgtgctgaccctgcgcaacgtgtacgacatgaagatcgagtgcccgcacaccgtctccttcggggagaacagcgtgatcggctacgtggagctcccgcccatgcccctggtcgacacggtgcagttggtgcccgagtcctcctgctccatggacaaccaccagagcctcaacaccatcaccaagtacacccaggtctcctggcgggggaaggccgaccagagccagtccagccagaactccttcgagacggtgagcaccgaggtggacctgaaggggacctgcgtcctgaagcacaagatggtggaggagtcctaccgaagcagaaagtccatcacttgctacgacctcagctgcaactccacctactgcaagcccaccctgtacatgatcgtgcccatccacgcctgcaatatgatgaagtcctgcctgatcgccctcgggccctaccgtgtccaggtggtgtacgagcggacctactgcatgaccggcgtcctgatcgagggcaagtgcttcgtcccggaccaaagcgtggtcagcatcatcaagcacgggatcttcgacatcgccagcgttcacatcgtgtgcttcttcgtcgccgtaaagggcaacacgtacaaaatcttcgagcaggtcaagaagtccttcgagagcacgtgcaacgacaccgagaacaaggtgcaggggtactacatctgcatcgtgggcggaaactccgctcccatctacgtccccaccctggacgatttccgcagcatggaggcgttcaccggcatcttccggagcccccacggcgaggaccacgacctcgccggggaggagaccgccacctacagcatcgtgggcccggccaacgcgaaggtgccccactccgccagctccgacaccctgagcctgatcgccttctctgggatccccagctactcaagcctctccatcctaacgagctccaccgaggccaagcacgtcttcagccccggcctgttcccgaagctcaaccacaccaactgcgacaagggcgccatccccctgatgtggaccgggatgatcgacctgccaggctactacgaggcgatccacccctgcacggtgttctgcgtgctctccgggccgggcgccagctgcgaggccttcagcgagggcggcatcttcaacatcacctcccccatgtgtctggtcagcaagcagaaccgcttccggctgaccgagcagcaggtcaacttcgtctgccagcgcgtggacgtggacatcgtggtctactgcaacggccagcggaaggtgatactcaccaagacgctggtgatcgggcagtgcatctacaccatcacctctctgttcagcctcctgcccggcgtcgcccactccatcgccgtggagctgtgcgtgcccgggttccacggctgggcgaccgccgccctcctggtcacgttctgcttcgggtgggtactgatcccggccatcaccttcatcatcctcaccatcctgaagttcatcgccaatatcttccacacgagcaaccaggagaaccgcttgaagtccgtgctccggaagatcaaggaggagttcgagaagacgaagggctcgatggtctgcgacatctgcaagtacgagtgcgagacctacaaggagctgaaggcgcacggcgtctcctgcccccagagccagtgcccctactgcttcacccactgcgagcccaccgaggccgccttccaggcccactacaaggtatgccaggtcacccaccgcttccgggacgacctgaagaagacggtgaccccgcagaatttcacccccgggtgttaccgcacgctcaacctgttccggtacaagtcccgctgctacatcttcacgatgtggatcttcctgctcgtgctggagtctatcttatgggccgcctctgccagcgagacgcccctcaccccggtctggaacgacaacgcccacggcgtggggtccgtgcccatgcacactgacctggagctggacttctcactgacctccagcagcaagtacacctacaggcgcaagctcaccaaccccctggaggaggcccagtcaatcgacctgcacatcgagattgaggagcagaccatcggcgtcgacgtgcacgcgctcgggcactggttcgacggccggctgaacctgaagacgagcttccactgctacggcgcctgcaccaaatacgaatacccctggcacaccgccaagtgccactacgagcgcgactaccagtatgagacctcctgggggtgcaacccgagcgactgccccggcgtggggacgggctgtaccgcttgcggcctctacctggaccgcctgaagcccgtcgggtccgcctacaagatcattaccatccggtacagccgccgggtatgcgtgcagttcggcgaggagaacctctgcaagatcatcgacatgaacgactgcttcgtctcccgccacgtgaaggtgtgtatcatcgggaccgttagcaagttctcccagggcgacacgctgctgttcttcgggcccctcgagggcggcgggctgatcttcaagcactggtgcaccagcacgtgccagttcggcgacccaggggatatcatgagcccccgggacaagggcttcctgtgccccgagttccccgggtccttccgcaagaagtgcaacttcgcgaccaccccgatctgcgagtacgacggcaacatggtgtccggctacaagaaggtgatggccaccatagacagcttccagtccttcaacaccagcaccatgcacttcacggacgagaggatcgagtggaaggaccccgatgggatgctccgcgaccacatcaacatcctggtcaccaaggacatcgacttcgacaacctgggcgagaacccctgtaagatcgggctccagacctccagcatcgagggcgcatgggggtccggcgtgggcttcaccctgacttgcctggtgagcctcaccgagtgccccaccttcctgaccagcatcaaggcctgcgacaaggccatctgctacggggcggagtccgtcacgctgacccgtggccagaacaccgtgaaggtgagcgggaagggcgggcactccggcagcaccttcaagtgctgccacggcgaggactgctcccagatcgggctccacgccgccgccccgcacctggacaaggtcaacggcatctcagagatggagaactccaaggtgtacgacgacggggcgccccagtgcggcataaagtgctggttcgtcaagagcggcgagtggatctccggaatcttcagcggcaattggatcgtcctgatcgtgctctgcgtcttcctcctgttctccctcgtgctgctgagcatcctctgccccgtgcgcaagcataagaagtcctga

SEQ ID NO: 15046 - RNA, 3408 nt, synthetic construct
  misc_feature 1..3408: note = derived and/or modified CDS sequence (opt11) from HTNV(Aa14_186)__KX687228.1__GP
  source 1..3408: mol_type = other RNA
atgggcatctggaaatggctggtgatggccagcctcgtctggcccgtacttaccctgcgcaacgtgtacgacatgaagatcgagtgcccgcacaccgtctccttcggggagaacagcgtgatcggctacgtggagctccctccgatgcccctggccgacacggcccagctggtcccagaatccagctgctccatggataaccaccagagcttaaacacgatcaccaagtacactcaagtttcctggcgggggaaggccgaccagtcccagtccagccaaaattccttcgagacggtgagcaccgaggtcgacctgaagggcacatgcgtgctgaagcacaagatgatcgaggagtcctaccgctcccggaaaagcataacctgctacgacctcagctgcaacaacacgtactgcaagcccaccctgtacatgatcgttcccatccatgcctgtaacatgatgaagtcctgcctaatcgccctcgggccctaccgcgtccaggtggtgtacgagcgaacctactgcatgaccggtgtcctgatcgagggcaaatgcttcgtgccggaccagagcgttgtttccatcatcaaacatgggatcttcgacatcgccagcgtgcacatcgtctgcttcttcgtcgcggtgaagggcaacacgtataaaatcttcgaacaggtgaagaagtccttcgaatccacgtgcaacgacaccgagaacaaggttcaggggtactacatttgcatcgtgggcgggaacagcgcccccatctatgtccccaccctcgacgacttccgctccatggaggccttcaccggcatcttccggagcccccacggcgaggaccacgatcttgccggggaggagaccgcgacctactccatcgtgggcccggccaacgctaaggtaccccacagcgcctccagcgacacattatccctgattgccttcagcgggataccctcctacagctccctcagcatcctgacgtccagcactgaggcgaagcacgtcttttctcccggcctgttcccgaagctcaaccacaccaactgcgacaagggcgccatccctctgatgtggaccgggatgatcgacctgcctggctactacgaggccatccacccctgcacggtgttctgcgtactctcagggccgggcgcctcctgcgaggccttcagcgaagggggcatcttcaacatcacaagccccatgtgcctagtctccaagcagaaccgcttccggctgactgagcaacaggtgaacttcgtgtgccagcgcgtcgatgtggacatcgtggtctattgcaacggtcagcggaaggtgatcctcaccaagactctggtgatcggacagtgcatatacaccatcacctcattgttctcccttctgcccggcgtcgcgcacagcatcgccgtggagctgtgcgttcccgggttccacggctgggccaccgccgccctcctggtcacgttctgcttcgggtgggtgctgatcccggcgatcaccttcatcatcctgaccatcttaaagtttatcgccaacatcttccacacctccaatcaggagaaccgcctgaagtcagtgctccgtaagatcaaggaggagttcgagaagacgaaaggcagcatggtgtgtgacatctgcaagtacgagtgcgagacctacaaggagctgaaggcccacggcgtgagctgcccccagtcacagtgcccctactgcttcacacactgcgagcccaccgaggccgccttccaagcgcattacaaagtgtgccaggtcacccaccgcttccgggacgacctgaagaagacggtgaccccacagaattttactcccgggtgctaccgcacccttaacctgtttcggtacaagagccgctgctatatcttcacgatgtggatttttctgctcgtactggagtccatcctgtgggcggccagcgcctccgaaacgcccctcaccccggtctggaacgacaacgcgcacggcgtggggagcgtgcccatgcacaccgacctggagctggacttctccctgaccagctcctctaagtatacttaccggcgcaagctcaccaaccccctggaagaagcacagtctatcgacctgcacatcgagatcgaggagcagaccatcggcgtcgatgtgcacgccctcgggcactggttcgacggacggctgaacctgaagacgtccttccactgctacggcgcgtgcacgaagtacgaatacccgtggcacaccgccaagtgccactacgagagggactaccaatacgagacctcctggggctgcaacccgtccgactgccccggcgtggggacgggctgcacggcgtgcggcctctacctagaccgcctgaagcccgtcggtagcgcttacaagatcatcaccatccggtactcccgccgggtttgcgtgcagttcggcgaggagaacctctgcaagataatcgacatgaacgactgcttcgtcagccgccacgtgaaggtgtgtatcatcgggaccgtctcaaagtttagccagggcgataccctgctgttcttcgggcccctagaaggcggcgggctgatctttaagcattggtgcacctctacctgccagtttggcgacccgggggacatcatgagcccccgggacaagggcttcctgtgtcccgagttccccgggtccttccgcaagaagtgcaatttcgccacgacaccgatttgcgaatacgacggcaacatggtttccggctacaagaaggtgatggccaccattgactccttccagagcttcaacacatccaccatgcatttcacggacgagcggatcgagtggaaggaccccgacgggatgctccgcgaccatatcaacatcctagtcaccaaagacatcgacttcgacaacctgggcgagaacccttgcaagatcggactacagacctctagcatcgagggtgcctggggcagcggcgtggggttcaccctgacctgcctggtgtccctcaccgagtgccccaccttcctgacaagtatcaaggcttgcgacaaggccatctgctacggtgccgagtccgtcacgctgacccgaggccagaacaccgtgaaggtgtccggaaagggcgggcacagcggctccaccttcaagtgctgccacggcgaggactgcagccagattgggctccacgccgccgcgccgcacctcgacaaagtcaacggcataagtgaagtggagaactctaaggtgtacgacgacggggcgccccagtgcggcatcaagtgctggttcgttaagtccggagagtggatcagcgggatcttctccgggaactggatcgtgctgatcgtcctctgcgtctttctgctgttcagcctcgtgctgctttccattctctgccccgtccgcaagcacaagaaaagctga

SEQ ID NO: 15047 - RNA, 3408 nt, synthetic construct
  misc_feature 1..3408: note = derived and/or modified CDS sequence (opt11) from HTNV(Aa14_234)__KX687230.1__GP
  source 1..3408: mol_type = other RNA
atgggcatctggaagtggctagtgatggccagccttgtctggcccgtgctgaccctgcgcaacgtctatgacatgaagatcgaatgcccgcacaccgtctccttcggtgagaacagcgtgatcggctacgtggaattgcccccgatgcccctggccgacaccgcgcagttggtcccggagtccagttgcagcatggacaaccaccagagcttaaataccatcacaaagtacacccaagtgtcctggcgggggaaggccgaccagagccagtcgagccagacgtccttcgagaccgtgagcaccgaggtcgaccttaaggggacctgcgtgctgaaacacaaaatggtcgaggagagttaccgcagccgcaaatccatcacatgctatgacttaagctgcaacagcacctactgcaagcccaccctgtacatgatcgtccccatccacgcctgtaacatgatgaagtcatgcctgatcgctctcggcccctaccgcgttcaggtggtttacgagcggacctactgcatgacgggcgtgctgatcgagggcaagtgcttcgttcctgaccagtccgtagtttcgatcatcaagcacgggatcttcgacatcgccagcgtgcatatcgtatgctttttcgtggcggtcaagggaaacacctacaagatcttcgagcaggtcaagaagtcctttgagtccacctgtaacgacaccgagaacaaggtgcaggggtactacatttgcatcgtcggcgggaacagcgcgcccatttacgtgcccacgcttgacgacttccgcagcatggaggccttcaccggcatattcagaagcccgcatggcgaagaccacgatctcgccggggaggagaccgctacctacagcatcgtgggtccggccaacgccaaggtcccccattccgccagctccgacactctgagcctgatcgccttctccgggatccccagctattccagcctctccatcctgaccagctccaccgaagctaagcacgtgttcagccccggacttttcccgaaactgaaccacacctcctgcgacaagggggccatacccctgatgtggacggggatgatcgacctgcccggctactacgaagccatccacccgtgcaccgtgttctgcgtactctcgggcccgggagccagctgcgaggccttctccgaagggggcatcttcaacataaccagccccatgtgcctagtgtccaaacagaaccgcttccgactgaccgagcaacaggtgaacttcgtgtgccagcgcgtggacgtggatatcgtcgtgtactgcaatggccagcgaaaggtgatcctcacgaagaccctggtgattgggcagtgtatttacaccatcaccagccttttctccctcctgcccggcgtggcgcatagcatcgccgtcgaactgtgcgtccccgggttccacggctgggccacggccgccctcctcgtgaccttctgcttcgggtgggtgctgatcccggcgattaccttcattatcctcactgtccttaagttcatcgccaacatcttccacacgtccaaccaggagaaccgcctcaagagcgtgctccggaagatcaaggaggagttcgaaaagacaaagggctccatggtgtgcgacatctgcaagtacgagtgtgagacctacaaggagctgaaggctcacggcgtcagctgcccgcagtcccagtgcccctactgcttcacccactgcgagcccaccgaggccgccttccaggcgcactataaggtgtgccaggtgacgcatcgcttccgggacgacctcaagaagactgtcaccccgcagaacttcacccccgggtgctaccgcactctcaacttgttccggtacaagagccgctgctatatcttcaccatgtggatattcctgctcgtgctggagtccattttatgggccgccagcgcctccgaaacgcccctcaccccggtatggaacgacaacgcccacggcgtggggagcgttccaatgcacaccgaccttgagctggacttctccctgaccagcagctccaagtacacctaccggcgcaaactcacgaatcccctggaggaggcccagagcatagacctgcacatagagatagacgagcagactataggcgtggacgtccacgccctcgggcactggttcgacggccggctgaacctgaagacctcattccactgctatggcgcctgcaccaagtacgagtacccctggcacaccgccaagtgtcactacgagcgcgactaccagtatgagacgagctggggatgcaacccgtccgattgccccggcgtagggaccggatgcaccgcctgcggcctctacctggaccgactgaagccagtggggtccgcctacaagatcatcaccatccggtactctcgccgggtctgtgtgcagttcggcgaggagaatctctgcaagatcatcgacatgaatgactgcttcgtgagccgccacgtcaaggtgtgcatcatcgggacggtgtccaagttcagccagggtgacaccctactgttcttcgggcccctcgagggcggcggactgatattcaagcattggtgcacctccacgtgccagttcggcgaccccggagacatcatgagcccccgggacaagggattcctgtgccccgagttccccgggtccttccgcaagaagtgcaacttcgctaccaccccgatctgcgagtacgacggcaacatggtcagcggctacaagaaggtgatggcgacgatcgactccttccagagcttcaacacctccacgatgcactttaccgatgagcggatcgaatggaaggacccggacgggatgctccgagaccacatcaacatcctggtgaccaaggacatcgacttcgacaacctgggcgagaacccctgcaagatcgggctccagaccagctcaatcgagggcgcctgggggagcggcgtcggcttcacgctgacctgcctggtgagcctcaccgagtgccccaccttcctgacgtccatcaaggcgtgcgacaaggccatatgctacggggccgaaagcgtgaccctgaccagaggacagaacaccgttaaggtgtccgggaaaggcgggcacagcggctccacctttaagtgctgccatggcgaggactgcagccaaatcgggctccacgcggccgcgccgcacttagacaaagtgaacgggatttccgagatggagaacagcaaagtgtatgacgacggggcaccccagtgtggcatcaagtgctggttcgtgaagtccggcgagtggatcagcgggatcttctccggcaactggatcgtcctgatcgtattatgcgtattcctactcttcagcctcgtcctgttatccatactctgcccagtgcgcaagcacaaaaagagctga

SEQ ID NO: 15048 - RNA, 3408 nt, synthetic construct
  misc_feature 1..3408: note = derived and/or modified CDS sequence (opt11) from HTNV(Aa14_239)__KX687231.1__GP
  source 1..3408: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctcccgcccatgcccctggccgatacggcgcagctggtccccgagtccagctgctccatggacaaccaccagagcctaaataccatcaccaagtacacccaggtgtcctggcgcgggaaggccgaccagagtcagtccagccagaactccttcgagacggtgagcaccgaggtggacctgaaggggacctgcgtgctgaagcacaagatggtggaggagtcctaccgctcacggaagtccattacctgctacgacctcagctgcaactcaacgtactgcaagcccaccctgtacatgatcgtccccatccacgcctgcaacatgatgaaaagctgcctgatcgccctcgggccctaccgcgtccaggtggtgtacgagcgcacctactgcatgaccggcgtgctaatcgagggcaagtgcttcgtgccggaccagtccgtcgtgagcatcatcaagcatgggatcttcgacatcgccagcgtgcatatcgtctgcttcttcgtggcggtcaagggcaacacgtacaagatcttcgagcaggtcaagaagtccttcgagagcacgtgcaacgacaccgagaacaaggtgcagggatactacatttgcatcgtcggcgggaactccgcgcccatctacgtgcccaccctggacgacttccgcagcatggaggccttcaccggcatcttccggtccccgcacggcgaggaccacgacctcgccggggaggagaccgcgacctacagcatcgtgggccccgccaacgccaaggtcccccattccgccagctccgacaccctgagcctgatcgctttctccgggatccccagctactccagcctctccatcctgacgagcagtaccgaggctaagcacgtgttcagccccggcctgttcccgaagctcaaccacaccaactgcgacaagggcgccatccccctgatgtggaccgggatgatcgacctacccggctactacgaggccatccacccctgcacggtgttctgcgtcctctccggcccgggcgccagctgcgaggccttcagcgagggcggcatcttcaatatcacctcccccatgtgcctggtgagcaagcagaaccgcttccggctgaccgagcaacaggtgaacttcgtctgccagcgcgtggacgtggacatcgtcgtgtactgcaacggccagcggaaggttatcctcaccaagacgctagtcatcgggcagtgcatctacaccatcacctccctgttcagcctcctgcccggcgtggcgcactccatcgcagtggagctgtgcgtccccggcttccacggctgggccaccgccgccctcctggtgacgttctgcttcgggtgggtgctgatcccggcgatcaccttcatcatcctcacagtcctgaagttcatcgccaacatcttccacaccagcaaccaggagaaccgcctgaagtctgtgctccggaagatcaaggaggagttcgagaagacgaagggcagcatggtgtgcgacatctgcaagtacgagtgcgagacctacaaggagttaaaggcccacggcgtctcctgcccccagagccagtgcccctactgcttcacccactgcgagcccaccgaggccgccttccaggcgcactacaaggtttgccaggtgacccaccgcttccgggacgacctgaagaagacggtcaccccgcagaacttcacccccgggtgctaccgcaccctcaacctgttccggtacaagtcccgctgctacatcttcacgatgtggatcttcctgctcgtgctggagagcatactgtgggccgcctcagccagcgagacgcccctcaccccggtgtggaatgacaatgcgcacggcgtcgggtccgtgccgatgcacaccgacctggagctggactttagcctaacctccagcagcaagtacacctaccggcgcaagctaaccaaccccctggaggaggcccagtccatcgacctgcatatcgagatcgacgagcagaccatcggcgtggacgtccacgccctcgggcactggtttgacggccggctaaacctgaaaacgagcttccactgctacggcgcctgcaccaagtacgagtacccctggcacaccgccaagtgccactatgagagagactaccagtacgagacctcctgggggtgcaacccgagcgactgccccggcgtggggacaggctgtaccgcgtgcggcctctacctggaccgcctgaaacccgtggggtcagcctacaagatcatcaccatccggtacagccgccgggtctgcgtgcagttcggcgaggagaacctctgtaagatcatcgacatgaacgactgtttcgtgtcccgccacgtcaaggtgtgcatcatcgggaccgtgagcaagttctcccagggcgacacgctgctgttcttcgggcccctcgagggcggcgggctgatcttcaagcactggtgcacctcgacctgccagttcggggacccgggggatatcatgagcccccgggataagggcttcctgtgccccgagttccccgggagcttccgcaagaagtgcaacttcgccaccacgccgatctgcgagtacgacggcaacatggtctccggctacaagaaggtgatggccacaatcgacagcttccagtccttcaacaccagcaccatgcacttcaccgatgagcggatcgagtggaaggaccccgacgggatgctccgcgaccacatcaacatcctcgttaccaaggacatcgacttcgacaacctgggcgagaacccctgcaagatcgggctccagacctccagcatcgagggcgcctgggggtccggcgtcggcttcacgctgacgtgccttgtgagcctcaccgagtgccccaccttcctgaccagcatcaaggcgtgcgacaaggccatctgctacggggccgagtccgtgacgctgacccgaggccagaacaccgtcaaagtgagcgggaagggcgggcactccggcagcaccttcaagtgctgccacggcgaggactgctcccaaatcgggctccacgccgccgcgccgcacctggacaaggtgaacggcatcagcgagatggagaactccaaggtctacgacgacggggcgccccagtgcggcatcaagtgctggttcgtcaagagcggcgagtggatctccgggatcttcagcggcaactggatcgtgctgatcgtgctctgcgtgttcctgctgttctccttggtcctgctgagcatcctctgccccgtgcgcaagcacaagaagtcctga

SEQ ID NO: 15049 - RNA, 3408 nt, synthetic construct; identical to SEQ ID NO: 11763
  misc_feature 1..3408: note = derived and/or modified CDS sequence (opt11) from HTNV(Aa14-172)__KU207162.1__GP
  source 1..3408: mol_type = other RNA

SEQ ID NO: 15050 - RNA, 3408 nt, synthetic construct; identical to SEQ ID NO: 11764
  misc_feature 1..3408: note = derived and/or modified CDS sequence (opt11) from HTNV(Aa14-175)__KU207163.1__GP
  source 1..3408: mol_type = other RNA

SEQ ID NO: 15051 - RNA, 3408 nt, synthetic construct
  misc_feature 1..3408: note = derived and/or modified CDS sequence (opt11) from HTNV(Aa14-184)__KU207164.1__GP
  source 1..3408: mol_type = other RNA
atgggcatctggaaatggctggtgatggccagcctcgtctggcccgtgctgaccctgcgcaacgtctacgatatgaagatcgaatgcccgcacaccgtgtccttcggggagaacagcgtaataggctacgtggagctcccgcccatgcccctggccgacacggcgcagctggtccccgagtccagctgttccatggacaatcaccagagcctcaacacaatcaccaagtacactcaggtgtcctggcgggggaaagccgaccaaagccagtccagccagaactctttcgagacggtgagtaccgaggtcgacctgaaggggacctgcgtgctgaagcacaagatgatcgaggaatcctatcgaagccggaaatccattacctgctatgacctcagctgcaacaacacgtactgcaagcccaccctgtacatgatcgttccaatccatgcctgcaacatgatgaagtcctgcctgatcgccctcgggccctaccgcgtccaagtcgtttacgagcggacctactgcatgactggcgtcctgatcgaggggaagtgcttcgttccggaccagagcgtagtctccatcatcaagcacgggatcttcgacatcgcaagcgtgcatatagtgtgcttcttcgtcgcggtgaagggtaacacgtacaaaatcttcgaacaggtgaagaagtcattcgagtccacctgtaacgacaccgagaacaaggtacaggggtactacatctgcatcgtcggagggaactcggcccccatctacgtccccaccctggacgatttccgcagcatggaggccttcacgggcatcttccggtccccgcatggcgaggaccacgacctcgccggggaggagaccgcgacatactctatcgtgggcccggccaacgccaaggtgccccacagcgcctccagcgacaccctgtccctgatcgccttcagtggtataccctcctacagctccctcagcatactgacgtccagcaccgaggcgaagcacgtgttctcgcccggtctgttcccgaagctcaaccacacgaactgcgacaagggcgccatccccctgatgtggaccgggatgatcgacctgcccggctactacgaagccatccacccgtgcacggtgttttgcgtgctcagcggcccgggcgccagttgcgaggcctttagcgagggcggcatcttcaatatcacgagccccatgtgcctggtgtccaagcagaaccgcttccggctgaccgagcaacaggtcaacttcgtatgccagcgcgtggacgtggacatcgtggtctactgcaacgggcagcggaaggtgatcctcaccaagacgctggtgattgggcagtgtatctacaccatcaccagcctgttctcgctactgccgggggtcgcccatagcattgccgttgagctgtgcgtacccgggttccatggctgggccaccgccgccctcctggtcaccttctgtttcgggtgggtgctgatcccggcgatcacctttatcatcctcaccattttaaagttcatcgcaaacatcttccacacctccaaccaagaaaatcgcctgaagtcggttctgcggaagatcaaagaggagttcgaaaagacgaagggctccatggtctgcgacgtatgcaagtacgagtgcgagacctacaaagagcttaaggcgcatggcgtgagctgcccccagtcccaatgcccgtactgcttcacccactgcgagcccaccgaggccgccttccaggcgcactacaaggtctgccaggtgacccaccgcttccgggacgacctcaagaaaacagtgacccctcagaacttcacccccggatgctaccgcactctcaaccttttccggtacaaaagccgatgctacatcttcacgatgtggatctttctgctcgttttggagagcatcctatgggccgccagcgcctccgagacacccctcacccctgtgtggaacgacaacgcgcacggcgtggggagcgtgcccatgcacaccgaccttgagcttgacttctccctgactagctccagtaagtacacctaccggcgcaagctcaccaacccactggaggaagcccagtcaatcgacttacatatcgagatcgaggagcagacaataggcgtggacgtgcacgcgctcgggcactggttcgacggccggctgaacctgaaaacgtccttccactgctacggcgcctgcaccaagtacgagtacccctggcataccgccaaatgccactacgagcgggactaccagtacgagacatcttgggggtgcaacccgtcggattgccccggtgtcggaaccggctgcaccgcgtgcggactctacctggaccgcctgaagcccgttgggtcggcctataagataatcaccatccggtactcccgccgtgtgtgcgtccaattcggcgaggagaacctctgcaagatcatagacatgaacgactgcttcgtgagtcgccatgtgaaagtatgcataatcgggacagtgtccaagttcagccagggcgacacgctgctgttcttcgggcccttagagggaggcgggctgatctttaaacactggtgcacatccacctgtcagttcggcgacccgggggacatcatgagccccagagacaagggcttcctgtgccctgagttcccggggagcttccgcaagaagtgtaacttcgccacgacgcctatctgcgagtacgacggcaacatggtgagcgggtacaagaaggtcatggcgaccatcgactccttccagagcttcaacacctccaccatgcactttaccgacgagcgcatcgagtggaaagacccagacgggatgctccgcgaccatataaacatcctcgtaaccaaggacatagacttcgacaacctgggcgagaacccgtgcaagatcggactccagaccagctccatcgagggcgcctgggggagcggcgtgggcttcaccctgacgtgcctagtctccctcactgagtgccccacattcctgacgagcataaaggcgtgcgataaggccatttgctacggagctgagagcgtaacgctgacgagaggacagaacaccgtgaaagtctccgggaagggcgggcacagcggctcgaccttcaagtgttgccatggcgaggactgctcgcagatcgggctccacgctgccgcgccgcacttggacaaggtgaacggcatctccgaggtggagaatagcaaggtctatgacgacggggctccccagtgcggcatcaaatgctggttcgtgaagtccggcgagtggatcagcgggatcttctccggcaactggatcgtcctgatcgtgctctgcgtattcctcctgttcagcctcgtcctgctgtccatcctgtgccccgtgcgcaaacataagaagtcctga

SEQ ID NO: 15052 - RNA, 3408 nt, synthetic construct
  misc_feature 1..3408: note = derived and/or modified CDS sequence (opt11) from HTNV(LR1)__AF288293.1__GP
  source 1..3408: mol_type = other RNA
atgggcatctggaagtggctggtgatggccagcctcgtctggccagtgctgacgctgcgcaacgtgtacgacatgaagatcgagtgcccgcacaccgtctccttcgggggcaacagcgtgattgggtacgtggagctcccgcccgtccccctggccgacacggcgcagatggtgcccgagtccagctgctccatggacaaccaccagagcctgaacaccatcaccaagtacacccaggtgtcctggcggggcaaggccgaccagagccagtccagccagaactccttcgagacggtcagcaccgaggttgacctcaaggggacctgcgtgctgaagcacaagatggtcgaggagtcctaccgcagccggaagtccgtgacctgctacgacctgagctgcaactccacgtactgcaagcccaccctctacatgatcgtgcccatccacgcctgcaacatgatgaagtcctgcctgatcgccctgggcccctaccgcgtccaggtggtgtacgagcggacctattgcatgaccggcgtgctcatcgaggggaagtgcttcgtgccggaccagtccgtggtcagcatcattaagcatggcatattcgacatcgccagcgtgcacatcgtgtgctttttcgtcgcggtgaaggggaacacgtacaagatcttcgaacaggtgaagaagtccttcgagagcacgtgcaacgacaccgagaacaaggtgcagggctactacatctgcatcgtcgggggcaactccgcccccatctacgtgcccaccctggacgacttccgcagcatggaggccttcaccggcatcttccggagcccccacggggaggaccgcgacctggccggcgaggagatcgcgagctactccatcgtgggaccggccaacgccaaggtcccccatagcgcctccagcgacaccctccgactgatcgcatactccggcatccccagctactccagcctgtccatcctcaccagctccaccgaggcgaagcacgtcttctcgcccggcctgttcccgaagctgaaccacacgaactgcgacaaatccgccatcccccttatctggaccgggatgatcgacctgcccggctactacgaggccgtgcacccctgcaccgtgttctgcgtcctgagcgggccgggcgccagctgtgaggccttctcggagggcgggatcttcaacatcaccagctccatgtgcctcgtgagcaagcagaaccgcttccggctcacggagcagcaggtcaacttcgtgtgccagcgcgtggacatggacatcgtggtctactgcaacggccagcggaaggtgatcctgactaagaccctcgtgatcgggcagtgcatctacaccatcacgtcccttttcagcctgctccccggcgtcgcgcactccatcgccgtggagctgtgcgtgcccgggttccacggctgggcaaccgccgccctgctcgttaccttccgcttcgggtgggtgctgatccccgctatcaccttcatcatcctgacggtgctcaagttcatcgccaacatcttccacaccagcaaccaggagaaccggctgaagtccgtcctgcgcaagatcaaggaggaatttgagaagaccaagggcagcatggtgtgcgacgtgtgcaagtacgaatgcgagacctacaaggagctcaaggcccacggcgtctcctgcccgcaaagccagtgcccctactgcttcacgcactgcgagcccaccgaggccgccttccaggcgcactacaaggtgtgccaggtgacccaccggttccgcgacggtctgaagaagaccgtcacgccccagaacttcaccccgggctgctatcggaccctgaacctcttccgctataagtcccggtgctacatcttcaccatgtggatcttcctgctggtgctcgagagcatcctgtgggccgcctccgccagcgagacgcccctgacccccgtgtggaacgacaacgcgcacggcgtcggctcggtgccgatgcacaccgacctcgagctggacttcagcctgaccagttcctcaaagtacacctaccgccgcaagctgacgaacccgctcgaggaggcccagtccatcgacctgcacatcgagatcgaggaacagaccatcggggtggacgtccacgccctgggccactggttcgatggccggctcaacctgaagaccagcttccactgctacggggcctgcaccaagtacgagtacccctggcacacggccaagtgccactacgagcgcgactaccagtacgagacctcctggggctgcaaccccagcgactgcccgggggtgggcaccggctgcaccgcgtgcgggctctacctcgatcagctgaagcccgtgggctccgcctacaagatcatcaccatccggtacagccgccgggtctgcgttcagttcggggaggagaacctctgcaagatcatcgacatgaacgactgcttcgtgtcccgccacgtcaaggtgtgcatcatcggcaccgtgagcaagttttcccagggggacaccctcctgtttttcggccctctggagggagggggcctcatcttcaagcactggtgcaccagcacgtgccagtttggggaccccggcgacatcatgtcccctcgagacaaggggttcctgtgccccgagttccccggcagcttccgcaagaagtgcaacttcgccaccacccccatctgcgagtacgacggcaacatggtctccgggtacaagaaggtgatggcaaccatcgatagcttccagtccttcaatacgagcaccatgcacttcaccgacgagcggatcgagtggaaggacccggacggcatgctgcgcgaccacatcaatatcctcgtgaccaaggacatcgacttcgacaacctgggggagaatccctgcaagatcggcctgcagacgtccagcatagagggtgcgtggggcagcggcgtcgggttcaccctgacctgcctcgtttccctgaccgagtgtcccacgttcctcaccagcatcaaggcgtgcgacaaggccatctgctacggcgccgagtccgggaccctgacccggggccagaacacggtgaaggtcagcgggaagggcggccactccgggagcaccttcaagtgctgccacggcgaggactgctcccagatagggctgcacgccgccgcgccccacctcgacaaggtgaacggcatcagcgagatcgagaactccaaggtctacgacgacggcgccccgcagtgcgggatcaagtgctggttcgtcaagagcggcgagtggatctccgggatcttcagcggtaattggatcgtgctgatcgtgctgtgcgtgttcctcctgttctccctcgtgctcctgagcatcccctgccccgtccgcaagcacaagaagtcctga

SEQ ID NO: 15053 - RNA, 3408 nt, synthetic construct; identical to SEQ ID NO: 11767
  misc_feature 1..3408: note = derived and/or modified CDS sequence (opt11) from HTNV(SN7)__AF288656.1__GP
  source 1..3408: mol_type = other RNA

SEQ ID NO: 15054 - RNA, 3408 nt, synthetic construct
  misc_feature 1..3408: note = derived and/or modified CDS sequence (opt11) from HTNV(84FLi)__AF366569.1__GP
  source 1..3408: mol_type = other RNA
atgggcgtgtggaagtggctggtcatggccagcttggtgtggcccgcctgcaccctacgcaacgtgtacgacatgaagatcgagtgcccgcacaccgtcagcttcggggagaacagcgtaataggctacgtggagctgccgccgatgcccctcgccgacacgacccagctggtgcccgaatccagctgtagtatggacaaccaccagagcctgaacaccatcaccaagtacacccaggtgtcctggcggaagaaagccgatcaggcccagagcagtcagaacagcttcgagacggtgtccgtcgaagtggacctcaagggaacctgcgtgctgaagcacaagatgatcgaggagagctaccgctcccgcaagagcatcacgtgttacgacctgagctgtaatagcacgtactgcaagcccaccctctacatgatcgtcccgatccatgcctgcaatatgatgaagtcctgcctcatcgccctgggcccctaccgggtccaggtggtgtacgaacggacctactgtatgacaggtgtactcatcgaggggaagtgcttcgtgccggaccagagcgtcgtgtccatcatcaagcacggcatcttcgacatcgcgagcgtgaagatcgtctgcttcttcgtcgccgtgaaggggaacacgtacaagctgttcgagcaggtcaagaagtccttcgactctacgtgcaacgacaccgagaacaaggtgcagggctactacatctgtatcgtcggaggcaacagcgcccccatctacgtgcccaccctggacgacttccgcagtatggaggcctttagcgggatctttcggagcccccacggcgaggaccacgacctcgcgggcgaggaggtcgccagctactccatcgtcgggccggccaacgccaaggtgccccacaacgccagctccgacaccctgagcctgatcgcgtactccggcataccgagctactccagcctctccatcctgacctcgtccaccgaggccaagcacgtcttctcacccgggttcttcccgcagctgaaccacaccaagtgcgacaagacggcaatcccccttacgtggacaggcatgatcgacttacccggctactacgaggccatccacccctgcaccgtcttctgcgtgctgtccgggccaggcgccagctgcgaggcgttcagcgagggcgggatcttcaacatcacgtcccccatgtgcctcgtaagtaagcaaaaccgcttccggctgaccaagcaacaggtaaacttcgtgtgccaacgggtggacatggacatcgtagtgtactgcaacggccagcggaaggtgatcctgacaaagaccatggtcatcggccagtgcatctacacgatcacctccctcttcagcctgctgcccggcgtggcacactccatcgccgtggagctctgcgtccccgggttccacggatgggccaccgctgcgctgctggtgaccttctgcttcgggtgggtgctcatcccggccgtcacattcatcatcctgaccgtgctgaagttcgtggccaatatcttccacaccagcaaccaggagaaccgcctcaagtccgtcctgcggaagatcaaggaagagttcgagaagaccaagggcagcatggtgtgcgacgtgtgtaagtacgaatgcgagacgtacaaggaactgaaggcccatggggtctcctgcccccagtcacagtgcccctattgcttcacccactgcgagcccaccgaggccgcgttccaggcccactaccgcgtgtgtcaagtgacccaccgcttccgcgacgacctcaagaagaccgtaaccccgcaaaatttcacccccggctgctaccggaccctgaacctgttccgctataagtccagatgctacatttttaccatgtgggtgttcttgttagtgctggagagcatcttatgggccgcctccgcgagcgaggtcccactaaatccgatctggaacgacaatgcacacggagtagggtccgtgcccatgcacactgacctggagctagacttcagcctgacctccagcagcaagtatacctaccgccggaagctgaccaaccccttagaggagacgcaggccatagacctgcacatcgagatcgaggagcagactatcggcgtcgacgtacacgccctggggcactggttcgacggacgcctgaacctcaagaccagcttccactgctacggggcctgcaccaagtacgagtacccctggcacacggcgaagtgccattacgagcgcgactaccagtacgagaccagctggggctgcaacccctccgactgccccggcgtggggaccggctgcaccgcttgcgggctgtacctggaccagctcaagcccgtcggcagcgcctacaaaatcatcacgatccggtactcccgccgcgtgtgcgtgcagttcggggaggagaacttgtgcaaggtgatcgacatgaacgactgcttcgtgagccgccacgtcaaggtctgcatcatcgggacagtgtccaagttctctcaaggcgacaccctcctcttcttcggacccctcgagggtgggggcttgatcttcaagcactggtgcacttctacgtgtcagtttggcgacccgggggacatcatgagcccccgggataagggcttcctctgccccgagttccccggcagtttccgcaagaagtgtaacttcgccaccaccccgctgtgtgagtacgacggcaacatgatcagcggatacaagaaggttatggccactatcgactccttccagagcttcaacacgagcaccatgcacttcaccgacgagcggatcgagtggaaggacccggacggtatgctgcgcgaccacatcaatatcctcgtcaccaaggacatcgacttcgacaatctgggcgagaatccctgcaaaatcgggttacaaacgagcagcatcgagggcgcgtgggggtccggcgtggggttcaccttgacctgcctggtgtccctgaccgagtgccccacatttctcaccagcatcaaggcctgcgacaaggccatctgctacggcgcggaaagcgtcaccctgaccaggggccagaatacggtgaaggtctccggcaagggcgggcacagcggaagcaccttcaaatgctgccatggggaggattgcagccagaccggcctgcatgccgcggctcctcacctcgacaaggtgaacggcatctccgagattgaaaacagcaaggtgtacgacgacggggcgccccaatgcggcatcaagtgctggttcgtgaaatcgggggagtggatcagcgggatcttctccggcaactggatcgttctgatcgtgctgtgcgtctttctgcttttctctttggtgctcctgtccgtgttatgccccgtccgcaagcacaagaagtcctga

SEQ ID NO: 15055 - RNA, 3408 nt, synthetic construct
  misc_feature 1..3408: note = derived and/or modified CDS sequence (opt11) from HTNV(Aa08-1111)__KY594715.1__GP
  source 1..3408: mol_type = other RNA
atgggcatatggaagtggctggtgatggccagcctcgtctggcccgttttcaccctgcgtaacgtgtacgacatgaagatcgagtgtccgcacaccgtctccttcggggagaacagcgtgatcgggtacgttgagctgccacccatgcccctcgccgacacggcccaaatggtcccggagtccagctgctccatggacaaccaccagagcctaaacaccatcaccaagtacacccaggtgtcttggcgggggaaggcagaccagagccaatccagccagaactccttcgaaacggtgagcaccgaggtcgacctgaaggggacctgcgtgctaaagcacaagatggtggaggaatcctaccgatcccggaagtccataacctgttacgacctgagctgcaacagcacgtactgcaagccgaccctttacatgatcgtccccatacacgcctgcaacatgatgaagtcgtgcctcattgccctggggccctaccgcgtccaggtggtctacgagcggacctactgcatgaccggcgtccttattgagggcaagtgcttcgtgccagaccagagcgtcgtaagcatcatcaagcacgggatcttcgacattgccagcgtgcacatcgtctgcttctttgtggcggtgaagggcaacacgtacaagatctttgagcaggtcaagaagtccttcgagagcacgtgcaatgacaccgagaacaaagtgcaggggtactacatctgcatcgtcggcgggaactccgcccccatctacgcccccaccctcgacgatttccgcagcatggaggcctttaccggcatcttcaggagcccccacggcgaggaccacgacctggcgggggaggagatcgcctcctactctatcgtgggtccggctaacgccaaggtcccgcacagcgcctccagcgacaccctgtccctcatcgcgtacagcgggatcccctcctacagctcgctgagcatcatcacctccagcaccgaggccaagcacgtcttctcccccggtctgttcccgaagctcaaccacacgaactgcaacaagggcgccatccccctgatctggaccgggatgatcgaccttcccggctactacgaggccgtgcacccctgcaccgtgttctgcgtcctcagcgggccgggcgccagctgcgaggcgttctccgaagggggcatctttaacatcaccagccccatgtgcctcgtgtccaagcagaaccgcttccggctaacggagcaacaggtgaacttcgtctgccagcgcgttgacatggacatcgtggtgtactgtaacggccagcggaaggtgatcctcaccaagactctggtgatcgggcagtgcatctacaccatcacgagcctgttctccctcctgcccggggtcgcccacagcatcgccgtggaactgtgcgtgcccggatttcacggctgggccaccgccgcgctgctggtcacgttctgcttcgggtgggtgctgatcccggccattacattcatcatcctcacggtgttgaagttcatcgccaacatcttccatacctccaaccaggagaaccgcctcaagagcgtcctgcggaagatcaaggaggagttcgaaaagaccaagggctccatggtgtgcgacatctgcaagtacgagtgcgagacctacaaggagctgaaggcccacggcgtgagctgcccccagtcccagtgcccctactgcttcacgcactgcgagcccaccgaggccgcgtttcaggcccactacaaggtctgccaggtgacccatcgcttccgggacgacctgaagaagaccgtgaccccgcagaacttcacgcccgggtgctaccgcaccctcaacctgttccggtacaagagccgctgctacatcttcaccatgtggatcttcctgctcgtcctggagtccatcctgtgggccgccagcgcgtcagagacgcccctcaccccggtttggaacgataacgcgcacggcgtggggagcgtccccatgcacaccgacctggagctggacttttccctcaccagcagctccaagtacacctaccggcgcaagctgacgaatcccctggaggaagcacagagcatcggcctacacatcgagatagaggagcagaccatcggggtggacgtgcacgccctcggccactggttcgacggccggctgaacctgaaaacctccttccactgctacggggcctgcaccaagtacgagtacccctggcacacggcgaagtgccactacgagcgcgactaccagtacgagaccagctggggctgcaacccgtccgactgccccggggtcggcaccggctgcaccgcctgcgggctctacctggaccaactgaagcccgtcggcagcgcttacaagatcatcacgatccgatactcccggcgcgtgtgtgtccagttcggggaggaacacctctgcaagataatagacatgaatgactgcttcgttagccggcatgtgaaggtctgcatcatcggtaccgtgtccaaatttagccagggggacaccctgctgttcttcggccccctcgagggcgggggcctgatcttcaagcactggtgcacctccacgtgccagttcggagacccgggcgacatcatgagcccccgcgacaagggtttcctgtgcccggagttccccggctccttccggaaaaagtgcaacttcgccaccaccccgatctgcgagtacgacggaaacatggtgagcgggtacaagaaggtgatggccaccatcgactccttccagagctttaatacgtccaccatgcacttcaccgacgagcgcattgagtggaaggaccccgacggcatgctccgggatcacattaacatcttggtgaccaaggacatcgacttcgacaatctgggggagaacccctgcaagattggcctccagacgagctccatcgaaggggcgtggggcagcggcgtggggttcaccctgacctgcctggtaagcctcaccgagtgtcccacgttcctgacctccatcaaggcctgcgacaaggccatctgctacggcgccgagagcgtgaccctgacccgcggtcagaacacggtgaaggtctccggcaagggcggccacagcggctccacgtttaagtgctgccacggggaggagtgcagccagatcggcctccacgccgcggccccgcatctggacaaggtgaacgggatctccgagatcgagaacagcaaggtgtacgacgacggcgcgccccagtgcggtatcaagtgctggttcgtcaagtccggcgagtggatcagcggcatcttctccggaaactggatcgtgctgatcgtcctctgcgtgttcctcctgttcagcctcgtgctgctctccatcctctgcccggtccggaaacacaaaaagagctaa

SEQ ID NO: 15056 - RNA, 3408 nt, synthetic construct
  misc_feature 1..3408: note = derived and/or modified CDS sequence (opt11) from HTNV(Aa09-189)__KY594716.1__GP
  source 1..3408: mol_type = other RNA
atgggcatctggaagtggctggtgatggccagcttggtctggcccgtcttcaccctgcgcaacgtgtacgatatgaagatcgagtgcccgcacacagtctccttcggggagaacagcgtgatcggctacgtggagctgccacccatgcccctcgccgacacggcccagatggtcccggagtccagctgctccatggacaaccaccagtcgcttaacacaatcaccaagtacacacaggtgtcctggcggggaaaggccgatcagagccagtccagccagaactccttcgagacggtgagcaccgaagtcgacctgaagggaacctgcgtgctcaagcacaaaatggtggaggagtcctaccgcagccgcaagtccattacctgctacgacttgagctgcaactccacgtactgcaagcccaccctgtacatgatcgtccccatccacgcttgcaacatgatgaagtcttgcctcatcgccctgggaccctaccgcgttcaggtggtgtacgagcggacctactgcatgaccggcgtgctgatcgaggggaagtgcttcgtgccggaccagtccgtcgtgagcatcatcaagcacgggatcttcgacatcgccagcgtccatatcgtctgcttcttcgtagcggtcaagggcaacacgtacaagatcttcgagcaggtcaaaaagagtttcgagagcacttgcaacgacaccgagaacaaggtgcaggggtactacatctgcatcgtcgggggaaactccgcacccatatacgcccccaccctcgacgacttccgcagcatggaggccttcacgggcatcttccggagcccccacggcgaggaccacgacctggcgggggaggagatcgcctcctactctatcgtgggccccgccaacgccaaggtgccccacagtgcctccagcgacactctgtccctcatcgcgtactcggggatcccctcctacagctccttaagcatcataacgtccagcaccgaggccaagcacgtgttctcccccggcctgttcccgaagctcaaccatacgaactgcgacaagggcgccatccccctgatctggaccggaatgattgacctgcccggctactacgaggcagtgcacccctgtaccgtcttctgcgtcctcagcgggccgggcgccagctgcgaggcgttctccgagggcgggatcttcaacatcacctcacccatgtgcctggtatccaagcagaaccgattccggctaacggagcaacaggtgaacttcgtctgccagcgcgtggacatggacatcgtggtctactgcaatgggcagcggaaggtgatcctcaccaaaaccctggtgatcgggcagtgtatctacaccatcacaagccttttctccctcctgcccggcgtcgcccacagcatcgcagtcgagctgtgcgtgccagggttccacggatgggccaccgccgcgttgctggtcaccttctgtttcgggtgggtcctgatcccggctatcacctttatcatcctcacggtgctgaagtttatcgccaacatctttcacacctccaaccaagagaaccgcctgaaaagcgtcctccggaagatcaaggaggagttcgagaagaccaagggctccatggtgtgcgacatatgcaagtacgagtgcgagacctacaaggagctaaaggcccacggcgtgagctgcccccagtcccagtgcccttactgcttcacgcattgcgagcccactgaggccgcgttccaggcccactacaaggtatgccaggtgacccaccgcttccgggacgacctgaagaagaccgtgacgccccagaacttcacccctgggtgctaccgcaccttaaacctgttccggtacaagagccgctgctacatcttcaccatgtggatcttcctactcgttctggagtcaatcctgtgggccgcctccgcgtccgagacgcccctcacccctgtgtggaacgacaacgcccacggcgtggggagcgtgcccatgcacaccgacctggagctggacttctccttaaccagcagctccaagtacacctaccggcgcaagctgaccaacccgctggaggaagcccagagcatcggcctgcacatcgagatcgaggagcaaaccatcggggtggacgtgcacgcgctcggccactggttcgacggccggctgaacctgaagacgtccttccactgctacggggcctgcaccaaatacgagtacccctggcacacggcgaagtgccactacgagagggactaccagtacgagactagctggggctgcaacccgtccgactgccccggggtcggcaccggttgcaccgcctgcgggctttatttagaccagcttaagccagtgggcagcgcctacaaaatcattacgatccggtactccaggcgcgtgtgtgtccagttcggggaggagcacctctgcaagatcatcgacatgaacgactgcttcgtgagccggcacgtgaaggtctgcatcatcggcaccgtgtctaagttcagccaaggcgacaccctgctgttcttcggccccctcgagggcgggggcctgatcttcaagcactggtgcacctccacgtgccagttcggggacccgggcgacatcatgagcccccgcgacaaagggttcctgtgccccgagttccccggctccttccggaagaagtgcaacttcgccaccaccccgatctgcgagtacgacggcaacatggtgagcgggtacaagaaggtcatggccaccatcgactccttccagagcttcaacacgtccaccatgcacttcaccgacgagaggatcgagtggaaggaccccgatggcatgttaagagaccacatcaacatcctggtgaccaaggatatcgacttcgacaacctgggggagaacccctgcaagatcggcctccagacaagctccatcgagggggcgtggggtagcggggtggggttcaccctgacctgcctggttagcctcaccgagtgccccaccttcctgacctccatcaaggcctgcgacaaggccatctgctacggcgccgagagcgtgacccttacccgagggcagaacacggtgaaggtctcaggcaaagggggccacagcggctccaccttcaagtgctgtcacggggaggagtgcagccagattggcctccacgccgcggccccgcacttggacaaggtgaacgggatctccgagatcgagaacagcaaggtgtacgacgacggtgcgccccagtgtggcatcaagtgctggttcgtcaagtccggggaatggatcagcggcatcttctccgggaactggatcgtgctgatcgtcctctgcgtgttcctgctgttcagcctcgtactgctgtccatcctctgccccgtccggaagcacaaaaagagctga

SEQ ID NO: 15057 - RNA, 3408 nt, synthetic construct
  misc_feature 1..3408: note = derived and/or modified CDS sequence (opt11) from HTNV(CJilin93)__AY748307.1__GP
  source 1..3408: mol_type = other RNA
atgggtatgtggaagtggctggtgatcgccagcctcgtgtggcccgccctggcgctgcgcaacgtgtacgacatgaagatcgagtgcccccacaccgtgtccttcggtgagaacagtgtcatagggtacgtggagctcccgccgatgcccttagcagacaccgcacaaatggtgccggagagtagctgctccatggacaaccaccagagcataaacacgatcaccaagtacacccaagtcacctggcgggggaaggccgaccccggccagtccagccagaactcctttgaaacgctgtctgccgaagtcgacctcaaggggacctgcgtactgaagcacaagatggtcgaggagtcctatcgcagccggaagtccatcacgtgctacgacctgagctgcaacagcacctactgcaaacccacactctacatgatagtgccaatccacgcgtgcaacatgatgaaaagctgcttaatcgccctgggaccgtaccgcgtgcaggtcgtgtacgagcggacctactgcatgaccggggtgctcatcgaggggaagtgcttcgtccccgaccagtccgtggtgagcatcatcaagcacggaatcttcgacatcgcctccgtccacatcgtgtgtttcttcgtggccgtcaaggggaacacctacaagctattcgagcaggtcaagaagtcctttgagagcacgtgcaacgacaccgagaacaaagtgcagggctactatatctgcatcgtcgggggcaacagcgcgccaatctacgtgcccaccctggatgacttccgcagcatggaggccttcaccggcatcttcaagtccccgcacggggaggatcacgacctcgccggcgaggagatcgccagctacagtatcgtggggcccgccaacgcgaaagtgccccatagcgcctcaagcgacacgctgtcactgatcgcctacagcggcatcccctcctatagctccctcagcatcttaacctccagcaccgacgccaagcacgtattttcaccgggcttgttccccaagctcaaccacaccaactgcgacaagtcagccatccccctgacgtggaccggtatgatcgacctgccagggtactacgaggcgatccacccgtgcacagtcttctgcgtgctctccgggccaggcgccagctgcgaggcattcagcgagggagggatcttcaacattacctcccccatgtgcctggtgagcaagcagaaccggttccgcctgacggagcagcaggttaacttcgtgtgccagagagtggacatggacatcgtcgtctactgtaacggccagcgcaaggtgatcctcaccaagaccctagtcatcgggcagtgcatctacaccatcacgtccctgttcagcctcctgcccggcgtggcccactccatcgccgtggagctatgcgtcccggggttccacggctgggcgaccgctgccctcctggtgacctactgcttcgggtgggtgctgatcccggccatcacctttatcatcctcacagtcctgaaattcatcgccaacatcttccacaccagcaaccaggagaaccggctaaagagcgtactgcgcaagatcaaggaggagttcgagaagacgaaggggagcatggtgtgcgacgtctgcaagtacgagtgcgaaacctataaggagctgaaggcccacggcgtgtcctgcccccagagccaatgcccctactgcttcacgcactgcgagccgacggaggccgctttccaagcccactacaaggtgtgccaggtcacccaccggttccgtgacgacctcaagaaaaccgtgacacctcagaacttcactcccggctgctatcggaccctcaacctgttccgctacaaatcccggtgctacatcttcaccatgtgggtgttcctgctcatcctggagagcgtcctgtgggcggcctccgctagcgagactccgctcacgcccgtgtggaacgataacgctcatggcgtggggtccgtccccatgcacacagacctggagttagacttcagcctaacgtcaagcagcaagtacacctaccgccggaagctcacgaaccccctggaggaggcccagtccatagatctgcacatcgagatcgaggagcagacgatcggggtggacgtacacgcgctcggacactggttcgacggccgcctgaacatcaagaccagcttccactgctacggcgcctgcacaaagtacgagtacccgtggcacacggccaagtgccactatgagcgggactaccaatacgagaccagctgggggtgcaaccccagcgactgccccggcgtcgggacgggctgcaccgcctgcggcctgtatctcgaccagctgaagcccgtggggtccgcctacaagatcatcacgatccggtacagccgccgtgtgtgcgttcagttcggcgaggagaacctgtgcaaaataattgacatgaacgactgcttcgtttcccgccacgtgaaggtctgcatcatcgggaccgtgagcaagttctcccagggcgacaccctcctgttctttggcccgttagagggcggcggtttgatctttaagcactggtgcaccagcacgtgccagttcggcgaccccggggacataatgagcccccgggacaaaggcttcctgtgccccgagttcccgggttcattccgcaagaagtgcaactttgcgaccacacccatctgcgaatacgacggcaacatggtgtccggctacaagaaggtcatggccaccatcgacagcttccagtcctttaacacgtccactatgcacttcaccgacgagcggatcgagtggaaggatcccgacgggatgctgcgcgaccacatcaacatccttgtgaccaaggacattgacttcgacaacctaggcgagaacccctgcaagatcggcctgcagacgtccagcatagagggcgcgtgggggtccggtgttggcttcaccctgacgtgcctggtcagcctgaccgagtgcccgacgttcctcaccagcatcaaagcgtgcgacaaggccatctgctacggggcggaatctgtgaccctgacccgtggccagaacacggtgaaggtcagcgggaagggcgggcactccggcagcaccttcaagtgttgtcacggcgaggactgctccaaaatcgggctccacgcggccgccccgcacctcgacaaggtgaacggcataagcgagatcgaaaactccaaggtgtacgatgacggagcgcctcagtgtggcatcaaatgctggttcgtcaagagcggcgagtggatctccgggattttcagcggcaactggatcgtgctgatcgtcctgtgtgtgttcctcttattctccctggtgctactctccatactgtgccccgtccgcaagcataagaagtcctga

SEQ ID NO: 15058 - RNA, 3408 nt, synthetic construct
  misc_feature 1..3408: note = derived and/or modified CDS sequence (opt11) from HTNV(KHF,clone:4)__LC209208.1__GP
  source 1..3408: mol_type = other RNA
atgggcatctggaaatggctggtgatggccagcctcgtctggcccgtgctgaccctgcgcaacgtgtacgacatgaagatcgagtgcccgcacaccgtctccttcggggagaacagcgttatcggctacgtggagctcccgcccatgcccctggccgacacggcccagctggtccccgagtcctcttgctccatggacaaccaccagagcctcaacaccatcaccaagtacacccaggtgtcctggcggggaaaggccgaccagagccagtccagtcagaactccttcgagacggtgtccaccgaggtcgacctaaaggggacctgcgtgctgaagcacaagatggtggaggagtcctaccgcagccggaaatccattacctgctacgacctcagctgcaactccacgtactgcaagcccaccctgtacatgatcgtccccatccacgcctgcaacatgatgaaaagctgcctgatcgccctcgggccctaccgcgttcaggtggtgtacgagcggacctactgcatgaccggcgtgctgatcgagggcaagtgcttcgtgccggaccagtccgtcgtgagcatcatcaagcacgggatcttcgacatcgccagcgtgcacatcgtctgcttcttcgtggccgtgaagggcaacacgtacaagatcttcgagcaggtcaagaagtcctttgagagcacatgcaacgacaccgagaacaaggtgcaggggtactacatctgcatcgtcggcgggaactccgcccccatctacgtgcccaccctggacgacttccgcagcatggaggccttcaccggcatcttccgtagcccccacggcgaggaccacgacctcgctggggaggagaccgcgacctactccatcgtgggccccgctaacgccaaggtcccccactccgcgagctcagacaccctgagcctgatcgccttctcggggatcccctcgtactccagcctctccatcctgaccagctccaccgaggcgaagcacgtgttcagccccggcctgttcccgaagctcaaccacaccaactgcgacaagggcgccatccccctgatgtggaccgggatgatcgacctgcccggctactacgaggccatccacccctgcacggtgttctgcgtcctctccgggccgggcgccagctgcgaggccttcagcgagggcgggatcttcaacatcacctcccccatgtgcctggtgagcaagcagaaccgcttccggcttaccaagcagcaagtgaacttcgtctgccagcgcgttgacgtggacatcgtcgtgtactgcaacggccagcggaaggtgatcctcaccaagacgctggtcatcgggcagtgcatctacaccatcacgtccctgttcagcctcctgcccggcgtggcccactccatcgccgtggagctgtgcgtccccgggtttcacggctgggcgaccgccgccctcctggtgacgttctgcttcgggtgggtgctgatcccggcggtcaccttcatcatcctcgctatcctgaagttcatcgccaacatcttccacaccagcaatcaggagaaccgcctgaagtccgtgctccggaagatcaaggaggagttcgagaagacgaagggcagcatggtgtgcgacgtctgcaagtacgagtgcgagacatacaaggagctgaaggcccacggcgtgtcctgcccccagagccagtgcccctattgcttcacccactgcgagcccaccgaggccgcgttccaggcccactacaaggtgtgccaggtcacccaccgcttccgggacgacctgaagaagaccgtgacgccgcagaacttcacccccgggtgctaccgcaccctcaacctgttccggtacaagtcccgctgctacatcttcaccatgtggatcttcctgctcgtgctggagagcatcctgtgggccgcctccgcgagcgagacacccctcaccccggtttggaacgacaacgcccacggcgtgggttccatccccatgcacaccgacctggagctggacttcagcctgacctccagcagcaagtacacgtaccggcgcaagctcaccaaccccctggaggaggcccagtccatcgacctgcacatcgagatcgaggaacagaccatcggcgtggacgtccacgcccttgggcactggttcgacggccggctgaacctgaagaccagcttccactgctacggagcctgcacgaagtacgagtacccctggcacaccgcgaagtgccactacgagcgcgactaccagtacgagacctcctgggggtgcaacccgagcgattgccccggcgtggggaccggctgcacggcctgcggcctctacctagaccgcctgaagcccgtggggtccgcctacaagatcatcaccatacggtacagccgccgggtctgcgtgcagttcggcgaggagaacctctgcaagatcatcgacatgaacgactgcttcgtgtcccgccacgtcaaggtgtgcatcatcgggaccgtcagcaagttctcccaaggcgacaccttgctgttctttgggcccctcgagggcggcgggctgatcttcaagcactggtgcacgagcacctgtcagttcggcgacccgggggacatcatgagcccccgggacaagggcttcctgtgccccgagttcccggggtccttccgcaagaagtgcaacttcgccaccaccccgatctgcgagtacgacggcaacatggtctccggctacaagaaggtgatggccacgatcgacagcttccagtccttcaataccagcaccatgcacttcaccgacgagcggatcgagtggaaggaccccgacgggatgctccgcgaccatatcaacatcctggtgacgaaggacatcgacttcgacaacctgggcgagaacccctgcaagatcgggctccagacctccagcatcgaaggcgcgtgggggtccggcgtcggcttcaccctgacctgcctggtgagcctcacggagtgccccaccttcctgaccagtatcaaggcctgcgacaaggccatctgctacggtgccgagtcagtgaccctgacgcggggccagaacaccgtcaaggtgagcgggaagggcggtcactccggcagcaccttcaagtgttgccacggcgaggactgctccccgaacgggctccacgccgcggctccccatctggacaaggtgaacggcatcagcgagatcgagaactccaaggtctacgacgacggggcgccccagtgcggcattaagtgctggttcgtcaagagcggcgagtggatctccgggatcttcagcggcaactggatcgtgctaatcgtgctctgcgtgttcctgctgttctccctcgtcctgctgagcatactctgccccgtgcgcaagcacaagaagtcctga

SEQ ID NO: 15059 - RNA, 3408 nt, synthetic construct
  misc_feature 1..3408: note = derived and/or modified CDS sequence (opt11) from HTNV(KHF,clone:5)__LC209209.1__GP
  source 1..3408: mol_type = other RNA
atgggcatctggaaatggctggtcatggcctcccttgtttggcccgtgctaaccctacgcaacgtctacgacatgaagatagagtgcccacacacggtttccttcggcgagaactccgtcatcggatacgtcgaactacccccaatgcccctcgcagacacagcccaacttgtccccgagagcagctgctctatggacaaccatcagtcgctgaacacaataaccaaatacacccaagtcagctggcgcggaaaagcagaccaaagtcagtcaagccaaaacagcttcgaaaccgtctccaccgaggtagacctcaaaggcacttgcgtcctaaagcataaaatggtagaagaaagctaccgcagtcgcaaatccatcacatgctacgacctcagctgcaactccacctactgcaaaccaactctatacatgatcgtacccatccatgcatgcaacatgatgaaaagctgcctcatcgcactcggaccatacagggtacaagtcgtctacgaacgtacatattgtatgaccggagttctgatcgaaggcaaatgcttcgtacccgaccagtccgtagtctccataatcaaacacggaatcttcgacatagcaagcgtccatatagtatgcttcttcgtcgcggtcaaaggtaacacatacaaaatattcgaacaggttaagaaatcgttcgaatctacctgcaacgacaccgagaataaagttcaagggtactatatctgtatcgtgggcggcaacagcgcccccatttacgtaccaacccttgacgacttccgcagcatggaagcattcaccggtatcttccgctccccacacggcgaagaccacgacctagcgggagaagaaacggccacatactcgatagtagggcccgcgaacgccaaagtcccccactccgcgtcatcggacacactatcactgatagcattctccggcatcccctcctactctagcctatcaatcctcaccagctccacagaagcaaaacacgtgttctcaccaggtctattccctaagctaaaccacaccaactgcgacaagggcgcaatccccctaatgtggaccggcatgatcgaccttcccggctactacgaagccatccacccatgcacagtcttctgcgtcctctccggcccaggcgcctcctgtgaagccttctccgaaggcggcattttcaacatcacatcaccaatgtgccttgtctctaagcagaaccgtttccgccttaccgaacagcaagtcaatttcgtctgccaacgagtcgatgtcgatattgtcgtctactgtaatggccaaagaaaagtcatcctcacgaaaaccctagtcataggacagtgcatttacaccatcacttcgctttttagcttactcccgggtgttgcccacagcattgccgtcgaactctgcgtaccaggcttccacggctgggcaaccgctgccctactcgtcacattttgtttcggatgggtactcattcctgctgttacctttatcatcctagccatactcaagttcattgccaacatattccatacgagcaaccaggagaaccgcctcaaatcagtcctgagaaaaatcaaagaagagttcgagaaaactaaaggctccatggtctgcgacgtctgcaagtacgaatgcgaaacttacaaagaactaaaagcccatggagtctcctgcccacaatcacaatgcccttattgtttcacccattgcgaaccaaccgaagccgcatttcaagcgcactacaaggtatgccaagtcacccaccgattccgcgacgacctcaagaaaaccgttactccccagaactttacccccggatgctaccgcacactcaaccttttcagatacaaatcccgatgctacatatttaccatgtggatcttcctcctagtcctagaatccatcctatgggcagcctcagcgtcagaaacacccctaaccccagtctggaacgacaacgctcatggcgttggcagtattcccatgcacacagaccttgaactcgactttagccttacctcctcttctaaatacacctatagacgcaaactcacgaacccccttgaagaagcacagtccatcgatctacatatcgaaatcgaggaacaaacaatcggggtagacgtccacgccctgggacactggttcgacggacgcctcaacttaaagacgagcttccactgctacggagcctgtaccaaatacgaatacccatggcacactgcaaaatgccattacgaacgcgactaccaatatgaaactagctggggctgcaatcccagcgattgccccggcgtagggacgggctgcaccgcctgcggcctctatctcgaccgcctcaagccggtcggatcagcatacaaaataataaccatccgctattcgaggagagtctgcgttcaattcggcgaagaaaatctctgcaagatcattgacatgaacgattgcttcgtaagccgtcacgtcaaggtatgcataataggaactgtaagcaagttctcacaaggcgacacactcctcttctttggacccctagaaggaggcggtcttatattcaaacactggtgcacctccacgtgccagttcggcgaccccggcgacattatgtcgccccgggataaaggcttcctctgcccagagttcccagggagcttccgcaagaaatgcaacttcgccaccaccccaatctgtgaatatgacggaaatatggtctcaggatacaagaaagtcatggccacaatcgattcctttcaatccttcaacactagcacaatgcacttcaccgacgaacgaatcgaatggaaagaccccgacggaatgcttagagaccacatcaacatcctcgtaacgaaagacatcgacttcgacaacttaggcgaaaacccctgcaaaattggcctccaaacctcctccatcgaaggcgcttgggggagcggagtcggcttcacccttacatgccttgtatccctaacagaatgcccaacctttctgacctccatcaaggcatgcgataaggccatctgctacggagccgaaagtgttaccctcacccgcggacagaacaccgttaaagtctctggtaaaggaggccactccggcagcactttcaaatgctgccacggagaagactgcagccccaatggcctccacgctgcagcacctcacctagacaaggttaacggaatatcagaaatcgaaaattccaaagtttatgacgacggggcaccacagtgcggtatcaaatgctggttcgtcaaatcaggcgagtggatttccggcatcttctccggaaattggatagtcctcatagtcttatgcgtgtttctgctattctccctagtactactgtcaatcctctgccctgtacgcaaacacaagaaatcctga

SEQ ID NO: 15060 - RNA, 3405 nt, synthetic construct
  misc_feature 1..3405: note = derived and/or modified CDS sequence (opt11) from HTNV__D00376.1__GP
  source 1..3405: mol_type = other RNA
atgggcatctggaagtggctggtgatggccagcctcgtctggcccgtgctgaccctgcgcaacgtgtacgacatgaagatcgagtgcccgcacaccgtctccttcggggagaacagcgtgatcggctacgtggagctaccgcccatgcccctggccgacacggcccagctggtccccgagtctagctgctccatggacaaccaccagagcctcaacaccatcaccaagtacacccaggtgtcctggcgggggaaagccgaccagagccagtccagccagaactccttcgagacggtgagcaccgaggtcgacttgaaggggacctgcgtgctgaagcacaagatggtggaggagtcctaccgcagccggaagtccatcacgtgctacgacctcagctgcaactccacctactgcaagcccaccctgtacatgatcgtccccatccacgcctgcaacatgatgaagtcctgcctgatcgctctcgggccctaccgcgtccaggtggtgtacgagcggacctactgtatgaccggcgtgctgatcgagggcaagtgcttcgtgccggaccagtccgtcgtgagcatcatcaagcacgggatcttcgacatcgccagcgtgcacatcgtctgcttcttcgtggcggtgaagggcaacacgtacaagatcttcgagcaggtcaagaaatccttcgaaagcacgtgcaacgacaccgagaacaaggtgcaggggtactacatatgcatcgtcggcgggaactccgcccccatctacgtacccaccctggacgacttccgctcaatggaggccttcaccggcatcttccggagcccccacggcgaggaccacgacctcgccggggaggagaccgcgacctacagcatcgtaggcccggccaacgccaaggtcccccactccgccagctcggacactctgagcctgattgccttctccgggatccccagctactccagcctctccatcctgacatcgtccaccgaggcgaagcacgtgttcagccccggcctgttcccgaagctcaaccacaccaactgcgacaagggcgccatccccctgatgtggaccgggatgatcgacgtgccccgttactacgacggcatccaccccttcacggtcttctgcgtgctgtccgggccgggcgccagctgcgaggccttcagcgagggcggcatcttcaacatcacctcccccatgtgcctcgtcagcaagcagaaccggtttcgcctgaccgagcagcaggtcaacttcgtgtgccagcgggtggacgtagacatcgtggtatactgcaacggtcagcgcaaggtcatcctgaccaagacgctcgtgatcgggcagtgcatctacaccatcacctccctgttcagcctgctccccggcgtggcccactccatcgcggttgagctgtgcgttcccggattccacggctgggccaccgccgccctgctcgtgacgttctgcttcgggtgggtccttatcccggccgtgaccttcatcatcctggcgatcctcaagttcattgccaacatctttcacaccagcaaccaggagaaccggctgaagtccgtgctgcgcaagatcaaggaagagttcgagaagaccaagggcagcatggtctgcgacgtgtgcaaatacgaatgcgagacgtacaaggagttaaaggcccacggcgtgtcctgcccccagagccaatgcccctactgcttcacccactgtgagcccaccgaggccgccttccaggcgcactacaaggtctgccaggtgacccaccggttccgcgacgacctaaagaagaccgtgaccccgcagaactttacccccgggtgctatcggaccctgaacctcttccgctacaagtcccgctgctacatcttcaccatgtggattttcctgctggtcctcgagagcatcctgtgggccgcgtccgccagcgagactcccctgaccccggtgtggaacgacaacgcgcacggcgtggggtccatccccatgcacaccgacctcgagttggacttcagcctgacatccagcagcaagtacacgtaccgccggaagctgaccaatcccctcgaggcacagtccatcgacctgcacatcgagatcgaggagcagaccatcggcgtcgacgtgcacgccctggggcactggttcgacggccgcctcaacctgaagaccagcttccactgctacggcgcctgcacgaagtacgagtacccctggcacaccgccaagtgccactacgagcgcgactaccagtacgagacctcctggggctgcaacccgtcggattgccccggctgcgggaccgggtgcacggcgtgcggcctgtacctcgaccggctgaagcccgtggggtccgcctacaagatcatcaccatccgctacagccggcgcgtctgcgtgcagttcggcgaggagaacctgtgcaagatcatcgacatgaacgactgcttcgtgtcccggcacgtcaaggtttgcatcatcgggaccgtcagcaagttctcccagggcgacaccctcctgttcttcgggcccctggagggcggcgggctcatcttcaagcactggcgcacgtcaacgtgccagttcggcgacccgggggacatcatgagcccccgggacaagggcttcctgtgtcccgagttccccgggtccttccgcaagaagtgcaacttcgccaccaccccgatctgcgagtacgacggcaatatggtctccggctacaagaaggtgatggccaccatcgacagcttccagtccttcaacaccagcaccatgcacttcaccgacgagcggatcgagtggaaagaccctgacgggatgctgcgcgaccacataaacatcctcgtgacgaaggacatcgacttcgacaacctgggcgagaacccctgcaagatcgggctgcagacctccagcatcgagggcgcctgggggtccggggtcggcttcaccctgacatgcctcgtgagcctgacggagtgccccaccttcctcaccagcatcaaggcgtgcgacaaggccatctgctacggggccgagtccgtgaccctgacgcggggccagaacaccgtcaaggtgtccgggaagggcgggcattccggcagcaccttcaagtgctgccacggcgaggactgctccccgaacgggctgcatgccgccgcgccccacctcgacaaggtgaacggcatcagcgagatcgagaacagcaaggagtacgacgacggggcgccccagtgcggcatcaagtgctggttcgtcaagagcggcgagtggatctccgggatcttcagcggcaactggatcgtgctgatcgtcctgtgcgtgttcctcctgttctccctggtgcttctgagtatactgtgccccgtccgcaagcacaagaagtcctag

SEQ ID NO: 15061 - RNA, 3417 nt, synthetic construct
  misc_feature 1..3417: note = derived and/or modified CDS sequence (opt11) from LANV(510B)__AF005728.1__GP
  source 1..3417: mol_type = other RNA
atggaaggatggctctttacaatactcggcgtatgttatataatgaccacggttctacccaaaaccatctacgaattaaaaatggaatgcccacacacagtaggcctcggtcaaggatacatcatcggctccgcggaactagggctcatagacatcgccacagtccccgaaatcaaacttgaatcctcctgcaacttcgacctgcacaccaccagctcaacccagaaatcattcacccagctcgaatggcgcaagaaagcagagaccaccgataccacacaagctgctagcacaacattcgaagcccaaaccaaaactgtaaacataaggggcacctgtatactagcgtccgacctttacgacacccttaaacgcgttaagaaaacagttctctgctacgacctgacatgcaaccaaacccagtgtcagcccacagtctacctcatcacccccgtcggaacttgcatgtccatacgcagctgtatggccaatctcctatccaacagaatccagatcacgttcgagaaaacacactgcgtcaccggacaactcgtggaaggacaatgtttcaacccgagtcactcgcttaccctctcccagcccccgcacacatacgacgtcgtcaccctccccaccacatgctttttcacagccaagaaagccgaccaatacaaaatagtcaaaaccttcgaaggcattatctccaaaacaggctgcacagaaaacagcatccaagggtactacgtctgcttcataggatcacactccgaacccctcatcatacccacacttgaggacatccggtccgcagagctcgcctcacgcatgctcctacaccctcgaggcgaggatcacgaccccctacaaaacgcacaagctgtcctccgaatcgtcggtcctataaccgccaaagtaccctcttccagcagcaccgaaacactgcaaggaatcgcatttgccggagtgccgatgtactcctccttctccacactcgtacggaacgccgaccctgagtatgtattcagccctggcataattccagaatccaaccaaagcgtgtgcgacaagaaaaccctaccactgacctggaccggatacctaccaatctcaggcgagatggaaaaagtcaccggatgcacagtcttctgcaccctcgcaggtcccggagcgaattgtgaagcctattcagagtctggaatattcaacatctcttcacctacttgcctagtaaacaaagtccaacggttcagaggctcggaacagaaaatcaacttcatgtgccaacgaatcgacaacaacgtcgtcgtctattgcaacggccagaagaaagtaattctcactaaaacactcgtcatcggacaatgcatatatactttcacctccctcttctctctcatgcccgacgtcgcccactcgctagcagtggaactatgcgtacctggcctgcacggttgggccaccattgccctactatccactttctgcttcggctggctgctcataccaggcatcacactaatcgtcctcaaaatactcaaaatactcacctattcatgttcccactacagcagcgaaagcaaattcaaaatgatcctagaaaaagttaaagtagaataccagaaaacaatgggctctatggtctgtgacatctgtcatcatgaatgcgaaactgtcaaagaactcgagtcccacaaacaaagctgcgtcgaaggccaatgcccgtactgtatgacagtcactgaagccacccaaagcgccctgcaagcccacttcagtatatgcaaactcaccggacgatttcacgaagccctaaagaaatcccttaagaaacccgaagtacaccgaggatgctaccgaaccctcggagtctttcgctatcgaagtagatgctacgtcggcctcgtttggggatgcctcctgacaatagaacttgttctctgggccgcaagcgccgaaacacccttactagaaccaggatggagcgacaccgcccacggcgtaggcgaactcccactcaaaaccgacctggaactagacttcagccttccctcctcaagctcctacagctaccgccgccgcctcactaaccctgccaacaaagaagaatcacttccattccactttcaaatggaaaaacaagtcatacacgccgaaatacaatcactcgggcactggatggatgcaactttcaacattaaaactgcattccactgctacggggcctgcaaacaatacagctacccatggcagacagcaaaatgctttttcgagaaagattaccaatacgaaaccggatggggctgcaaccccggggactgccccggggtcggcacaggatgcacagcctgcggaatctacttagacaaactaaaatcggtcggaaaagcatacaaagtcatctctctcaaatacacacgaaaagtctgcatccaactcggcaccgagcaagtatgtaaacatatcgacgcaaacgactgtctcgtaaccccctccgtcaaagtatgcatcatcgggacagtctccaaaattcagccatcagacaccctactcttcctaggccccctcgaacaagggggagtcatcctgaaacaatggtgcacaacctcttgcacattcggcgacccaggcgacatcatgtccaccacatcaggaatgaggtgccccgagcacacgggatccttccgtaaaatctgcggatttgcaaccacgcccgtgtgcgaataccaaggcaatacaatttccggttaccagcgacttatggccaccaaggactccttccaatccttcaacctcaccgatccccacataaccagctccaaacttgaatggatcgaccccgacggcaacactcgtgaccacgtcaacctcatcctaaaccgagatgtgtcgttccaagacttatccgacaacccttgcaaggtcgacctacatacccagtccatagacggcgcctggggatcgggcgtcggcttcaccctcacttgtgtcgtaggtctcacagagtgcccctcattcatcacctcaatcaaagcgtgtgacctcgctatgtgctacggctcaaccgtagcgacacttgctcgcggatccaacaccgtcaaggtcgtaggcaagggtggacactcaggctcgtccttcaaatgttgccacgactcagactgctcgtcagaagggcttatggcatcggcgccacacctagagcgagtgacaggctttaatcagattgactccgacaaagtttacgacgacggcgcaccgccctgctcattcaaatgctggttcactaaatccggcgaatggctcctcggcatacttaatgggaactggatcgtcatagcagtgctcgtcataatactcataatctccattatactcttttccttcctgtgcccccggcgctcacataagaaaaacgtctaa

SEQ ID NO: 15062 - RNA, 3402 nt, synthetic construct; identical to SEQ ID NO: 11776
  misc_feature 1..3402: note = derived and/or modified CDS sequence (opt11) from LQUV(Longquan-Rs-32)__JX465402.1__GP
  source 1..3402: mol_type = other RNA

SEQ ID NO: 15063 - RNA, 3402 nt, synthetic construct
  misc_feature 1..3402: note = derived and/or modified CDS sequence (opt11) from LQUV(Longquan-Ra-25)__JX465397.1__GP
  source 1..3402: mol_type = other RNA
atgaagtccatcctgcttatcctgctgctcggccaggtgcgcagcaaggccaccaacgagatcaagctggagtgcccccacgaccagcgggtcgaaacagggttcagccatggcttcaccgacctgtccccgatcctctacactaaaggcctgttcaccaagcacctggagaacaactgccccttcgacatctccatcatcaaccgcctcgttcgggacgtgcgcatctccacctggcaggccaaaagtacgaacaccgacgcgaccgtcgcctccgccaccagcttcgagacgaaggacacggacgacaagctggcaggcgtctgcggctttttcgacgacatcaccaagcccaagcagggccagcgtaaggccatcatctgctacgacctgtcctgcaaccagacccactgccttcccaccctgcacctgattttcccgcaacagttctgccagtcactcaagcagtgctccatcaacgcgtacgaccataagatcctcatcaccatctccctgtcattctgtcccgagggcctcatcatcgggggcaactgcatcgtgccagtcctggcacagagtcagctgctccacaaccacatgacctacaacatcaaggtgacctgcttcttcgagtactccatggcccgcgagagcctggacaacaaattcctggaggagatgaaccggctcgtgctggggcgcaactgcgagaaaactgaatacctgggcgggtacgtctgcttccttgccggctacggcaccgcgatccacgtgccctacgacaacacctacctgtccggggccgtggtcaacagcatgaaggccaacctgcacggcgaggaccacgaccggctcaaactgggggataccagcgccgtgatcgccggcaacctgaagttcgtaatcgacagcacggcgccggaaaagtcctatcagggcgaatgcttcaccgggcacatgggttacaccagcctctatttctaccccgtccgctccaaggggaagtacgtgaccatcctgacgaagggcgtaatccccgtcatcaacaagacgacctgtatgcccaagattgtgccgctagtgtggaccgggatggtcgagatgcggggcatcgaggagaagctcgaagcctgcaccatgcactgcatcatggtgggcaacggggcgacctgcgaggccttctccgccaccggcatcttcgacatcaaaagcacaacgtgccagatcgggaagacgcacaagtaccgccggaccgaggaccagatcacgttcacgtgccaggatctgaacaaggacatctccgtgatctgtaacggcgaaaacatcaccgtccccgtcaagagcctgatcgtggggcaatgtatctacaccatcacctccatcttcagcatcttccccgccaccgcccactccatcgccacggaaatgtgcgtgcagggcatacacggctggctcaccatcatcattttcttcaccttttgctttgggtggctgctgatccccattctaacctgcctcatcataaacacgatcgcctatagcttgatcaccctcgcctacttcaagaatggcgcgcgccttgggaacctgatcaagcggatgaagtccgagttccagcgcaccattggcaacaccacgtgcaacatctgcctccgggagtgcgagagcgagtccgagtacaagagccacgaggaactgtgcaagaacggttcctgcccgtactgcatgaaggacatcggcgtgagccaggtcctgctgaacgagcattacaacgcgtgtatgctcatcgaccgctatgagaagcggctgacccacaccctgaaccagacgcccctttactcccgcaaggtgcggaaaatccagagcttccgctaccgcaaccggtgcttcatcctgaccgtgtggatcatcctgctcacggtcgagtccctgatctgggccagcagcgccgaggacatcaagcctgcccccaagtggcagaacaccgcccacggcatcgggaccatcaagctgaactccgactacgagctcgacttcagcgtggtggctggctccgagttcacgcacaagcgcatgctgcagagcccggagtcggggaagaagaacatccccttcaccgtctacctaagcgagcagctgatcacctccaccgtgcagatcctgggcaactggatggacgccgagatcaacgtcaagagcgtgttccactgctacggcacatgtaagaagtactcctacccctggcagagcagtccatgccacaaagaggtggacttcgagttccagagctcctgggggtgcaacccgataagctgccccggcatcaactccgggtgcaccgcctgcggcacctacgtggacaagttgaagaccatcgcgaaggcctaccgcatcatcactgtcaagtacagccgcaaagtctgctaccagatcgggaccaagaaggcctgcaagaccctcgagtccaacgactgcttagtgagcaacggcgtcaagatctgcgccatcggcaccatcagcacgctgcagacagggatgaccctcgtgttctttggccccctgaacgggggagccctactcatcaaggattggtgcatctccagctgtaaattcggggaccccggcgacatcatgcagatctccaacaacatcacgtgcccgagcttcgatggcaccatgcagcgggtgtgccgcttcgggctggagccgatgtgctcctacagcggcaacaagatttccggggtaaagcgggtgctggagaccaaagatagctacctctccgtgaacctgactaagcccaaactggtcggaagcaccctcctgtggaactccttggatagctccatcaaggaccacatcaacatcgtggtgagcaacgatatcgacttcgaagatctcgcggagacgccgtgcaaggtcaccatcaagaacctgaagatcgagggggcctggggctcaggcatcggaatcaaactgcactgcgaggtgagcctctctgagtgttctgagtacctgaccaccatcaaggtgtgcgacaacgccatctgctacggcgggaacgtcgcccacctgtcccgcggcctcaacaccgtgatcatcaagggggccggcggccacagcgggagctccttcaagtgctgccatgaaacgagctgctcagatatcggcttcaaggcggaggcgccccacctggcccggatcgttgacgacgggatcaccaccagcatgtcctacagcgacggcgcccccgaagccggcattatctcctggatctacaaggtcgccgagtggatcaaggggatgttcaacggcaactggttcgtgctgatcatcatgatcctcttcctgatcatcagcattgtgctgctaatcttcctgtgccccgttaagaagtacaagtga

SEQ ID NO: 15064 - RNA, 3402 nt, synthetic construct; identical to SEQ ID NO: 11778
  misc_feature 1..3402: note = derived and/or modified CDS sequence (opt11) from LQUV(Longquan-Ra-5)__JX465398.1__GP
  source 1..3402: mol_type = other RNA

SEQ ID NO: 15065 - RNA, 3402 nt, synthetic construct; identical to SEQ ID NO: 11779
  misc_feature 1..3402: note = derived and/or modified CDS sequence (opt11) from LQUV(Longquan-Ra-56)__JX465399.1__GP
  source 1..3402: mol_type = other RNA

SEQ ID NO: 15066 - RNA, 3402 nt, synthetic construct
  misc_feature 1..3402: note = derived and/or modified CDS sequence (opt11) from LQUV(Longquan-Ra-90)__JX465400.1__GP
  source 1..3402: mol_type = other RNA
atgaagtccatcctgctcatcctgctgctcggccaggtgcgcagcaaggccaccaacgagatcaagctggagtgcccccacgaccagcgggtcgagaccgggttcagccacggcttcacggacctgtccccgatcctctacaccaaggggctattcactaagcacctggagaacaactgccccttcgacatcagcatcatcaaccgcctcgtccgggacgtgcgcatctccacctggcaggccaagagcacgaacaccgatgcgaccgtcgcctccgccaccagcttcgagacgaaggacaccgacgacaagctggccggcgtgtgcgggttcttcgacgacatcaccaagcccaagcagggccagcggaaggccatcatctgctacgatctgtcctgcaaccagacccactgcctccccacgctgcacctgatcttcccgcagcagttctgccagagcctcaagcagtgctccatcaatgcgtacgaccacaagatcctgatcaccatcagcctgtccttctgtcccgagggcctcataatcgggggcaattgcatcgtgcccgtcctggcccagagtcagctgctccacaaccacatgacatacaatatcaaggtgacctgcttcttcgagtactccatggcccgcgagagcttggacaacaagttcctggaggagatgaaccggctcgtgctggggcgcaattgcgagaagacggagtacctgggcgggtacgtctgcttcctcgcaggctacggcaccgcgatccacgtgccctacgacaacacctatctctccggtgccgtggtcaacagcatgaaggccaacctgcacggcgaggaccacgaccggctcaagctgggggacacctccgccgtgatcgccggcaacctgaaattcgtgatcgacagcacggcgccggagaagtcctatcagggcgagtgcttcaccgggcacatgggctacaccagcctctacttctaccccgtccgctctaaggggaagtacgtgaccatcctgacgaagggcgtgatccccgtcatcaacaagacgacctgcatgcccaagatcgtgccgctggtgtggaccgggatggtcgagatgcggggcatcgaggagaagctcgaggcctgcaccatgcactgcatcatggtgggcaacggagcgacctgcgaagccttctccgccaccggcatcttcgacatcaagagcaccacgtgccagattgggaagacccacaagtacagacggaccgaggaccagatcaccttcacgtgccaggacctgaacaaggacatctccgtgatctgcaacggcgaaaatatcaccgtccccgtcaagtccctgatcgtggggcagtgcatctacaccatcacctctatcttcagcatcttccccgccaccgcccactccatcgccacagagatgtgcgtgcagggcatccacggctggctcaccatcatcatcttcttcaccttctgcttcgggtggctgctaatccccatcctgacctgcctcatcatcaacacgatcgcctacagcctgatcaccctcgcctacttcaagaacggcgcgcgcctggggaacctgatcaagcggatgaagtccgagttccagcgcaccatcggcaacaccacatgcaacatctgcctccgggagtgcgagagcgagtccgagtacaagagccacgaggagctgtgcaagaacgggtcctgcccgtactgcatgaaggatatcggcgtgagccaggtcctgctgaacgagcactacaacgcctgcatgctcatcgaccgctacgagaagcggctgacccacaccctgaaccagacacccctctactcccgcaaggtgcggaaaatccagagcttccgctaccgtaaccggtgcttcatcctaaccgtgtggatcatcctgctcaccgtcgagtccctgatctgggccagcagcgccgaggacatcaagcccgcccccaagtggcagaataccgcgcacggcatcgggaccatcaagctgaactccgactacgagctcgacttcagcgtggtggccggctccgagttcacgcacaagcgcatgctgcagagcccggagtctggaaagaagaacatccccttcaccgtatacctgagcgagcagctcatcacctccaccgtgcagatactgggcaactggatggacgctgagatcaacgtcaagagcgtgttccactgctacggcacgtgcaagaagtactcctacccctggcagagctccccctgccataaggaggtggacttcgagttccaaagctcctgggggtgcaaccccatctcctgccccggcatcaactccgggtgcaccgcctgcggcacctacgtggacaagctgaagaccatcgcgaaggcctaccggatcatcacggtcaaatacagccgcaaggtgtgttaccagatcgggaccaagaaggcctgcaagaccctcgagtctaatgactgcctcgtgagcaacggcgtcaagatctgcgccatcggcacgatcagcacgctgcagaccgggatgaccctcgtgttcttcggtcccctgaacgggggcgccctgctcatcaaggactggtgcatttccagctgcaaattcggggaccccggcgacatcatgcagatctccaataacatcacgtgcccgagcttcgacggcaccatgcagcgagtatgccgcttcgggctagagcccatgtgctcctacagcggcaacaagatctccggggtcaagagagtgctggagacgaaggacagctacctctccgtgaacctgaccaagcccaagctggtcggcagcaccctcctgtggaactccctggacagctccatcaaggaccacatcaacatcgtggtgagcaacgacatcgacttcgaggacctcgcggagacgccgtgcaaggtcaccatcaagaacctgaagatcgagggggcctggggctccggcatcgggatcaagttgcactgcgaggtgagcctatccgagtgcagcgagtacctgacaaccattaaggtgtgcgacaacgccatctgctacggcgggaacgtcgcccacctgtcccgcggcttaaacaccgtgatcatcaagggggccggcggccacagtgggagctctttcaagtgctgccacgagacgagctgctccgacatcggcttcaaggcggaagcgccccacctggcccggatcgtggatgacgggatcaccaccagcatgtcctacagcgacggcgcccccgaggccggcatcgtctcctggatttacaaggtggccgagtggatcaaggggatgttcaacggcaactggttcgtgctgatcatcatgatcctcttcctgatcatcagcatcgtcctgctcatcttcctgtgccccgtgaagaagtacaaatga

SEQ ID NO: 15067 - RNA, 3423 nt, synthetic construct; identical to SEQ ID NO: 11781
  misc_feature 1..3423: note = derived and/or modified CDS sequence (opt11) from NYV(Rhode Island-1 (RI-1))__U36801.1__GP
  source 1..3423: mol_type = other RNA

SEQ ID NO: 15068 - RNA, 3423 nt, synthetic construct; identical to SEQ ID NO: 11782
  misc_feature 1..3423: note = derived and/or modified CDS sequence (opt11) from NYV(New York-1 (NY-1))__U36802.1__GP
  source 1..3423: mol_type = other RNA

SEQ ID NO: 15069 - RNA, 3423 nt, synthetic construct; identical to SEQ ID NO: 11783
  misc_feature 1..3423: note = derived and/or modified CDS sequence (opt11) from NYV(New York-2 (NY-2))__U36803.1__GP
  source 1..3423: mol_type = other RNA

SEQ ID NO: 15070 - RNA, 3447 nt, synthetic construct
  misc_feature 1..3447: note = derived and/or modified CDS sequence (opt11) from PUUV(K27)__L08754.1__GP
  source 1..3447: mol_type = other RNA
atgggtgagctctcaccggtctgcctatatctcctcctccagggcctgctgctttgcaacaccggagccgcccgcaatctaaacgaactcaaaatggaatgcccccacacaatccgactcggacaaggcctagtcgtcggatccgtagaactacccagcctccccatccaacaagtcgagacactcaaactcgaatccagttgcaatttcgacctccataccagcaccgccggccagcaatccttcacaaaatggacctgggaaataaaaggcgacctcgcggagaacacacaagcctctagcacatctttccaaaccaaaagcagcgaagttaacctccgaggcctgtgccttatccccaccctcgttgtcgaaaccgcagcacgcatgcgcaaaaccatagcatgctacgacctcagctgcaaccaaacagtctgccaaccaacagtctacctaatgggccctattcaaacatgcatcacaaccaaaagctgcctcctcagcctcggcgaccaaagaatacaagtaaactacgagaaaacgtactgcgtatctggtcagctcgtcgaaggcatctgcttcaaccccatacacacaatggcactttcacaaccctcacacacttacgacatcatgaccatgatggtccgatgcttcctggtgatcaagaaagttacctcaggtgacagcatgaaaatagagaaaaacttcgaaacactcgtccagaaaaacggctgcaccgccaacaacttccaaggatactatatctgcctgataggatcatcatcagaaccgctgtacgtcccggccctagacgactaccgatctgccgaagttctttctcgcatggccttcgcaccacacggcgaagatcacgacatagagaaaaacgcagtcagcgcaatgaggatcgcaggcaaagtaacgggcaaagctcccagcacagaaagctctgataccgtacaggggatcgcattcagcggcagcccactttacacctccactggcgtattaacaagcaaggacgaccccgtgtacatctgggccccaggcattatcatggaaggtaaccactccatatgtgaaaagaaaaccttgccgctcacttggaccggatttatctctctccccggcgaaatcgagaaaacgacccaatgcacagtcttttgtaccctagcaggaccaggcgccgactgcgaagcatacagcgaaaccggcatcttcaacattagcagccctacttgctccatcaaccgcgttcaacggttccgaggctcggaacagcaaataaaattcgtctgccaacgcgtagacatggacataaccgtctactgcaacgggatgaagaaagtcattcttaccaaaaccctagtgatagggcaatgtatatataccttcacatctatcttctcactcatcccaggagttgcacattccctcgccgtcgaactctgtgtacccggcctacatggctgggccaccatgctcctactactcaccctatgcttcggctgggtcctaatacccaccataaccatgatccttctaaaaatactcatagctttcgcctacctatgctccaaatacaacaccgactcaaaattccgaatcctcatagaaaaagtcaaacgagagtaccagaaaaccatgggatccatggtctgtgaggtatgccaatatgaatgtgagaccgcaaaagaacttgagtcccatcgcaaatcatgctcaatcggctcatgcccctactgcctgaacccatcggaggcaaccacaagtgccctccaggcacacttcaaagtatgcaagctcacttcacgcttccaagaaaatctgcgcaaaagcctaacagtctacgaacccatgcagggctgctaccgaacactatccctcttccgataccgctcgcgtttcttcgtaggcctcgtctggtgcgtcctcctcgtgctagagctaatagtatgggccgcatcagccgaaacccaaaatcttaacgccggctggacagacactgcgcacgggtccggcatcataccgatgaagaccgaccttgaacttgatttcagcctgccgagctctgcctcatacacttaccgacgccaattacaaaaccccgcaaacgagcaggagaaaatcccattccacctccaattatccaaacaagtcatacacgccgaaatacaacacctgggccactggatggacgcgacctttaacctcaaaacggctttccactgctacggaagctgcgaaaagtacgcatacccgtggcaaaccgccgggtgcttcatcgagaaagactacgaatacgaaacaggttggggctgtaacccgcccgactgccccggcgtagggacaggctgcaccgcctgcggagtatacctggacaaactcaaatctgtcggaaaagtattcaaaatcgtaagccttagatacacgcgcaaagtttgcatccaactcggtacagaacaaacatgcaaaacagtcgattctaatgactgccttatcaccacctcagtaaaagtatgtctcatcggcaccatttcaaagttccagccctccgataccctacttttcttaggcccgctacaacaaggagggctaatctttaaacaatggtgtaccacaacttgccaattcggggaccctggtgatatcatgtctactccaaccggaatgaaatgcccagaactaaacggatcattccgcaagaaatgcgcatttgctaccacgcccgtatgccaattcgacgggaacaccatatccggctacaaacgcatgatcgcaacaaaagactcattccagtccttcaacgtaacggaaccccacatcagcacaagtgccctcgaatggatagaccccgactctagtctcagagaccacatcaacgtcatagtctcacgagatctatcattccaggatctctcggaaacgccatgccagatagacctagctacggccagtatagacggagcatggggctctggcgttggattcaacctagtctgcaccgtatctctgacagaatgctccgcattcctgacttccatcaaagcatgcgacgctgccatgtgctatggctccaccaccgcaaacctagtccggggtcagaataccatacacatcgtcggaaaaggaggtcactccggatctaaattcatgtgttgccacgatacgaaatgctcgtccacagggctagtggcagcagcaccccacttggaccgagtcaccggctacaaccaggccgactccgacaaaatattcgacgacggcgcccccgaatgcgggatgagctgctggtttaagaagtccggcgaatggattcttggcgtcctgaacggaaactggatggtagttgcagtcttagtcgtcctcctcatactctcaatactactcttcaccctttgctgtccccgccgaccatcgtaccgaaaagagcataagccctga

SEQ ID NO: 15071 - RNA, 3447 nt, synthetic construct
  misc_feature 1..3447: note = derived and/or modified CDS sequence (opt11) from PUUV(13891)__U22418.1__GP
  source 1..3447: mol_type = other RNA
atgggtaagatcatacccgtctgtctctacctcctatttctatgcctcctcctttggaatcgcggggacgcccgtaaccttaacgaactcaagatggaatgcccgcacacaataggcctcgggcaagggttagttatcggctccgtcgaactacccccagtcccgctcacccaagtggaatccctcaaactagaatccagttgcaatttcgacctacatacctcgacctctagccagcaatctttcaccaagtggacatgggaaatcaaaaatgaccttgccgaaaacacacaagcgagttcgacctcgttccaaaccaaaagctcagaaataaacctcagaggactatgtctcataccgcccctcgtaatcgaaacggccgccagaacaagaaaaacgatcgcctgcttcgacctcagctgcaaccaaaccgcatgccaacctacagtctttctcataggcccaatccaaacctgcataaccaccaaaagctgccttctaggtctgggcgaccagcggattcaagtaaactacgagaaaacgtattgtgtgtcaggacaactcgtcgaaggcgtttgcttcaaccccgtgcacaccatggccctttcccaaccgtcacacacctatgacatagtgacggtcatggtacgttgcttcttaatagtcaaaaaggtaagcaccggagactccatgaagttggaaaagagcttcgaaaccctagtacagaaaacaggatgcaccggaaacggtttccaaggatactatgtttgcctcgtaggtagcagctccgaaccgctttacatacccaccctagacgactaccgctcagctgaaatactctcccgaatggccttcgccccgcacggagaagaccacgacgtcgaaaagaatgccatctccgccatgcgcatcgttggcaaggtcaccggaaaggccccctccacggaatcctcggacaccatccaaggaatcgcgttctcgggaaaccccctttacacgagcaccggcgtcctcacggctaaggacgaccctgtatatatctgggcccccggaataatcatggaaggcaaccactcagtatgcgacaagaaaaccctacccctaacctggaccggttttatccccctaccaggcgaaatagagaaaacgacccaatgcacggtcttctgcacactcgccggaccgggcgccgactgtgaagcatattccgaaaccggcatcttcaacataagtagtcctacctgcctaataaaccgggttcaacgatttcgcggcgctgaacaacaaatcaaattcatctgccaacgagtagatatggacataaccgtctattgtaacggccttaagaaagtgattctcaccaaaactctcgtcataggccaatgtatttacaccttcacatcaatattctccctgatccccggcgttgcacactcccttgcggtcgaactctgtgttcccggtctccacggatgggccaccatgctactcctattgaccttctgttttggatggatcctaattcccttcttttccatgatcttgctcaaaatattaatagccttcgcatacctttgctccaaatacaataccgattcaaaattcaaaattctaattgaaaaagtcaagcgagaatatcagaaaaccatggggtccatggtctgcgaagtgtgccaatacgaatgcgaaaccgcaaaagaactagagtcccaccgtaaatcatgcccaatcggctcatgcccctactgcctaaacccagcagaagccacaacatcagcgctgcaagcgcatttcaaagtatgtaaactgaccagccgtttccaagacaacctaagaaaaagcctgggagcatacgaacccaaacaaggctgctaccgcacactcagcctcttccgctaccgctcgcgcttcttcgtgggcttcaactggtgtcttctcctcgtccttgaactaatagtctgggcggcctcagccgaaactcaatccctcaattccggctggaccgacaccgcacacggaagtgggataatcccgatgcgcacagacctagaactagacttttcgctacccagcagcgccagctacacttatcgccgccaactacagaaccctgccaacgaacaagagaaaatccccttccatctgcaaatctccaaacaggtgatccacgccgaaatccaacacttaggccattggatggacgggactttcaacctaaaaaccgccttccactgctacggatcttgcgaaaaatacgcatacccatggcagaccgccggctgcttcatcgaaaaggactacgagtatgaatcgggttggggctgcaatccacccgactgcccaggcgtaggcaccggctgcaccgcttgcggtgtctacctagacaaactgaaatcagtcggcaaagcctttaaaatagtaagcctacgttatacgcgcaaagcctgcatacaacttggtaccgaacagacctgcaaatccgtagactccaacgactgccttgtaactacctccgtcaaagtgtgcctcatcggcaccgtaagcaagtttcaaccatcggacacgctcctcttcttaggcccccttgaacaagggggcctcattttcaagcaatggtgtaccacgacctgccagttcggagacccgggcgatattatgtcaacacccgtcgggatgaaatgcccagaactatcaggatcctttcgcaagaaatgcgcctttgccaccaccccagtctgtcaattcgacggtaacactctctccggatataaacgcatgatcgccaccaaagactcctttcagtcattcaacgtcacagaaccccacataagcgcatctagcctcgaatggatcgacccagactcctcactacgcgaccacatcaacgtcattgtaggccgtgatctgtcctttcaagacctatcggaaacaccttgtcaagtcgaccttgctactacctcaatcgatggcgcctggggctcaggggttggcttcaacctcgtatgctccgtctcactcaccgaatgctcaaccttccttacctcgatcaaagcatgcgacagcgcaatgtgctacggctcgaccacagccaacctacttcgcggtcaaaacaccgttcacatagtaggaaagggcggacacagcgggagtaagttcatgtgctgccacgacacaaaatgctcatccaccggccttgtcgcagccgcaccccatcttgaccgtgtgaccggctacaaccaagcggactccgacaaaatttttgatgacggagctcccgaatgcggaatctcgtgctggttcaccaaaagtggcgaatggatcctcggcgtcctcaacggcaactggatggtcgtcgcagtcctcatcgcactcttcatcttctcaatcttcctgttcacactttgctgcccacgacggccctcctacgcaaaggaacacaaaccatag

SEQ ID NO: 15072 - RNA, 3447 nt, synthetic construct
  misc_feature 1..3447: note = derived and/or modified CDS sequence (opt11) from PUUV(CG17/Baskiria-2001)__AF442614.1__GP
  source 1..3447: mol_type = other RNA
atgggagagctatcacctgtgtgcctctacctgctgctccaaggcctcctcctctgcaacactggagccgccagaaacctgaacgaactcaaaatggagtgcccccacaccatcggcctaggacaaggcctagtcgtcggaagcgtagaactgccatcactccccattcagcaagtcgagacactcaaactcgaatcctcatgcaacttcgatctccacacctcaactgctggacagcaatcattcactaaatggacatgggaaataaaaggagacttagccgaaaacacgcaagccagctccacctcttttcaaaccaaatcatccgaagtcaacctgcgcgggttatgtctaataccaacattagtcgtcgaaacagcagcccgaatgcgcaaaaccattgcatgttacgacctctcttgcaatcaaacagtatgtcagcccacagtctatctaatgggccccatacaaacctgcatcacaactaaatcatgcctactcagcctgggagaccaacgaatacaagtcaactacgaaaagacctattgcgtttcaggccagcttgtggaaggcatatgcttcaaccccatacacacgatggcgctctcccaacccagccacacttacgatattatgaccatgatggtaagatgcttcctcgtcatcaagaaagtcacctcaggggactcaatgaaaattgagaaaaactttgaaacactcgtacagaaaaacggctgcactgccaacaacttccaaggatattatatctgcctaattggcagcagcagcgaacccctctacgtcccagccctagacgactacaggagcgccgaagtgctctcaagaatggcttttgctccccacggagaagaccacgacatcgaaaagaatgccgtgagcgccatgcgtatagccggcaaagtcactggcaaagccccaagcaccgaatcaagcgacaccgtacaaggcatcgccttttcgggatcgccgctctacacctccacgggggtactcacatccaaagacgaccccgtctatatctgggcacccggcatcatcatggaaggtaaccactccatatgcgagaaaaagacactcccccttacctggaccggcttcataagcctaccaggcgaaatcgagaaaacaacccaatgcactgtgttttgcaccctcgccggacccggggccgactgcgaagcgtacagcgaaaccggcatcttcaacatcagctcaccaacctgtctcatcaaccgcgtccagcgattccgcggagccgaacagcaaatcaaattcgtatgtcaacgagtagacatggacatcaccgtatactgtaatggaatgaagaaagtaatcttaaccaaaaccctagtaataggccaatgcatctacacatttacatctatcttctcactcatcccgggagttgcacactcgcttgcagtcgaactctgcgtgccaggcctgcacggatgggccactatgctcctactactaaccttttgcttcggctgggtcctgatccccactatcacgatgatcctactaaaaatattgatcgccttcgcctacttatgtagtaaatacaacacggatagcaaattccgcatactaatcgaaaaagtcaagagggaataccagaaaacgatgggctcaatggtttgtgaggtatgccagtacgaatgcgaaacagccaaagaattagaatcccaccgcaagtcctgttcaatcggttcctgcccctactgccttaacccctccgaggccaccaccagcgccttacaagcccacttcaaagtttgcaagctaacctcacgctttcaagagaacctacgaaaaagcctaactgtctacgagcccatgcagggttgctatcgaaccctctccctctttagataccgctccagatttttcgtaggcctagtctggtgcgtcctgttagtcctagagctgatcgtctgggcagcaagcgccgaaacccaaaacctaaatgccggctggacggacacagcccacggctccggtatcattcccatgaaaaccgacctggaactagacttctcgttaccaagctccgcatcctacacttaccgacgacagctgcaaaacccagcaaacgagcaagagaaaattccattccacctccaactcagcaaacaagtaatccacgccgagatccaacacctcggacactggatggacgcaaccttcaaccttaaaaccgccttccactgctatggatcctgcgaaaaatacgcttacccatggcaaactgcgggatgcttcattgaaaaagattacgaatacgaaaccgggtggggatgcaacccacccgactgccctggcgtcggcacaggatgtacagcatgcggcgtctacttagataagctaaaatccgtagggaaagtcttcaagatcgtctcccttagatacacgcggaaggtctgtatccagctcggaacagaacaaacctgcaaaacagtcgactcaaacgactgtttaatcactaccagtgtaaaagtgtgcttaatcggcacgataagcaaatttcagccctccgacacccttctgttcctcggacccctccaacagggaggactaatatttaaacagtggtgcacaaccacatgccagtttggagaccctggggacataatgtcgacccccaccggcatgaaatgccccgagctaaacggatcctttcgaaagaaatgtgcgttcgcaaccacacccgtatgccagttcgatggcaacacaatctctggctacaaaagaatgatcgccacaaaagactccttccagtcattcaacgtcaccgaaccacacatctccacgagcgcacttgagtggatcgacccagattcctcactccgcgaccacataaacgtaatcgtttcccgcgacctatcatttcaagatctatcagaaaccccctgccaaattgacctggccaccgcttctatcgacggagcctggggcagcggagtcggcttcaaccttgtctgcaccgtctcactaacggaatgtagcgctttcctcacctccatcaaggcttgcgacgctgcaatgtgttatggctcgacaaccgccaacctcgttcgcggccagaataccatccacatcgtcggcaaaggaggccactccggctccaaattcatgtgctgtcatgacacaaaatgctcatccaccgggctcgtagccgccgccccacacctcgaccacgtcacaggctataaccaagccgacagcgacaaaatcttcgacgacggcgcccccgagtgcggcatgtcatgctggtttaagaaatcgggagaatggattctaggcgtacttaatggaaactggatggtcgtcgccgtacttgtcgtcctcctcatcctgtccatcctcctctttacactttgctgcccccgccgaccatcataccgaaaagaacacaaaccctaa

SEQ ID NO: 15073 - RNA, 3447 nt, synthetic construct
  misc_feature 1..3447: note = derived and/or modified CDS sequence (opt11) from PUUV(CG215/Omsk)__AF442615.1__GP
  source 1..3447: mol_type = other RNA
atgggtaaactctccccagtgtgcctgtacctacttctccaatgcctcctcctcggtgacaggggagacgctcgcaacctcaatgaactgaaaatggaatgcccccacacgatagggttaggccaaggactcgtcgtaggatcagttgaacttccccctgtcccaatccaacaagtagaatcactaaaacttgaatcctcatgcaactttgaccttcacacaagcactgccggtcaacagagcttcaccaaatggacttgggaaattaaaaatgacctagcagaaaatacccaagcatcatccacatccttccaaaccaaaagctcagaagttaacctccgcggtttgtgcctcatacccactctcgttgtcgaaaccgcagccaggacacggaagacaattgcttgctacgacctaacctgcaaccaaaccgtgtgccaaccaaccgtgtacctcatgggtccgatccaaacatgcgtcacaaccaaatcttgcctcttaggcctcggagatcaacggatccaggtgaactacgaaaagacctactgcgtttccggtcaactcgtagaaggcgtctgcttcaatccaatacacaccatggcgctctcacaaccctcacacacctacgatgtcatgacactcatggtcagatgtttcctcattatcaagaaggtcaccagcggtgactccatgaaaatagaaaagaacttcgaaaccctcgtccagaaaacaggctgcaccggcaacaattttcaaggatactacatctgcctcataggctcgtcttcagaaccattatatgtaccaacccttgacgactaccgaagcgcagaagtactatcgaggatggccttcgcccctcacggggaggatcacgacatcgagaaaaacgccgtctcaacgatgcggatcgccggcaaagtcaccggccgagcgccttcaactgaagccagcgacacagtacaaggaatcgcattctccggatcacccctctacacctccacgggcgtactcacagcgaaagacgacccggtctatatatgggcccccggcatcatcatggaaggcaaccactccagttgcgacaaaaagaccctgcccctcacttggacaggatttatttccctgccaggcgaaatagagaagacaacccaatgcacggtattctgcacgctagcgggacctggcgcagactgcgaagcctactcagagaccggaatattcaacatctcaagccccacgtgcctcataaacagggtccaacgcttccgcggagccgaacagcaaatcaaattcgtgtgtcaacgggtggacatggacattatcgtatactgcaatggaatcaaaaaggtgatactaacaaaaaccctagtaataggacagtgcatctatacctttacaagcatattctcgctaatcccgggggtcgcccactccctcgctgtagaactctgcgtacctggcctccacggctggaccaccatgctactcctacttaccttctgcttcggctgggtactcatcccctttataacaatgatccttctcaaaattctcatagccttcgcatacctatgctccaaatacaacaccgacagcaaatttcgcatcttagtagaaaaagtcaagaaagaataccagaaaacgatgggatcaatggtttgcgaagtttgccaatacgaatgcgaaaccgccaaagaactcgaaagccacagaaaaagctgctccataggctcatgtccctactgtctaaacccctccgaagcgactacctccgccctgcaagcccacttcaaagtatgcaaactaacgtcgcggtttcaagagaatctacggaaatctctgactgtctatgaacccatgcaaggatgctaccgcacgctttccctcttccgctaccggtcgaaattctttgtcggcctagtctggtgcctactactcgtcatggaactaatcgtatgggccgcatcagccgaaacccaaaacttaaactccggctggactgacaccgcacacggctccggtatcataccaatgaaaacagacctagaactcgacttcagcttgccttccagcgcgtcatatacctaccgccgccaactccaaaacccagctaacgagcaagagaagatccccttccacctccagatctccaaacaagtcatccacgcagaaatccaacatctaggacactggatggacgccacattcaacctgaaaacggcgttccactgctacggctcatgcgaaaaatacgcatacccctggcagaccgctggctgcttcattgaaaaagactacgaatacgaaaccggatggggatgcaacccgcccgactgccccggcgtaggtactggctgcaccgcctgcggagtctacctggacaaactcaaatcagttggcaaagtcttcaagatcgtcagcctcaaatacacccgcaaagtctgcatccaactcggcacagaacaaacatgcaaaaccgttgactcaaacgactgtctcataactacctctgtaaaagtctgtatgataggcacaatatccaagttccaaccatccgacacactactctttcttggccccctccaacaaggcggattgatatttaaacaatggtgcaccacgacctgccaattcggggatcccggcgacatcatgtccacccccaccggaatgaagtgcccagagctaaacggctcgttccgcaagaaatgtgctttcgccacaaccccagtctgccaattcgacggaaacaccatctcaggatacaaaagaatgatcgccaccaaagacagcttccagagctttaacgtaaccgaaccacacatctccgcgagcgcgctcgaatggatcgacccggactctagcttacgcgaccacatcaacgttgtcgtcggccgagacctgtccttccaagacctctcagagaccccctgccaagtggacctaatgacctctacaatcgacggcgcctggggatccggcgtaggtttcaacctcgtatgtacggtatccctgactgaatgctccccattcctcacgtcaataaaagcatgtgactcagccatgtgctacggctccacgaccgtcaacctcgtacggggccaaaacaccgtccacatcgttggcaaaggcggccacagcggcagcaaatttatgtgctgtcacgacacaaaatgctccagtacgggccttgtcgcagccgctcctcacctcgaccgtgttacaggatacaaccaagccgactccgataaaatattcgacgacggagctcctgaatgcggaatgtcgtgctggttcaagaaatccggcgaatggatcctaggcgtcctaaacggtaactggatggttgtagccgtcctcatagcactcctcatcctctccattctcatgttcaccctttgctgcccacgaagaccatcctaccggaaagaacacaaaccttaa

SEQ ID NO: 15074 - RNA, 3447 nt, synthetic construct
  misc_feature 1..3447: note = derived and/or modified CDS sequence (opt11) from PUUV(CG222/Omsk)__AF442616.1__GP
  source 1..3447: mol_type = other RNA
atgggcaagctgagccccgtgtgcctctacctgctgctccagtgcctgctgctcggggaccgcggcgacgctcggaacctgaacgagctgaagatggaatgcccgcataccatcgggctcggccaggggctggtcgtgggctcagtagagctgccgcccgtccccatccagcaggtcgagagcctcaagctggagtccagctgcaacttcgacctgcacacctccacagccggccagcagagcttcaccaagtggacctgggagatcaagaacgacctcgcggagaacacccaggcctccagcacgtccttccagaccaaaagctccgaggtgaatctgcgcggactgtgcctaatccccaccctggtggtggagaccgccgcccggacgcgcaagaccatcgcctgctacgacctgacctgcaaccagaccgtgtgccagcccacggtttacctcatggggcccatccagacctgcgtgaccaccaagagctgtctgctggggctcggcgaccagcggatccaggtgaactacgagaagacgtactgcgtctccgggcagctggtggagggcgtgtgcttcaaccccatccacaccatggcgctaagccagccgtcccacacctacgacgtcatgaccctcatggtgcgctgcttcctgatcatcaagaaggtgacgagcggcgactccatgaagatcgagaagaacttcgagaccttagtccagaagaccgggtgcaccggcaacaacttccaagggtactacatatgcctcatcggctcgtccagcgagcccctctacgtgcccacgctggacgactaccggagcgccgaggtgctctcccgcatggccttcgcgccccatggcgaggaccatgacatcgagaagaacgccgtcagcaccatgcggattgccgggaaggtcaccggccgcgccccgtccaccgaggccagcgacacagtgcaggggatcgccttctccggcagccccctgtacacctccaccggggtcctgaccgcaaaggacgaccccgtgtacatctgggcccccggcatcatcatggagggcaaccacagctcttgcgacaagaagacgctcccgctgacctggaccgggttcatcagcctgcccggcgagatcgagaagaccacccagtgcaccgtcttctgcaccctcgccgggccccgggccgactgcgaggcctactccgagaccggcatcttcaacatcagctccccgacctgcctgatcaaccgcgtgcagcggttccgcggggcggagcaacagatcaagttcgtgtgccagcgggtcgacatggacatcatcgtgtactgcaacggcatcaagaaggtgatcctgacgaagaccctcgtcatcggccagtgcatctacaccttcaccagcatcttctccctgatccccggggtggcccacagcctggccgtggagctctgcgtccccggcctgcacggctggacgaccatgctgctccttctgaccttctgcttcggctgggtgctgatccccttcatcaccatgatcttgctgaagatcctgatcgccttcgcatacctctgttccaagtacaacacggacagcaagttccgcatcctggtggagaaggtcaagaaggaataccagaagaccatggggtccatggtgtgcgaggtgtgccagtacgagtgcgagaccgcgaaggagctggagagccaccgcaagagctgctccatcggcagctgcccctactgcctcaacccgtccgaggccaccacgagcgccctgcaggcccacttcaaagtctgtaagctgacgtcccggttccaggagaacctccgcaagagcctgaccgtgtatgagccgatgcagggctgctaccggaccctgtctctcttccggtaccgcagcaagttcttcgtggggctggtctggtgcctgctcctcgtgatggagctgatcgtgtgggccgcgtccgccgagacgcagaacctcaacagcggctggacagataccgcccacgggtccggcatcatcccaatgaagaccgacctggagctggacttcagcctcccttccagcgcctcctacacgtaccgccggcagctgcagaacccggcgaacgagcaggagaagatccccttccacctccagatcagcaagcaggtcatccacgccgagatccaacacctgggccactggatggacgccaccttcaacctgaagaccgccttccactgctacgggtcctgcgagaagtacgcctacccctggcagaccgcgggctgcttcatcgagaaggactacgagtacgagacggggtggggctgtaacccgcccgactgccccggggtgggcaccggctgcacggcctgcggggtgtacctggacaagctcaagagcgtcggcaaggtgttcaagatcgtgagcctgaagtacactcgcaaggtatgcatccagctggggacggagcagacctgcaagaccgtggactccaacgactgcctcatcaccacgagcgtgaaggtctgcatgatcggcaccatctccaagttccagcccagcgacacccttctgttcctcgggccactgcagcagggaggcctgatcttcaagcagtggtgcaccacgacctgccagttcggggaccccggcgacataatgagtacccccaccggcatgaagtgccccgagctcaacggcagcttccggaagaagtgcgcgttcgccaccacgccggtgtgccagttcgacgggaacaccatctccggctacaagcgcatgatcgccaccaaggacagcttccagtccttcaacgtgaccgagccccacatcagcgcctccgccctggagtggatcgaccccgacagctccctgcgagatcacatcaacgtggtggtgggccgcgacctcagcttccaggacctgtccgagacgccctgccaggtcgacctgatgaccagcaccatcgacggggcgtggggctcgggggtgggcttcaacctcgtgtgcaccgtcagcctgacggaatgctccgccttcctgaccagcatcaaggcctgcgacagcgcgatgtgctacgggtccaccaccgtgaacctcgtgcggggccagaacacggtgcacatcgtgggaaagggcgggcacagcgggtccaagttcatgtgctgccacgacaccaagtgtagctccaccggcctggtggccgccgccccgcccctggaccgcgtcaccggctacaaccaggcggacagcgacaagatcttcgatgacggggcccccgagtgcggcatgtcctgctggttcaagaagtccggggagtggatcctcggcgtccttaacgggaactggatggtggtcgccgtgctgatcgccctcctgatcctgagcatcctcatgttcacgctgtgctgcccccggcgcccgagctaccggaaggagcacaagccctga

SEQ ID NO: 15075 - RNA, 3447 nt, synthetic construct
  misc_feature 1..3447: note = derived and/or modified CDS sequence (opt11) from PUUV(CRF161)__AF367061.1__GP
  source 1..3447: mol_type = other RNA
atgggaaaattatctcccgtatgcctctatctattactgcaatgtctcctcctcggagaccgcggcgacgcccgcaacctcaacgaactgaaaatggaatgcccgcacaccatcggtctcggccagggattagtagtaggatccgtcgagctcccacccgtccccatacaacaagttgaatcactgaaactagaaagctcctgcaactttgacctacacacctccacagcaggtcaacaatccttcacaaaatggacctgggaaatcaaaaacgacctagtggaaaatacacaagcatcctccacatccttccagaccaaatcatccgaggtcaatctccgcggactctgcttaatacccaccctggtagtagaaaccgcggcacgaacccgcaaaaccatagcatgctacgatctaacctgcaaccagactgtctgccaacccacagtatatctcatgggccccatccaaacctgtatcactacaaagagctgcctcctgggactgggagaccaaagaatccaagtaaactacgagaaaacttactgcgtctccggccaactcgtcgaaggagtgtgctttaaccccatacataccatggcactcagtcaaccctcccacacatacgacgtcatgacattaatggtaagatgttttctaattatcaagaaagtcaccagcggcgatagcatgaagatagagaaaaacttcgaaacgctcgtccagaaaacaggttgcacaggcaacaatttccaaggctactatatatgcctaataggctcctcatcggaaccactctatgtgccaaccttagacgactatcgcagcgccgaagtactcagccgcatggctttcgcgccccatggcgaagaccacgacatcgagaaaaacgccgtctcaacgatgcgcatcgccggtaaggtcgccggccgcgccccctccaccgaagcctccgatacggtccagggcatcgcgttctccggctcacccctgtacacctccaccggcgtactcactgctaaagacgacccggtgtacatatgggcgcccggcatcattatggaaggaaaccacagcagctgcgacaagaaaacactaccacttacctggacaggcttcatctcgctccctggagaaatccagaaaacaacacaatgcactgtgttttgcacacttgctggcccccgcgccgactgtcaagcatactcagaaacaggcatcttcaatatcagcagcccaacatgcctaatcaaccgcgtacaacgcttccgcggtgccgaacaacaaataaagttcgtctgccagcgtgtagacatggacatcattgtctactgcaatggaatcaagaaagtcatactcaccaaaacccttgtcataggtcaatgcatctacactttcacctccatattctctctcatcccgggagtcgcccatagtctcgctgtagaactctgcgtacccggcctccacggctggacgaccatgctactactactcacgttctgtttcggctgggtactcatcccgttcatcaccatgatccttcttaaaatcctaatcgccttcgcctacctttgcagcaaatacaataccgacagcaaattccgcatcctagtcgagaaggtcaaaaaggaataccagaaaacaatgggatccatggtatgcgaagtatgccaatacgaatgcgaaacggcaaaagaactcgaatcccacagaaagtcctgctcaatcggttcctgcccatattgtctcaacccctccgaagccactaccagcgcccttcaagcacacttcaaagtatgcaagctcacatccagattccaagaaaacctgcgcaaaagcctaacggtctacgaacccatgcaaggctgctaccgcacgttatcacttttccgataccggtcgaagttctttgtaggcctagtctggtgtctactcctggtgatggaattaattgtctgggcagcctcagcagagacccaaaacttaaacagcggctggacagacaccgcccacggctccggcatcatacccatgaaaaccgacctcgaactcgacttttccctaccctcgagcgcgtcctacacctaccgccgccaactacaaaacccggccaacgagcaagagaaaatccccttccacctccaaatatccaaacaagtaatccatgccgaaatacagcacctcggtcactggatggacgcgacattcaacctaaaaaccgcattccactgctatggatcctgcgaaaaatacgcctatccgtggcaaacagccggctgctttatcgaaaaagattacgaatacgaaacagggtggggatgcaatccccctgactgccccggcgttggcaccggatgcaccgcttgtggcgtctacctggacaaactcaaaagcgtaggtaaagtattcaaaattgtttctctcaaatacacccgcaaagtatgcatccagctcggcaccgaacaaacctgcaaaacagtagacagcaacgattgccttatcacaacatcggtcaaagtttgcatgataggaaccatatcaaaattccaaccgagcgatactctgctgatcctcggcccactgcaacaaggaggactcatcttcaaacaatggtgcacaaccacatgccagttcggagatcccggcgacatcatgtcgacccccacaggcatgaaatgccccgaactaaacggcagtttccgcaagaagtgcgcattcgccacaacacccgtgtgccagttcgacggaaacaccatttccggctacaaacgcatgatagccacaaaagactcgttccaatcattcaatgttacagaaccccatatctcagccagcgcacttgaatggattgaccccgactccagcctccgcgaccacataaacgtagtcgtcggccgcgacctcagcttccaagacctatcggaaacaccctgtcaggtagacctaatgacaagcacgatcgacggcgcttggggctcaggcgtaggcttcaaccttgtctgcactgtgtctctcacggaatgctccgccttccttacttccataaaagcctgcgacagcgccatgtgctatgggagcacaacagccaacttagtcaaagggcaaaacacagtacacatggtaggaaagggaggccactcagggtctaaattcatgtgctgccacgacaccaaatgcagcagcaccggcctagtggcggccgccccacacctcgaccgggtcaccggctacaaccaggcagactccgacaagatcttcgatgatggcgcaccagaatgcgggatgagctgctggttcaagaagtcaggagaatggattctcggcgtcctcaacggcaactggatggtagtcgcagttcttatcgccctactcatcctctccatcctcatgttcacactctgctgccccagacgaccctcctaccggaaagaacacaaaccctaa

SEQ ID NO: 15076 - RNA, 3447 nt, synthetic construct
  misc_feature 1..3447: note = derived and/or modified CDS sequence (opt11) from PUUV(CRF308/Omsk)__AF442617.1__GP
  source 1..3447: mol_type = other RNA
atgggaaaactgtcccccgtctgcctgtacctcctattacaatgcctcctactcggggaccgaggcgacgcacgaaacctaaacgaactaaaaatggaatgtccccacaccatcggtctcggtcaaggcctcgtcgtcggatccgtcgaactgcccccagtaccgattcaacaggtcgaatccctcaagctggaatcttcatgcaacttcgacctccacacctcaaccgccggccaacaatcttttacgaaatggacatgggaaattaagaacgacctcgcagagaatacccaagcatcctccacctcattccaaacaaagtcatctgaagtcaacctgcgagggctatgcctcataccaacactggtcgtcgaaaccgccgcccgcacacgtaaaaccatcgcttgctatgacctgacatgcaaccaaactgtctgccaaccaaccgtctatctcatgggcccaatacagacctgcatcacaacaaaatcctgcctcctcggcctgggggaccaacgtattcaggtaaactacgagaaaacatactgcgtctccggccagctagtggaaggggtctgcttcaaccccatacacaccatggccctctcccaaccatctcacacatacgatgtaatgacactcatggtccgatgcttcctcataattaagaaagtcacatcaggggacagcatgaaaatagagaaaaatttcgaaacgctcgttcagaaaacaggatgcacaggcaacaacttccagggatactatatatgcctaatcggatcctcatcagaaccactctacgtacccaccctggacgactacagatccgcagaagtgctatcacgcatggcattcgctccccatggcgaagaccacgacattgagaaaaacgcagtctcgacaatgcgaattgcgggcaaagtcgccggccgagccccatctaccgaagcctccgacacagtacagggcatagccttcagcggttcacccctgtacacctccaccggcgtactcacagcaaaagacgaccccgtctacatttgggcgcccgggataatcatggaaggtaaccactccagctgcgacaaaaagactctcccattaacgtggaccggcttcatatccctacctggcgaaatcgagaaaactacacaatgtaccgtattctgcacccttgcaggccccggcgccgactgcgaagcgtactcggaaactggcatattcaacatatcctcgccaacctgcctcatcaaccgggtccaaagattccggggagcagaacaacaaatcaaattcgtctgccagcgagtcgacatggatatcattgtgtactgcaacgggatcaagaaggtcatcctaaccaaaacccttgtgataggccaatgcatctacacattcacctccatcttcagtctcatcccaggcatcgcgcactcactagcagtcgaactatgtgtcccaggacttcatggttggactaccatgctactcctcctcactttctgcttcggctgggtactaataccattcataacaatgattctcctgaaaatcctcatcgcgttcgcctacctatgctcaaagtacaacaccgacagcaaatttcgcattctagtagaaaaagtcaagaaagaataccagaaaaccatgggttccatggtttgcgaagtatgccaatacgaatgcgaaacagccaaagaactagagtcccaccgaaaaagctgtagcataggaagctgcccatactgcctcaacccctccgaagccacaacctccgcactacaagcgcacttcaaggtctgcaaacttacctctcgatttcaagaaaacctcagaaaatccctcaccgtctacgaacctatgcaaggctgctaccgcaccctctcactcttccgataccgctccaaattcttcgtcggcctagtatggtgcctcctactggtcatggagctaattgtatgggcagcctctgccgagacccaaaacctcaattctggctggaccgacacagcacacggctcaggcatcatccccatgaagacggacctagaactcgacttcagccttccctcatccgcatcctacacctaccgacgtcaactccaaaaccccgccaacgaacaagagaaaattcccttccatctgcaaatatccaaacaagtgatacatgccgaaatacagcacctgggccattggatggacgcaaccttcaacctaaagaccgccttccattgttatggcagctgcgaaaaatacgcctacccgtggcagaccgccgggtgcttcattgaaaaagactacgaatatgaaaccggttggggctgcaatccacccgactgtcccggcgtcggaaccggatgtaccgcttgcggcgtctatctcgacaaacttaaatcggtgggcaaagtatttaagatagtatctcttaagtacacccgaaaagtctgcatacagctgggcacggaacaaacctgcaaaaccgtagacagcaatgattgcctgataaccacaagcgtcaaagtctgcatgatcggcaccatctccaaattccaaccctccgacaccctactttttctcggacccctccagcaaggcggcttaattttcaaacaatggtgcaccaccacttgccagtttggagaccccggggacatcatgtcaacgcccacaggaatgaagtgcccagaactaaacggatcattccgcaagaaatgcgcattcgcaaccacccctgtttgccaattcgacggcaataccatctccggatataaacgcatgattgccaccaaagactccttccaatcgttcaacgtcacagaaccccacattagcgcatcagcccttgagtggatcgatcccgactcctcattacgggaccatatcaacgtggtcgtaggacgagacctctccttccaagatctatcagaaaccccgtgccaagtagacctgatgacctccacaatagacggcgcctggggaagcggtgtcggcttcaacctagtttgcactgtaagtctcacagaatgcagcgctttcttaaccagcataaaagcctgcgactccgccatgtgctacggatccactaccgctaaccttgtccgcggccaaaacactgtccacatcgttgggaaagggggccacagcggcagtaaattcatgtgctgccatgacaccaaatgctctagcacaggcttagttgccgctgcaccccacctcgatcgtgtaacaggttacaatcaagcagacagcgacaagatattcgacgacggcgcccctgagtgcggcatgtcctgctggttcaagaaatccggcgagtggatactcggcgttttaaacggcaactggatggtggtggcggtgctaatcgcgctcctcatactatccatcctaatgttcacactctgctgcccacgtcgcccttcctatcgtaaagaacacaaaccttag

SEQ ID NO: 15077 - RNA, 3447 nt, synthetic construct
  misc_feature 1..3447: note = derived and/or modified CDS sequence (opt11) from PUUV(Mu/07/1219)__KJ994777.1__GP
  source 1..3447: mol_type = other RNA
atggagaaaatcattcccgtatgcctatacctaccctttctatgtctactactctggtcccgtggagacacacgcaacctcaacgaactcaaaatggaatgcccacacaccatcgggctaggccaagggctcgtcatcggatccattgaactacccccagtaccactcatacaagtagaatctctcaaactcgaaagctcgtgcaacttcgatcttcacacctcaacctctagccagcaagccttcacgaaatggacatgggaagtaaaatctgaccttgccgaaaacacccaagcatcctccacttcattccaaaccaaatcctcagaagtcaatctacgaggcctatgcctcgtaccccctctggtaatcgagaccgctgccagaacgcggaaaactatagcatgcttcgacctatcctgcaaccaaaccacatgtcaaccaactgtcttcctaatgggcccgatccagacttgcataacgactaaatcctgtctccttggcctcggcgaccaaaggatacaagtaaactacgagaaaacctattgcgtgtcaggccagctcatcgaaggaatatgcttcaacccggtccacacaatggcactatctcaaccaagccacacatacgacatcgtaaccgtaatggtccgctgtttcctcatagtcaagaaagttaccaccggcgactcaatgaaaatcgaaaagagcttcgaaactctcgtacagaaaacaggctgcaccgataacggctttcaagggtactacgtctgcctcatcggttcatcatccgagccattatacatacccactctagacgattaccgtagcgctgaagtcctcagccgcatggcatttgcgccccacggcgaagaccatgacattgagaaaaacgcaatctccgcgatgcggattgtcggtaaggtcacaggcaaagccccatccacggaatcatccgacacagtccaaggaatagccttctcaggcaatccattatacaccagcacaggtgtcctcacagccaaggacgaccctgtctacgtatgggcaccaggcataatgatggaaggcaaccactccgtctgcgaaaagaaaactctcccacttacttggacaggcttcatccctctccctggcgaaattgagaaaaccacccaatgcaccgtattctgtacactagcagggccaggcgctgactgcgaagcatattccgaaacgggtatcttcaacatttcttccccgacctgcctcatcaatcgagtgcagcgcttcagaggcgccgaacaacagatcaaattcatttgccaacgagtcgacatggacatcacagtatactgcaacggactaaagaaagtcatccttacaaaaactctcgtcatcgggcagtgcatctatacgtttaccagcatattctcactcatccctggagtcgctcactcgctagccgttgaactctgcgtgcccggcctccatggatgggcgacaatgctactcctactgaccttctgcttcgggtggattctcatcccattctttgccatgatcctccttaaagtcctcatagcacttgcatacctctgcagcaaatataacacggactcaaaattcaaagtcctcatcgaaaaggtcaagaaagaataccagaaaacgatgggcagcatggtatgcgaagtgtgtcaatacgagtgcgaaacagccaaagaactcgagtcccaccgaaaatcctgccccatgggctcttgcccatattgcctaaaccccgcggaagcaactacaagtgccctacaagctcactttaaagtatgtaaactcacttcccgattccaggacaatcttcgcaaatccttgggtgcttatgaacccaagcaaggatgctacagaacgctatctctgttcagataccgcagtagatttttcgtcggtttcatctggtgcctgcttctcgtcctagaattaatagtctgggccgcaagcgcagagacgcagaatctcaactcaggctggacagacaccgcgcatggctcaggcgtcatcccaatgcgtacagacctagaactcgattttagcctccccagttccgcatcctacacctaccgcagacaactccaaaaccccgctaatgaacaagagaaaataccgtttcatctccagatctcaaaacaggttatccacgccgagatacaacacctaggccactggatggatggtacgttcaaccttaagaccgctttccactgctacggctcctgcgaaaaatacgcctacccctggcaaacggccggatgcttcgtcgaaaaagattatgagtacgaaagcggatggggctgcaacccggccgactgccctggcgtaggaaccggatgcacagcctgcggcgtttacctcgacaaactgaaaagtgtagggaaagcattcaagattgtctccctccgctacacacggaaggcctgcatccagctaggcaccgaacaaacctgcaaaaacgtcgactccaatgactgccttgtcaccacctccgtaaaagtctgcctcatcggaacagtctccaaattccagccatccgacacacttctcttcttgggccccctcgaacaaggcggtttgatcttcaaacaatggtgcaccacaacttgccaattcggcgacccgggagacatcatgtccacccccgtcggaatgaaatgccccgaactttcaggctccttccgcaagaaatgcgccttcgccaccactccagtctgccaattcgacggcaacactatatccggatacaaacgcatgatcgcaaccaaagacagcttccagtcgttcaacgtaaccgaaccacatatatccgctagctcactcgaatggatcgacccggacagttcactccgggaccacataaacgtcatagtcggacgggacctctccttccaagacctctccgaaacaccctgccaagtcgacttaacaaccacgtcgatagatggagcatggggatcaggcgtgggcttcaacctcatatgctcagtctcgctcacagaatgcagcaccttcctcacctcgatcaaggcttgcgactccgctatgtgctacggcagcaccaccgctaacctagtacgaggacaaaacacagtccacatcgtcggtaaaggcggccactccggcagcaaattcatgtgctgccatgacacaaaatgcagcagcaccggcctagtcgcagccgcaccgcatctcgacagagtcaccggctacaaccaagcggactccgacaaaatcttcgatgacggagccccagagtgtggcatctcatgctggtttacaaaatccggcgaatggatccttggcgtcctcaacggaaactggatggtcgtagcagtcctagtcgccctcttcatcctcagcatattcctcttcactctatgctgtcctcgtcgacccagctacgccaaagaacacaaaccctaa

SEQ ID NO: 15078 - RNA, 3447 nt, synthetic construct
  misc_feature 1..3447: note = derived and/or modified CDS sequence (opt11) from PUUV(Puu/Kazan)__Z84205.1__GP
  source 1..3447: mol_type = other RNA
atgggaaaacttagtcccgtctgtctttatctactactacaaggcctattgctctttaacaccggaacagcacgcaacctaaacgagctaaaaatggagtgtccccacaccatcggacttgggcaaggtctcgtagtcggatccgttgagctgcccccagtccccatccagcaagtcgagacactcaagctcgaatcctcatgtaacttcgaccttcacacctccaccgccggacaacaagcattcaccaagtggacatgggagatcaaaggcgaccttgcggagaacactcaagcgtctagcacctctttccagaccaaaagctccgaagtcaacctacgagggctttgcctcatcccaacccttgtcatcgagacagcagcacggatgcgaaaaacaatcgcgtgttacgacctcagctgcaaccaaaccgtgtgccaacccaccgtgtacctcatgggcccgatacagacctgcatcacaaccaaatcctgtctactcggactaggagaccaacgcatacaagtaaattacgagaaaacctactgcgtcagcggtcaactcgtcgaaggtgtttgcttcaaccccatccacaccatggccctttcccaaccctcgcatacctacgatatagtgacaatgatggtcaggtgctttctcgttattaagaaagtcacgtccggcgactccatgaaaatagagaaaaacttcgaaacgctcgtacagaaaaacggctgcacggccaattcttttcaaggctactacatatgcctaataggcagctcatctgaacctctctatgtacccaccctagacgactatcggagcgccgaagtactctcccggatggcctttgctccccacggtgaagatcacgatgtcgaaaagaacgccatatccgcccttcgtatcgccggcaaagtcacaggaaaagctccatccactgaatcatccgacacagtccaaggcgtcgcgttctccggctcgccactttacacgtccaccggtgttctaaccgccaaggatgacccggtatacatttgggcccccggcatcatcatggaaggaaaccactcggtttgcgaaaagaaaacgctcccgctaacatggacgggcttcatctcgctccccggcgaaatcgagaaaaccacgcagtgcacagtcttctgcaccctcgctggccccggagccgactgtgaagcatactcagaaactggcatattcaacatctcctcaccgacctgcctaataaacagagtacaacgattccgcggagccgaacaacaaataaagttcgtatgccagcgtgtggacatggacatcacagtctactgcaatggggtcaagaaagtgatcctaaccaagacactggtcataggtcagtgcatatacacattcacatccatattcagcctaatccccggtgtcgcacactccctagccgtcgaactgtgcgtgccaggcctccacggctgggccacaatgctactcctcctgaccttctgctttggttgggttctcatcccgacaatcacaatgatcctactaaagatccttatcgccttcgcctacctctgctcaaaatacaacaccgacagtaaatttcgcatcctcattgaaaaagtcaagaaagaataccagaaaacaatgggcagcatggtctgcgaagtctgccaatacgaatgcgaaaccgccaaagaactcgagagccaccgcaaatcatgttccatcggatcctgcccctattgcctcaaccccagcgaagcgacaacatccgcgcttcaagctcactttaaggtatgcaaactcacaagccgtatacaagaaaacctgcgaaaatcacttacagtatacgaaccgatgcaaggatgctaccggaccctatccctcttccgataccgctcacgattcttcgtcggcctagtctggtgcgtgctcctcgtcctcgaactcatagtctgggccgcctcagccgaaacacaaaacctaaacgccggctggacagacaccgcacacgggagcgggatcatcccaatgaaaaccgatctagaactcgacttctcactacccagctccgcctcctacacctaccgtaggcaactgcaaaaccctgctaacgaacaagaaaacattcccttccacctacaaataagcaaacaagtaatccatgcagagatccaacacctaggccactggatggacgcgaccttcaacttgaaaacggcctttcactgctacggcagctgcgaaaaatacgcctacccctggcaaacggccggctgtttcgtcgaaaaagactacgaatacgaaaccggttggggctgcaacccgccagactgcccaggagttggtaccgggtgtaccgcctgcggagcctatctcgacaaactaaaatccgtaggcaaagtgttcaagatcgtatccctacgctacacccgaaaagtctgcatccagttaggaaccgaacaaacatgcaaaacagtcgacagcaacgactgcttaatcacaacctcagtgaaagtatgcctcatcggcacaataagtaaattccaaccctcagacacgctcctcttcctaggacccctccagcaaggcgggctaatattcaaacaatggtgtacaacaacctgccaattcggagaccccggcgacatcatgtccaccccaaccggaatgaaatgccccgatctaaacggcagcttcagaaagaaatgcgccttcgcaaccaccccagtatgccaattcgacggaaatacaatctcaggctacaaacgcatgatcgcaacaaaagatagtttccagtcttttaatgtcaccgaaccccacatatcagcgagcgcactagaatggatcgacccagacagcagcctcagagaccacatcaacgttatagtatctcgcgacctcagcttccaagatctatccgaaacgccctgccagatcgacctcagcacagcaagcatcgatggcgcctggggtagcggcgtagggttcaacctcgtctgcaccgtttcactaaccgaatgctctgcattcctgacttccatcaaagcctgcgatgcagccatgtgctacggctcaaccaccgctaacctagtacgcggtcagaacaccatccacatcgtcggcaagggcggtcactccggaagcaaattcatgtgctgccatgacaccaaatgttcgaccacgggcctagttgcagccgcgccccatctagacagggtcactggctacaaccaagctgattctgacaaaatatttgacgacggagcacccgaatgcggaatgtcctgttggttcaagaaatcaggtgagtggatcctaggggttctcaacggaaattggatggtggtagccgtcctcattgcgctccttatcctcagcatactcttattcaccctctgctgcccccgacgcccttcgtaccggaaagaacacaagccctga

SEQ ID NO: 15079 - RNA, 3447 nt, synthetic construct
  misc_feature 1..3447: note = derived and/or modified CDS sequence (opt11) from PUUV(PUUV/Ardennes/Mg156/2011)__KT247603.1__GP
  source 1..3447: mol_type = other RNA
atgggaaaaataatccccgtttgcctctacctacttttcctgtgtctcctactatgggaccggggcgacaccagaaacctcaatgagcttaagatggaatgcccccacacaatcggactaggacaaggcttagtcatcggctcagtggaacttccacccgtacccctcacccaggtggaatccctgaaacttgaaagctcctgcaacttcgacctccatacatcgacatcaagccagcaaagtttcacaaaatggacatgggaaatgaaggtcgatctcgcagaaaacacccaagcctcatcaacctctttccaaaccaaatcatctgaaataaacctccgcgggctgtgcctcgtacccccgctcgtcatagagaccgccgcacgaacacgcaaaactatcgcatgcttcgaccttagctgcaaccaaaccgcgtgccaacccacagtcttcctaatcggcccgatccaaacctgtattacaaccaaatcgtgcctcctaggccttggcgatcagcgcatccaagtcaactacgagaaaacctactgcgtatctggccagctagtagaagggatctgctttaacccggtccacaccatggcactctcccagccctcccacacctacgacatcgtcacagtcatggtccgatgcttcctcatcgtcaaaaaggtctccaccggcgactccatgaaactagaaaagtcattcgaaacactcgtccagaaaacaggctgcaccggcaacgggttccaaggatactacgtatgcctaataggatcctcctccgaaccgctctacatcccgacgctcgacgattaccgatccgccgaagtactatcccgtatggccttcgcgccacacggcgaggaccacgacattgagaaaaacgcaatatccgccatgcggatcgtcggtaaagtcacaggcaaagcaccgagcaccgaatcatccgacaccgtacaaggcatagcattctcaggtaaccccctctacacatccactggcgtcctgacggccaaagacgatcccatttacatatgggcccccgggatcataatggaggggaaccactctgtatgtgacaagaaaacgctcccactaacatggacaggctttatacccctacccggcgagatcgagaaaacaacgcaatgcaccgtattctgcaccctcgccggccccggagcggactgcgaagcctactcagaaacaggcatattcaacatctcatcacccacatgtctcatcaaccgcgtacaacgattccgcggcgccgagcaacaaatcaaattcatatgccaaagagtagatatggacatcaccgtttactgtaacggactcaagaaagtaatactaaccaagaccctagtcatcggtcaatgtatatacaccttcacatccattttctccctgatccccggcgtcgctcattccctcgccgtagagctatgcgtcccagggctccatggatgggcgacaatgttattacttctgaccttctgcttcggctggatcctgatacccttcttttcaatgatactcctaaaaattctaatcgcatttgcctacctatgctccaaatacaacacagacagtaaatttaaaatcctcatcgaaaaggtaaagaaagaataccagaaaacgatgggatccatggtctgcgaagtctgccaatacgaatgcgagacagccaaagaactggaatcccatcgcaaaagctgccccatgggatcctgtccatactgcctgaatccagcggaagccaccaccagtgcactacaagcccatttcaaagtctgcaaacttacgtcgcgcttccaagacaaccttcgcaaaagcctaggcgcctacgaacccaagcaaggctgctaccgcaccctttccctttttagataccgctcccgcttcttcgtaggcttcatctggtgcttcctccttgtactggaactaatcgtttgggcagcatccgccgaaacccaaaatctcaactcaggatggaccgacacagcccatggcagcgggatcatacccatgcgtaccgacctcgaactcgacttctccctcccctcgtcagcgagttacacctaccgtcgacaactgcaaaaccccgctaacgaacaagagaaaatcccgttccatctgcaaataagcaaacaggtaatccacgcagaaatccaacacctaggtcactggatggacggaacattcaaccttaaaacggccttccactgctacggctcctgcgaaaagtacgcatatccctggcaaacagccggctgcttcgtagaaaaagattacgaatatgaatcaggctggggctgcaatccaccagactgcccaggcgtcggcaccggatgcacagcgtgcggcgtctatcttgacaaactgaaatccgtaggcaaagcctttaaaatagtgtccctgcgttacacacggaaagcatgtattcagctcggaacagaacagacctgcaaatccgtagactccaatgattgcctagtaaccacctctgtcaaagtctgccttattgggactgtgagcaaattccaaccctccgacacgctcttgttcctcggaccgctcgagcaagggggccttatcttcaaacagtggtgcactacaacctgccaatttggcgacccaggagacataatgtctacccccgtcggcatgaagtgccccgaattaagcgggtccttccgcaagaaatgtgcctttgccacaaccccggtctgtcaattcgacggcaataccctctccggatacaaaagaatgatcgcgacgaaggattctttccagagcttcaacgttaccgagccccacatcagcgccagcagcctcgagtggatagatcccgattcgtccctacgcgaccacatcaatgttatcgtcggccgagacctttcattccaagacctttccgaaacaccctgtcaagtcgacctcgccacctcatcgatagacggagcctggggaagcggcgtagggttcaacctagtatgcagtgtctccctcactgaatgctccactttcctaacgtccatcaaggcctgcgacagcgccatgtgttacggatccacgacagcgaatctcttgcgcggacaaaacaccgtacacatagtcggtaaaggcggacactctggatcaaaattcatgtgctgccacgacaccaagtgctccagcaccggcctcgttgcagccgcgccccacctcgaccgcgttaccggttacaaccaagccgactccgacaaaattttcgacgacggtgcacccgaatgcgggatatcctgctggttcacgaaaagcggcgaatggatcctcggcgtattgaacggaaactggatggtagtggcagtcctcgtagccctattcatcctgagcatattccttttcaccctctgttgcccccgacgtccatcatacgccaaagagcacaaaccttaa

SEQ ID NO: 15080 - RNA, 3447 nt, synthetic construct
  misc_feature 1..3447: note = derived and/or modified CDS sequence (opt11) from PUUV(PUUV/Ardennes/Mg75/2011)__KT247602.1__GP
  source 1..3447: mol_type = other RNA
atgggcaagataatccccgtgtgcctgtacctcctgttcctgtgccttctgctgtgggaccgcggggacacccggaacctcaacgagctgaagatggagtgcccgcacactataggcctggggcagggcctcgtgatcggatcggtggagctgccgcccgtgcccctgacgcaggtcgagtccctcaagctggagagcagttgcaacttcgacctacacacctccacctccagccagcagtccttcaccaagtggacgtgggagatgaaggtcgacctcgccgagaacacccaggccagctccacgagcttccagaccaagtccagcgagatcaacctgcgcggcctgtgccttgtgccgcccctcgtcatcgagacggcggcccggactcgcaagaccatcgcctgcttcgacctgtcctgtaaccaaaccgcctgccagcccacggtgttcctcatcggacccatccagacctgcattaccaccaagagctgcctgctggggctcggcgaccagcggatccaggtcaactacgagaagacgtactgcgtctccgggcagctggtcgagggcatctgcttcaaccccgtgcacaccatggccctgtctcagccctctcacacgtacgacatcgtcaccgtgatggtgcgctgcttcctcatcgtcaaaaaggtgtccaccggggactccatgaagctagagaagtccttcgagaccctggtgcagaagaccggctgtaccggcaacgggttccaaggctactacgtctgcctgatcgggagctctagcgaacccctgtacatcccgacgcttgacgactaccggtccgcggaggttctgagccgcatggccttcgctccgcacggcgaagaccatgacatcgagaaaaacgccatctcagcgatgcggatcgtgggcaaggtcaccgggaaagcccctagcaccgaatcctcggacaccgtgcagggcatcgccttttccggtaaccccctgtacacgtcgactggcgtgctgaccgccaaggatgatcccatctacatctgggccccggggatcataatggagggcaaccactccgtctgcgacaagaaaaccctccccctgacgtggaccggattcatccccctgcccggggagatcgagaagacaacacagtgcactgtgttctgcaccctggctggcccgggggccgactgcgaggcctacagcgagaccggcatcttcaatatctccagtcccacttgcctgatcaaccgcgtccagcggttcagaggggccgaacagcagatcaagttcatctgccaacgggtggacatggacatcaccgtgtactgcaacggcctgaagaaggtcattctcacaaaaaccctggtgataggtcagtgcatctacaccttcacgtccatcttcagcttaatccccggggtggcccactccctcgcggtagaactgtgcgtgcccggactgcacgggtgggcgacaatgctcctgctgctgaccttctgcttcggctggatcctcattcccttcttcagcatgatcctgctgaagatcctcatcgccttcgcctacttgtgctccaagtacaacacggacagcaagttcaagattctcatcgagaaggtgaagaaggagtaccagaagaccatggggtctatggtctgcgaggtctgccagtacgagtgcgagacggccaaagagctcgagtcccaccgcaagagctgccccatgggctcctgcccctactgcctgaaccccgcggaggccaccacgagcgccctgcaggcccacttcaaggtgtgcaagctcacgtcccggttccaggataacctaagaaagagccttggcgcctacgagccgaagcaggggtgctaccggacgctctccctcttccgttacagatcacgcttcttcgtcggcttcatctggtgcttcctgctcgtgctggagctgatcgtgtgggcggcatccgccgagacccagaacctcaacagcgggtggaccgatactgcccacggctccggcataatccccatgcgcacggacctcgaactggacttcagcctcccctccagcgcgagctacacgtaccgccgccagctgcagaaccctgccaacgagcaggagaagatacccttccacctccagatcagcaagcaggtcatccacgccgagatccagcacctggggcactggatggacggcaccttcaacctgaagaccgccttccactgctacgggtcctgcgagaagtacgcctacccctggcagacggcgggttgcttcgtcgagaaggactacgagtacgaaagcgggtggggatgcaacccgcccgactgccccggcgtggggaccggctgcaccgcctgcggggtctacctggacaagctcaagagcgtgggtaaggccttcaagatcgtgtccctaaggtacacgcgcaaagcctgcatccagctggggacggaacaaacctgcaagagcgtcgactccaatgactgcttagtgaccacaagcgttaaagtgtgcctgatcggcacagtgtccaagttccagcccagcgacaccctcctgttcctggggcccctggagcagggcgggctcattttcaagcagtggtgcaccaccacgtgccacttcggggacccgggcgacatcatgtccacccccgtgagcatgaagtgtcccgagctgtccggcagcttccggaagaagtgcgccttcgcaaccacccccgtctgccaatttgacggaaacaccctgtccggatacaagcgcatgatcgccaccaaagacagctttcaatccttcaacgtcaccgagccgcacattagcgccagtagcctcgagtggatcgaccccgactccagcctgcgggaccacatcaatgtgatcgtcgggcgcgacttatccttccaggacctcagcgagaccccctgccaagtggacttagcgacctcgtccatcgacggcgcgtgggggagcggagtggggttcaacctggtctgctcagtcagcctcacggaatgttccaccttcctgaccagcatcaaggcttgcgactctgccatgtgctacggcagcaccacggctaacctgctccggggccagaacaccgtgcacattgtcgggaaaggcgggcactcagggagcaagttcatgtgctgccacgacactaagtgctccagcaccggcttggtcgccgcggcgcctcacctggaccgtgtgacggggtacaaccaggccgactccgataagatcttcgacgacggcgccccggagtgtggtatcagctgctggttcaccaaatctggtgagtggatactcggggtcctgaacggcaactggatggtggtggcggttctggtggccctcttcatcctgagcatcttcctgttcactctctgctgcccacggcgcccatcctacgccaaggagcacaagccctga

SEQ ID NO: 15081 - RNA, 3447 nt, synthetic construct
  misc_feature 1..3447: note = derived and/or modified CDS sequence (opt11) from PUUV(PUUV/Jura/Mg2/2010)__KT247598.1__GP
  source 1..3447: mol_type = other RNA
atgggcaagatcatccccgtgtgcctgtacctcctgttcttatgcctcctgctgtggaaccgcggggacacgcggaacctcaacgagctaaagatggagtgcccgcataccatcggcctggggcagggcctcgtcatcgggagcgtggagctgccgcccgtgcccctaacgcaggtagagagtctcaagctggagagctcctgcaacttcgacctgcacaccagcacctccagccagcagtcattcaccaaatggacgtgggagatgaagagtgacctcgccgagaacacccaggccagcagcacctccttccagaccaagagctccgaaatcaacctacgggggctgtgcctcgtgccgcccctggtgatcgagacggcggcccggacccgcaagaccatcgcctgcttcgacctgagctgcaaccagaccgcctgccagccaacggtcttcctaataggccccatccagacctgcctgaccacgaagtcctgcctgctcgggctgggcgaccagagaatccaggtgaactacgagaagacgtactgcgtgagcgggcagctggtagagggcgtgtgcttcaaccccatccacaccatggccctctcccagccctcgcacacctacgacatcgtgaccgtaatggtgcgctgcttcctgatcgtgaaaaaggtctccacgggtgacagcatgaagatagagaagtccttcgagacgttggtgcagaaaacaggctgcaccggcaacgggttccagggctactacgtgtgcctcatcggttcgagctccgagcccctgtacatccccacgttggacgactaccggagcgcggaggtcctctcccgcatggccttcgccccgcacggagaggaccacgacatcgagaagaatgccatcagcgcgatgcggatcgtgggcaaagtgaccgggaaggccccctccaccgagagtagtgacaccgtccagggcatcgcctttagcggtaaccccctgtacacgtccaccggggtgctgaccgccaaggacgaccccatctacatctgggcgccggggataatcatggaagggaatcacagcgtgtgtgaaaagaagactttgcccctgacgtggaccggcttcatccccctgccgggggaaatcgagaagaccacccagtgcacagtcttctgcaccctcgcgggcccgggggccgactgtgaggcctactccgagaccggcattttcaacatcagctccccgacctgcctgataaaccgtgtgcaacggttccgcggtgctgagcagcaaatcaagttcatttgtcagcgcgtcgacatggacatcaccgtgtactgcaacggattaaagaaagtcatcctcaccaaaaccctggtcatcggccaatgcatttacaccttcaccagcatcttctccctgatccccggggtggcccatagccttgcggtggagctttgcgtccccggcctccacgggtgggccactatgctgctgctgctgaccttttgcttcggctggatcctcatacccttcaccgccatgctgctgctcaagatcctgatcgctttcgcctacctgtgttcgaaatacaacaccgacagcaagttcaagatcctcatcgaaaaggtgaagaaggaataccagaagacgatggggtctatggtgtgcgaggtctgtcagtacgagtgcgagacagcgaaggaactagaatcccaccggaaaagctgccccatgggctcctgcccctactgcctgaaccccgccgaagccaccaccagcgccctccaggcccattttaaggtgtgcaagctgacgtccagattccaggataacctgcgcaagagcctcggcgcgtacgagccgaagcagggttgctaccgaaccctgtccctgttccgctaccggagccgcttcttcgtcggcctcgtctggtgcttcctgctagtgctcgagctgatcatatgggccgcctccgcagagacccagaatctgaactcgggttggaccgacacggcccacggctccggcgtgatccccatgcggaccgatctcgagcttgacttcagcctgccctccagcgcatcctacacctaccgccgccagctccaaaacccggccaacgaacaggagaaaatcccctttcacctccagataagcaaacaggtcatccacgcggaaatccagcacctggggcactggatggacggcactttcaacctgaagacagccttccactgctacgggtcctgtgagaagtacgcttacccctggcaaaccgccggctgcttcgttgagaaggactacgagtacgaaagcgggtggggctgcaacccgcccgattgccccggcgtggggaccgggtgcaccgcctgcggggtctacctggacaagctcaagagcgtgggcaaagccttccggatcgtatccctgaagtacacgcgcaaggcctgcatccagctggggacggaacagacctgcaagtcagtcgactccaacgattgcctggtgaccacgagcgtgaaggtctgcctcatcggcaccgtttccaagtttcagccctccgacacactgctgttcctcggacccctggaacaaggcgggctgatctttaaacagtggtgcaccacgacctgtcagttcggggacccgcgggacatcatgtccacacccgtaggcatgcgctgccccgagctcagcgggtccttccggaagaagtgcgcgttcgccaccacgcccgtctgccaattcgacggtaataccatctctggctacaagcgcatgatcgccaccaaggactccttccaatcgtttaacgtgaccgaaccgcacatctccgcctcgtccctggagtggatcgatcccgacagctccctgcgggatcacataaacgtgatcgtcgggcgcgatctcagcttccaggatctttccgagaccccttgccaggtggatctaacgaccaccagcatcgacggcgcctgggggagcggtgtggggttcaacttaatctgcagtgtcagcttaaccgagtgctccacgttcctgaccagcatcaaagcgtgcgactccgccatgtgctacggcagcaccacggccaacctcatgcggggccagaacacgatccacattgtggggaagggtggtcactccggctcaaagttcatgtgctgccacgacaccaagtgctcctccaccggcctggtggccgcggcgccccatctagaccgcgtcaccgggtacaaccaggccgacagcgataagatcttcgacgacggcgcaccggagtgcggtatcagctgctggttcactaagtccggagaatggatcctgggtgtcctaaacggcaactggatggtggtcgctgtgctggtcgtcctcttcatcctgagcatcttcctgttcaccctctgctgcccacggagaccctcctacgccaaggagcacaagccgtag

SEQ ID NO: 15082 - RNA, 3447 nt, synthetic construct
  misc_feature 1..3447: note = derived and/or modified CDS sequence (opt11) from PUUV(PUUV/Jura/Mg214/2010)__KT247599.1__GP
  source 1..3447: mol_type = other RNA
atgggaaaaataatccccgtctgcctctacctactgttcctatgcctcctactatggaaccgaggagacacccggaacctaaacgagctaaaaatggaatgcccgcacaccatcggcctgggccaaggcctagtcatcggatcggtagagctaccacccgtcccactgacacaagtagaatcgcttaagctcgaaagcagctgtaactttgacctacacacaagcaccagcagtcaacaatccttcactaaatggacctgggaaatgaaatcagacctcgccgaaaatacccaagcatcctcaaccagcttccaaacaaaaagctcagaaatcaacctacgaggcctctgcctagtaccccctcttgtcatcgagacggcagcgcgcactagaaagacaatagcctgcttcgacctttcatgcaaccaaaccgcctgccaacccaccgtcttcctcatcggacctatacaaacctgcctaacaacaaaaagctgcctactcggtctcggcgaccaacgaatccaagtcaactacgagaaaacctactgcgtctcgggacaactggtagaaggcgtctgcttcaaccctatacataccatggcgctatcccaaccgtcccacacgtatgacatcgtcaccgtaatggtccgctgcttcctaatagtcaagaaagtttccaccggcgactccatgaaaatcgaaaaatctttcgaaacgttagtccaaaagaccggatgtacgggcaacggattccagggctattacgtctgtcttatcggatcatcctccgaaccgctgtacatccctacactcgacgactaccgaagcgccgaagtcctcagccgcatggcactcgctccccacggagaagaccacgacatagagaaaaatgccatcagtgctatgcggatagtgggaaaagtcaccggcaaagccccatcaaccgaatcctccgatacagtccaggggatagcgttctcaggaaatcctctctacacaagcaccggcgtcctcaccgcaaaagacgaccctatctacatatgggccccgggaatcatcatggaaggcaatcactcagtatgcgagaaaaagaccctaccacttacctggaccggcttcatccccctccccggtgaaatcgagaaaaccacacaatgcacggtcttctgcactctcgccggcccaggcgccgattgcgaagcctacagcgaaacaggaatcttcaacataagttcccccacctgtctcatcaaccgcgtacagcgattccggggagccgaacaacaaatcaaattcatttgccagcgcgtcgacatggacatcacagtgtattgcaacggcctcaagaaagtgatcctcaccaaaactctcgtaatcggacaatgcatctacacattcacttcaattttcagccttataccaggggtcgcccacagccttgctgtagaactctgcgtccctggtctacacgggtgggctactatgctactattgctcacattctgcttcgggtggatcctaatccccttcactgcaatgctgctactcaaaatactcatcgcctttgcctacctatgctccaaatacaataccgacagcaagttcaaaatcctaatcgaaaaagttaagaaagaataccataaatcaatgggttccatggtctgcgaagtttgccaatacgaatgcgaaacggctaaagaactagaatcacaccgcaaatcgtgccccatgggaagttgtccctactgcctaaaccccgcagaagcgaccacatcagcactacaagctcatttcaaagtctgcaaactgaccagtagattccaagacaacctgcgaaaatctctcggggcctacgaacccaaacaaggctgctatcgtactctaagcctctttcgttaccgctcacgattcttcgtcggacttgtctggtgtttcctactggttctcgaactcataatctgggccgcctccgcagagactcaaaacctcaactcaggctggactgacaccgcccacggcagcggcgtaatccccatgcgtaccgacctagaactagacttctcgctgccctcatcagcctcatacacatacagacgccaactccagaaccctgccaacgaacaagaaaagattccttttcacctccaaatcagcaaacaggtcatccacgccgaaatacaacacctcggacactggatggacggaacctttaaccttaaaacagccttccactgctacggaagctgcgaaaaatacgcatacccatggcaaaccgccggttgcttcgtcgaaaaggattacgagtatgaatccggatggggctgcaacccacccgactgccccggagtgggaacagggtgtacagcctgcggggtctacctcgacaaactaaaatccgttggaaaagccttccgtatagtaagcctaaaatacacacgcaaggcatgcatccaactaggcacagaacaaacatgcaaaagcgtagatagcaacgactgcctcgtcacaaccagcgtaaaagtctgtctaatcgggaccgtcagcaagttccagccctccgacaccctcctattcctagggcccctcgagcaaggaggtcttatcttcaagcaatggtgcactaccacatgccaatttggagaccccggagacatcatgtcaacaccagtaggaatgagatgccccgaactgtccgggtccttccgcaaaaagtgcgcctttgcaaccaccccggtctgccaattcgacggtaacaccatctccggctacaaacgcatgatcgccacaaaagattcattccaatcatttaacgttactgaacctcacatcagcgcctcatccctcgaatggatcgaccctgatagctccctcagagaccacataaatgtcatagtaggacgcgatctcagcttccaggacctatccgagaccccctgccaggtcgatcttacaacaacctctatagatggcgcttggggctccggcgtcggcttcaatctcatatgctcagtatcactcacagaatgtagcaccttcctgaccagcatcaaagcatgcgattccgccatgtgttacgggagcaccaccgcaaatctcatgcgcggccaaaacaccatccatatcgtcggcaagggtgggcacagcggatcaaaattcatgtgctgccacgatacaaagtgttcctcaacaggcctggtagctgccgcaccccatcttgatcgggtcacgggatacaaccaagccgactcggataaaatatttgacgacggagcccccgaatgcggcatctcttgctggttcacaaaatcaggagaatggatcctcggggtcctcaacggaaactggatggtcgtcgctgtcctcgtagtactcttcatcctgtccatcttcctcttcacgctctgctgcccgcgccgaccttcctacgccaaagaacataagccgtag

SEQ ID NO: 15083 - RNA, 3447 nt, synthetic construct
  misc_feature 1..3447: note = derived and/or modified CDS sequence (opt11) from PUUV(PUUV/Orleans/Mg23/2010)__KT247600.1__GP
  source 1..3447: mol_type = other RNA
atgggtaagataataccggtgtgtctgtacctcctgttccgctgcctgcttttatgggaccgggggaacgcccgcaacctgaacgagctcaagatggaatgcccacacaccatcggcctggggcagggcctggtcattggctcagtggagctcccacccgtgccactgacccagatcgaatccttgaagctcgagtcatcctgcaatttcgacctacacacgagtacctccagccagcagtccttcaccaagtggacctgggagataaaatcggacctggccgagaatacccaagcgtccagcacctccttccaaaccaagtctagcgaggtcaacctccgaggcctgtgtctggtcccgccgctcgtgattgagaccgcagcccgcacaagaaagaccatcgcctgcttcgacctgtcctgcaaccagaccgcctgccagcccaccgtgttcttgatcggccccatccaaacgtgcatcacgacgaaatcctgcctcttaggcctgggggaccagcgcatccaggtgaactacgagaaaacctactgcgtgagcggacagctcatcgagggcatctgcttcaacccagtccatacgatggcgctgtcccagccctcacacacctatgatgtggtgactgtaatggtgcgatgcttcctgatcgtgaagaaggtctcaaccggggactcaatgaagatcgagaaatccttcgaaactctcgtgcagaagaccggctgtacaggcaacgggttccagggctactacgtgtgccttatcgggtccagctccgagcccttgtatatccccaccctcgatgactacaggagcgcggaggtcctgtcccggatggcttttgctccccacggcgaagaccatgacatcgaaaagaacgcgataagtgcaatgcgtatcgttggaaaggttaccgggaaggcgccatcgaccgaggcgagcgacaccgtccagggtatcgcgttctcagggaaccccctgtacaccagcacgggcgttctaaccgcgaaggacgaccccatctatatctgggccccgggaatcatcatggagggcaaccactccgtatgcgagaagaagacactgcccctgacctggacaggcttcatccccctccccggcgagatagaaaagaccacacagtgcaccgttttctgcactctggccggtccgggcgccgactgcgaagcctacagcgagaccggcattttcaatatcagcagcccgacctgcctgatcaatcgtgtccaacgctttcgcggggctgagcagcagatcaagttcatctgccagcgggtcgacatggatatcaccgtgtattgcaacggccttaagaaggtgatcctaacgaagacgttcatcataggccagtgcatctatacctttacctccatcttcagcctgatccccggggtcgcccactccctcgccgtggagctgtgcgttccaggcctgcacgggtgggccaccatgctcctgttactcacgttctgcttcggctgggtcctgatccccttcttctctatgatcctgctgaaaatcctcatcgcctttgcgtatttatgttccaagtacaatacggatagcaagttccggatcctaatcgagaaggtgaagcgcgagtatcagaaaaccatgggttccatggtgtgcgaggtctgtcaatacgagtgcgagactgccaaggaactcgagtcccacagaaagtcgtgccccatgggcagctgcccctactgcctgaaccccgccgaggccacgaccagcgccctacaggcgcacttcaaggtgtgcaaactcacctcgcggttccaagacaacctgcgcaagtccctgggcgcctacgagccgaaacaggggtgctaccgtaccctctccctttttcggtaccggtcacgcttctttgtgggtttcatctggtgctttcttcttgtcctggaactcatcatctgggccgcctccgcagagacgcagaacctcaacagcgggtggaccgataccgcccatggctccggtgtgatacctatgcggaccgacctggagctcgacttcagcctccccagcagcgcctcctacacgtaccgccggcaattgcagaacccggccaacgagcaggagaagatccccttccatctgcagatctccaaacaggtcatccacgccgagatacagcacctgggtcactggatggacggcacctttaaccttaagacagcgttccactgctacgggtcctgtgagaagtatgcctatccctggcagaccgcaggctgtttcatcgaaaaggactacgagtacgagagcgggtggggctgcaatccgcccgactgcccaggcgtcggcacgggctgcaccgcatgcggggtgtacctggacaaactcaagtccgtcggaaaggccttcaagattgtctcgctgcgctacacccggaaggcgtgcatccagctggggaccgagcagacgtgcaagtccgtggactcgaacgactgtcttgtgaccaccagcgtcaaggtttgcttaatagggacagtttccaagttccagcccagtgacacgctcttattcctaggccccttggaacaaggcgggttaatcttcaagcagtggtgtaccacgacctgtcacttcggggacccgggcgacataatgagtacccccgccggtatgaaatgcccggagctaagcggctcgttcaccaagaagtgcgccttcgcccccaccccggtctgccagttcgacggcgacactacgtcggggtacaagaagatgatagccaccaaggactcgttccagagcttcaacgtgaccgagccgcacatctccgcgagtagtctagagtggatcgaccccgaccgcagcctacgggaccatatcaacgtgatagtaggccgcgacctgtcattccaggatttgagcgagaccccctgccaggtagacctcaccacgacctccatcgacggggcctggggcagcggcgtgggattcaacctgatctgcagtgtctccctgaccgagtgcagcaccttcttaacgtccatcaaagcctgcgatagcgccatgtgttacggctccactacggcgaacctgctgcggggacagaacaccgtgcacatagtgggcaagggagggcacagcgggtccaagttcatgtgctgccacgacacgaagtgcagctccaccgggctcgtcgccgccgccccgcacctggatcgtgtgaccggctacaatcaggccgacagcgacaagatctttgacgatggcgcgcccgagtgcgggatttcctgctggctcaccaaatcgggggaatggatactcggggtactgaacggcaactggatggtcgtcgctgtgctggtcgctctgttcatattctccatcttcctgttcacactgtgctgtcccaggcgcccaagctacgccaaagagcacaagccgtga

SEQ ID NO: 15084 - RNA, 3447 nt, synthetic construct
  misc_feature 1..3447: note = derived and/or modified CDS sequence (opt11) from PUUV(PUUV/Orleans/Mg29/2010)__KT247601.1__GP
  source 1..3447: mol_type = other RNA
atgggtaaaataattcccgtgtgtctatacctactcttccgttgcctccttctctgggaccgcggtaacgcccgcaacctgaacgagttaaagatggaatgtccccacaccataggactcggtcaaggcctcgtcatcggctcggtcgagctcccaccagtacccctcacccaaatcgaatcattaaagctcgaatcctcatgcaacttcgacctccacacatcgacttccagccaacaatcttttaccaaatggacatgggaaatcaaatcagaccttgcagaaaacacccaggcgtcatcaacctccttccaaactaaaagctcagaagtcaacctacgcggcctctgtctcgtgccacccctagtcattgaaacagcagcccgaaccagaaagaccatagcctgcttcgacctaagttgcaaccaaaccgcatgccagcccactgtcttcctaataggacccatacaaacctgcataaccaccaaaagctgcctcctcggtcttggggaccagcggattcaagtcaattatgagaaaacatactgcgtttccggccaactcgtcgaaggcgtctgctttaacccaatccacaccatggccctttcgcaaccaagccacacatacgacatagtaaccgtcatggtacgatgcttcctcatagtaaagaaagtatctacgggagattctatgaaaatcgaaaaatcatttgaaaccctagtacagaaaaccgggtgcacaggaaacggcttccaaggttactacgtctgcttaataggctcatccagcgaaccgctctacatcccaacccttgacgattaccgatccgccgaagtactaagccgcatggccttcgcgccccacggtgaagaccacgacatagagaaaaacgccatcagtgccatgagaatagtcggcaaagtcacaggtaaagccccatccacagaagcctccgacactgtccaaggaatagccttctccggcaacccgctttacacctcaaccggagtcctcacagcaaaagacgaccccatttacatctgggcgccaggcataataatggaaggcaaccactccgtatgcgaaaagaaaacactcccactaacttggaccggcttcataccccttcccggagagatcgagaaaaccacccaatgcacggtattctgcaccctcgcaggacccggcgccgattgcgaagcctactcagaaactggaattttcaacatttcctccccaacctgcctaatcaaccgagtccaacgcttccgcggggcagaacaacaaatcaaattcatatgccaaagagtggacatggacatcaccgtctattgcaacgggttaaagaaagtcatactaacaaaaacgttcataataggacaatgtatttatacttttaccagcatattctcccttatccccggggtcgcccacagcctcgccgtagaactctgcgtcccaggcctccacggatgggccaccatgctactactcctcacattctgcttcggctgggtactaatccccttctttagcatgatcctactgaaaatactgatagcattcgcctacctctgcagcaaatacaacacagactccaaattccgcatcctcatcgagaaggttaaaagggaataccagaaaaccatgggatccatggtctgcgaagtctgccaatacgaatgcgagacagcgaaagaacttgagtcccacaggaaatcctgccccatggggtcatgcccctactgcctcaacccggccgaggccaccacctcagctctgcaagcccatttcaaagtatgtaaactcacctcccgtttccaggataacctccgtaagagcttaggcgcctacgaacctaaacagggctgctaccgcaccctaagcctcttcagataccgcagccgattcttcgtaggcttcatctggtgcttcctgctggtactcgaactaatcatctgggcagcttctgccgaaacccaaaacttaaactccgggtggacagacacagcccacgggtccggggtaatacccatgcgaacagacctcgagctagacttttccctgccctcatctgccagctacacctaccgccgtcaactccaaaaccctgccaacgagcaagagaaaatcccctttcacctacaaatatccaaacaagtcatccacgccgaaatacaacacctgggccactggatggatggcacattcaatctcaaaacagcattccactgttacggatcctgtgaaaaatatgcctacccttggcaaacggctggatgtttcatagaaaaagactacgaatacgaatctgggtggggttgcaacccacccgactgccctggagtcggtacaggatgcaccgcctgcggagtatacctagacaaactaaaatccgtcggcaaagccttcaagatcgtctccctccggtacacccgaaaggcttgcatccagttaggaaccgaacaaacctgcaaatcagtagactccaatgactgcctagtcacaaccagcgtgaaagtgtgcctcatcggcactgtttctaaattccaaccatccgataccctactcttcctgggtccactcgaacaaggaggccttatcttcaaacagtggtgcaccacaacctgccacttcggagacccaggtgacataatgtctaccccagcaggcatgaaatgcccagaactatccgggtctttccgcaaaaagtgcgccttcgcgcccaccccggtgtgccacttcgacggcaagactatttcaggctataaacgtatgatcgctaccaaagacagcttccaaagtttcaatgtgacagaaccacacatatccgcctccagccttgaatggatcgaccccgactcgtcactcagagaccacataaatgttatagtcggccgagacctctctttccaagatctttcagagacaccttgccaagtcgacctcacaacaacatccatcgacggtgcctggggatccggcgtcggattcaacctaatctgctctgtctccctaacagaatgcagcaccttccttacctccatcaaagcctgcgatagcgcaatgtgctacggatccaccacagccaacttattgcggggccaaaacaccgtccacatcgtcggtaaaggcggtcattctggcagcaaattcatgtgctgccacgacaccaaatgctccagcacgggccttgtagcagcagccccacatctcgacagagtgaccggttacaaccaagcggattcagacaagatcttcgacgacggcgctcccgaatgcggaatctcctgttggctcaccaaatccggagagtggatactcggagtcctaaacggtaactggatggtcgttgcggtgctcgtagcactcttcatattttccatctttcttttcacactctgctgtccgcgccgtccttcctacgcaaaagagcacaagccctag

SEQ ID NO: 15085 - RNA, 3447 nt, synthetic construct
  misc_feature 1..3447: note = derived and/or modified CDS sequence (opt11) from PUUV(Vranica)__U14136.1__GP
  source 1..3447: mol_type = other RNA
atgggtaaactctccccagtctgcctctacctcttcctccaatgcctcctactctggaatcgcggttccgcgcgaaacctgaacgagctcaagatggaatgcccacacactataggactcggtcagggcttagtcatcggatccgtcgagctacctcccgtccccatccagcaggtcgaatcccttaaacttgagtccagctgtaatttcgacctacacacatcgactgctacacaacaatccttcactaaatggacctgggaaatgaaagacgaccttgcagaaaacacccaagcctcatccacctcgttccaaaccaagtccagcgaagtgaatctgcgcggcctttgcctgatacctcccctagtggtagaaaccgcaagccgcactcgaaaaacaatcgcgtgtttcgacatatcatgcaaccaaaccgtctgccaacccacagtctatctcgtaggccccatacaaacttgcatcaccaccaaaagctgccttcttggcctgggcgatcaacgtatccaggtcaactacgagaaaacctactgcgtatcagggcagctcatcgaaggcgtctgtttcaatcccgtccacacgcgagccctctcacaaccgagccatacctacgacattgtcaccatgatggtacgttgcttcctagtggtaaagaaagtgacctccggcgactccatgaaaatagagaaaaactttgaaacacttgtgcagaaaacggactgcaacgccaacggcttccaaggttactacatttgcctagtcggcagctcctcagaacccctttacgtacccaccttagacgactaccgtagcgccgaagtactttcccgcatggccttcgcgccccacggagaagaccacgacgtagagcgaaacgcagtctctgcgctccggatcgtaggaaaagtcacgggaaaagcccccagcaccgaagcctccgataccgtccaaggcatagccttctcaggatcgcccctatacacgtccaccggcgtactgacagctaaggacaaccccgtctatatctggtcgcccggaattataatggaaggcaaccattcagtttgcgagaagaaaaccctcccgctcacctggacaggtttcatacccctccccggcgaaatagagaaaaccccacaatgcacggtcttctgcactctagcaggacccggagcggattgtgaggcgtactcagaaacaggcatctttaacatatcctccccgacctgcctcctgaaccgcgtacaaaggttccgcggcgccgaacaacaaatcaaattcgtctgccaacgcgtggacatggacataactgtatactgcaacggaatgaagaaggtaatccttacaaaaaccctagtgatcggacaatgcatctacaccttcacaagtatcttctcactcatacccggcatcgcacactccctggccgtcgagctgtgcgtccccggcctacacggatgggccacagtcctcttactcctcacattttgtttcggctggatactaatccccttcatcgcaatgatcctactaaaaatcctcatcgccttcgcctacctttgttcgaaatacaacacggactcaaaattcaaaatacttatcgaaaaagtaaagaaagaataccagaaaactatgggtagcatggtctgcgaagtctgccaatacgagtgcgagactgccaaagaactcgagagtcaccgcaagtcttgccccatcggttcctgcccgtactgtctaaatccctccgaagccaccaccagtgccctacaggcacactttaaagtatgcaagctgacttcccgcttccaagataacctacgcaaatcactagccgcttacgaacccaaacaaggatgctaccgcaccctctcactgttccgctacagatcacgtttcttcgtcggtttcatatggtgcatcctcctagttctcgagctagtaatttgggcagcaagcgccgaaacccagaatctcaactcaggctggacagacacagcccacggcagcggcgtggtccccatgcgaacagacctcgaactcgacttctctcttccttcaagcgcatcctatacctaccgccgacaactccaaaaccccgcaaatgaacacgaaaagatcccgttccacctccaaataagtaaacaagtgattcacgccgaaatccaacacctgggtcactggatggatgcaactttcaacctaaaaacagccttccactgctacgggctctgcgagaaatacgcatacccgtggcagaccgcaggctgcttctttgagaaagactacgagttcgaatccggatggggctgtaatcctcccgactgccccggcatcggcacgggctgcacagcctgcggtgtctatttagacaaactgaaatccgtaggaaaagtattcaagataatctcactccgctacacaaggaaggcatgcatacaactaggcacagaacaaacctgcaaatccgtcgatagcaacgactgcctcgtcacaacatcaatcaaagtatgcttaatcggaaccgtatcaaaattccaaccctcagacactctattattcctaggccccctcgaacaaggcggcctcatattcaaacaatggtgcaccacaacctgccaattcggagaccccggggatataatgtccaccttaaccggaatgaaatgcccagaactcaacggcagcttccgcaagaaatgcgctttcgccactacacccgtttgccaatttgacggaaatacgatatccggctacaaacgcatgatggccaccaaagactccttccaatcatttaacgtcacggaaccccacatatctacgtcagcccttgaatggatcgacccagactcaagcctccgggaccacatcaacgtagttgtctctcgagacctatccttccaagacctctccgaaacgccctgccaggtagacctcacaacctcttcgatagatggcgcttgggggtcgggagttggctttaacctcgtttgcaccgtctcgctcacagaatgcccaacatttctcacgtcgattaaagcctgcgactccgcgatgtgttacggcagcaccacaaccaacctggtacgaggccaaaacaccgtacacatagtcggcaaaggaggccacagtggctcaaaattcatgtgctgtcacgacaccaaatgttcttccaccggccttatcgccgcagcacctcacctggatcgcgtcaccggatttaaccaagcggactccgacaaaatcttcgatgacggcgcccccggctgcggtatgagctgctggttcaagaaatcaggcgaatggatcctaggtgttctaaacggcaattggcttgtagtagccgtcctcatcgctcttttcatactttcaatcttcctgttcaccttatgctgcccccgccgacccacgtacaccaaagagcacaaaccataa

SEQ ID NO: 15086 - RNA, 3447 nt, synthetic construct
  misc_feature 1..3447: note = derived and/or modified CDS sequence (opt11) from PUUV(CG1820/POR)__KT885051.1__GP
  source 1..3447: mol_type = other RNA
atgggtgaactcagccctgtatgcctctacctactcctccaaggcttactactctgcaataccggcgccgcacgcaacctgaacgagctcaaaatggaatgcccgcacacaatccgcctcggacagggactcgtcgttggctcggtggaactcccaagtctgccaattcaacaagtcgaaaccctcaaacttgagtccagctgcaacttcgacctacatacaagtaccgcaggacaacagtccttcacaaaatggacctgggaaataaaaggagatcttgcggaaaacacacaagcctccagcacctcgttccaaaccaagagctcagaagtaaacctacgcggactttgtctaataccaaccctagtcgtcgaaaccgcggcccgtatgcgtaaaaccatcgcatgctacgacctgagctgcaaccaaaccgtatgccagcccacagtctacctcatgggaccaatccagacctgcataacgaccaaatcctgcctcctatccctaggggatcaaagaatccaagtcaactacgaaaagacctactgcgtatcgggtcaactcgtcgaaggcatctgcttcaacccgattcacaccatggccctatcacaaccctcacacacatacgacattatgaccatgatggtacgatgtttcctcgttataaagaaagtgaccagcggcgatagcatgaaaatagagaaaaacttcgaaacactcgtccagaaaaacggttgcacagccaataacttccaaggatactacatctgcctcataggttccagctcagaaccgctctacgtaccagcactagacgactacagatccgcagaagtcctttcccgcatggccttcgccccgcacggcgaagatcacgacatcgagaaaaacgcagtatcggctatgcggatagccggcaaggtcacaggaaaagcaccgtccaccgaatcatctgacactgtccaaggaattgcattctcagggtctcccctctacacttccacgggagtgcttacttctaaagacgaccccgtctacatatgggcccccggcattataatggaaggcaaccactcaatctgcgaaaagaaaactctacccctcacttggaccggatttatcagcctccccggcgaaatagagaaaaccactcaatgtaccgtattctgcaccctagccggacccggcgccgactgcgaagcatacagcgaaaccggaatcttcaatataagctcgcccacatgcctaataaatcgagtccagcgcttccgaggtagcgaacaacaaatcaaattcgtatgccagcgcgtcgacatggacataaccgtctactgcaacggcatgaaaaaggtcatcttaaccaaaacgctagtaataggccaatgcatctacacctttacctccatcttttccctaataccgggggtcgcgcatagtttagccgtggaactctgcgtccccggactacatggctgggcaacaatgctcttactcctcaccttctgcttcggttgggtcctcatacccacgatcaccatgatcctgctcaagatcctaatagcatttgcgtacctgtgcagcaagtacaacaccgactcaaaattccgaatcctgatcgaaaaagtaaagcgagaataccagaaaaccatgggaagcatggtctgcgaagtctgccaatatgaatgcgaaacagctaaagaacttgaaagccacagaaaatcttgctccataggctcctgcccgtactgcctcaatcccagcgaagctaccacctctgccctacaggcccacttcaaagtatgcaaactaacatcacgtttccaagaaaacttacgcaagtccctgacagtatacgaacccatgcaaggatgctaccgcactctatccctattccgctaccggagccggttcttcgtgggtctagtgtggtgcgtactgctagttctagaacttatagtctgggctgcatcagccgaaacccaaaacctaaacgccggctggacggacaccgcccacggatccggcataattccaatgaaaaccgaccttgaactcgattttagcctccccagctccgctagctacacataccgacgccaactccaaaaccccgctaatgaacaagagaaaatccctttccatctccaactgtcaaaacaagtcatccacgcagaaatccaacaccttggccactggatggacgccaccttcaatctcaaaactgccttccactgttacggctcatgcgaaaagtacgcctacccctggcaaacagccggctgcttcatagaaaaggactacgaatacgaaaccggttggggatgcaacccgccagactgtccaggggtcggcacaggttgcaccgcctgcggtgtttatttagacaaactgaaatccgttggcaaagtcttcaaaatcgtcagtctccggtacacccgcaaagtgtgcatacaactcggcaccgaacagacatgcaagaccgtcgattccaacgactgcctaataaccacgtcagttaaagtatgcctaatcggaaccatatccaaattccaaccctccgacacactcttgttcctaggcccccttcagcaaggaggcctaatatttaaacaatggtgcaccaccacatgccaattcggcgacccgggcgatatcatgtccacccccactggcatgaaatgtcccgaacttaacggctccttccgaaagaaatgcgccttcgccaccacacctgtctgccaattcgatggaaacacaatttcgggctacaaaagaatgatcgccacaaaagactcgttccaatcctttaacgtgacagaaccacacatctctaccagcgcccttgagtggatcgacccagacagctccctccgcgaccacataaacgtaatagtatcacgagacctctccttccaggacctatccgaaacgccatgtcaaattgacctagccaccgctagcattgacggcgcgtggggtagcggggtagggttcaaccttgtatgcaccgtgtcactaaccgaatgcagcgcctttctgacctccataaaggcatgcgacgcagccatgtgttacggctccaccactgccaatctcgtacgcggacaaaacacaatacacatcgtcggcaaagggggacactccggctccaaattcatgtgctgccacgacaccaagtgttcatccaccggcctagtcgccgccgccccacaccttgacagagtaacagggtacaatcaggccgattcggataagatctttgacgatggcgcccccgaatgcgggatgtcttgctggttcaaaaagtcaggagaatggatccttggcgtcttaaacggaaactggatggtagtcgcggtccttgtcgtcctccttatactctcaatactcctattcactctctgctgcccccgccgaccctcctacagaaaagaacataagccctag

SEQ ID NO: 15087 - RNA, 3447 nt, synthetic construct
  misc_feature 1..3447: note = derived and/or modified CDS sequence (opt11) from PUUV(DTK/Ufa-97)__AB297666.2__GP
  source 1..3447: mol_type = other RNA
atgggtgagctttcacccgtctgcctataccttcttctacaaggacttctcctctgtaacaccggcgcagccaggaatctcaacgagctcaagatggaatgcccccacacagtaagactcggccagggtctcgtcgtcggctcggtagaactacccagccttccgatacagcaagtcgagacgctcaaactagagagctcctgcaatttcgacctccacacatcaaccgcaggccaacaatcattcaccaaatggacttgggaaatcaaaggggacctagccgaaaacacacaagcgagttctacctccttccagaccaagtcatccgaagtcaacctgagagggctgtgcctcatacccacactcgtggtcgaaacagcggcccgcatgcgaaaaaccattgcgtgctacgacctatcatgcaaccaaactgtatgccaacccaccgtatatctgatgggacccattcagacctgtatcacaaccaagtcgtgcctcctctccctaggagaccaacgaatccaagtgaactacgagaaaacctactgcgtgtcgggccagctggtagaaggaatctgtttcaacccaatacacacaatggcactctctcaaccgtcccacacctacgacataatgaccatgatggtacgttgcttcctagtaataaagaaagttacctccggagactccatgaaaatcgagaaaaacttcgaaacacttgtgcaaaagaacggctgtactgccaataactttcaaggctattacatatgcctgatcggctccagctcggaacctctctatgtcccagcactagacgactaccgctcagccgaagtcctatcgcgaatggccttcgcacctcacggcgaagaccacgatattgagaaaaatgcagtctcagcaatgcggatagctggaaaagtcaccggcaaagccccttcaacagaatcaagcgatacggttcaaggcattgccttctcaggctcgcccctctacacatccaccggagtactcacgtcaaaggacgaccccgtttatatctgggcaccaggtatcataatggaaggcaaccactcaatatgcgaaaagaaaacacttccactaacatggacaggcttcatatcactaccaggagaaatcgagaaaacgactcagtgcaccgtcttctgcaccctcgcaggccccggggccgactgtgaagcctactccgaaactggcatcttcaacatatcctccccaacgtgcctaataaaccgcgtacagcggttccgaggcagtgaacaacaaataaaattcgtatgccagcgcgtcgacatggacatcactgtatactgcaacggcatgaagaaagtgatattaaccaaaacgcttgttatcggacagtgcatctacaccttcacctccatcttctcgctcatacccggagtcgcccactccctagcagtagaattgtgcgtccccggcctgcacggctgggccaccatgctcctactactgacattctgcttcggatgggtactaatacccaccatcaccatgatcctccttaaaatcttaatagcgttcgcctatttgtgtagcaaatacaacacggactcaaaattccgtattctcatcgaaaaagtaaagcgcgaataccagaaaaccatgggctccatggtatgcgaagtctgccaatacgaatgcgaaaccgccaaagaattagaatcccaccgcaaatcctgttccataggatcctgcccgtactgtctcaacccctccgaagccacaacatccgcactccaagcccattttaaagtctgcaaactaacctcccgctttcaagagaacctgcgcaaatccctaaccgtgtacgaaccaatgcaaggttgctacagaacactctccctattccggtaccggtctcgcttctttgtaggtctcgtctggtgcgtcctccttgtgctagagcttatcgtgtgggccgcctccgccgaaacacaaaacctcaacgcgggctggaccgacaccgcccacggatccggaatcatacccatgaaaaccgacctcgaacttgacttcagcctccccagctcggcttcatacacgtaccgcagacaactgcaaaatccagcgaacgaacaagagaaaatccccttccatctccaactctctaagcaggtaatccacgccgaaatccaacacctaggccactggatggacgccacctttaacttaaagacagcattccattgctacggatcctgcgaaaaatacgcgtatccttggcaaaccgccggctgtttcattgaaaaggactacgagtacgaaactggatggggatgcaacccacccgattgccccggtgtcggcaccggctgcaccgcgtgtggtgtctacctcgacaagctgaaatcggtaggaaaggtattcaagatcgtatccctccgatatacacgaaaagtatgcattcagctcggaaccgaacaaacctgtaaaaccgtagatagcaacgactgcctcattacaacatctgtcaaagtatgccttattggcacaatatcaaaattccagccctcggacaccctactcttcctaggtccactccaacagggtggcttaatattcaagcaatggtgcaccacgacctgccagttcggcgatcccggcgatataatgagtacacccaccggaatgaaatgccccgaactcaacggctcctttagaaagaaatgcgcctttgccacgactcctgtctgccaattcgacggcaacacgatatcgggctacaaacgaatgatagccacaaaggactccttccaatcgttcaatgtcaccgaaccgcacatctcaacctccgcgttagaatggatcgacccagatagttcactccgcgaccacattaacgtgatcgtctccagagacctcagctttcaggacctatcagaaactccctgccaaattgaccttgcaactgcaagcatcgacggggcttggggaagcggcgtggggttcaacctcgtctgcaccgtctcccttacggagtgctcagccttcctaacatcaataaaagcatgtgacgccgccatgtgttatggctccacaaccgccaacctcgtacgcggccaaaacacgattcacatagtcggtaaaggcggccattcaggaagcaagttcatgtgttgccacgacacaaaatgttcatccaccggcctggtcgcggcagcaccacacctcgaccgcgtgaccggatacaaccaggccgactccgataagatcttcgacgacggagcgcccgaatgcggtatgtcctgctggttcaagaaatccggagagtggatcctaggcgtcctcaacggcaactggatggtcgtcgcagtcctcgtagtactcctcatcctgtccattcttctattcaccttatgctgccctcgtcgcccttcgtacagaaaagaacacaaaccataa

SEQ ID NO: 15088 - RNA, 3447 nt, synthetic construct
  misc_feature 1..3447: note = derived and/or modified CDS sequence (opt11) from PUUV(PUU/Cg-Erft)__AJ238778.1__GP
  source 1..3447: mol_type = other RNA
atgggcaagatcatccctgtatgcctgtacctcctgttcctgtgcctcctgctgtggaaccgcggagacgcccggaacctcaacgagctgaagatagagtgcccgcacaccatcggcctggggcagggcctcgtcatcgggagcgtggaactgccgcccgtgcccctgacccaggtcgagtccctcaagctggagagctcctgcaacttcgacctgcacacgagcacctccagccaacagcccttcaccaagtggacctgggagatgaagtccgacctcgccgagaacactcaggcgagctccaccagcttccagaccaagtccagcgagatcaacctgcgcggcttatgcctcgtgccgcccctggtaatcgagacagccgcccgcacgcgcaagaccatcgcctgtttcgacctgtcctgtaaccagaccgcctgccagcccaccgtcttcctcatcggccccatccagacgtgcatcaccaccaaaagctgcctgctggggctcggcgaccagcggatccaagtgaactacgagaagacctactgcgtgtccggccagctggtcgagggcgtgtgcttcaaccccgtgcacacgatggcgctgagccagccctcccacacctacgacatcgtcaccgtgatggtgcgctgcttcctcatcgccaagaaggtcagcaccggggactccatgaagctggagaagtccttcgagacgctggtgcagaagaccagctgcaccggcaatggcttccaggggtactacatttgcctcgtgggcagcagctccgagcccctgtacatcccgaccctggacgactaccggagcgccgaggtcctctcccgcatggccttcgcgccccacggggaggaccacgacgtggagaagaacgccatcagcgccatgcggatcatcggcaaggtgacgggcaaggccccctccaccgagagctccgataccatccagggggtcgccttcagcggcaaccccctgtacaccagcacgggggtgctgaccgcgaaggacgacccggtgtacatctgggcccccgggatcatcatggaggggaaccacagcgtctgcgacaagaagaccttacccctgacctggacgggcttcatccccctgccgggcgagatcgagaagaccacccagtgcaccgtgttctgcacgctcgccgggcccggcgccgactgcgaggcctactccgagaccgggatcttcaatatcagctccccgacctgcctgatcaaccgcgtccagcggttccgcggcgcggagcagcagatcaagttcatctgccagcgggtggacatggacatcaccgtgtactgcaacgggctgaagaaggtcatcctcaccaagacgctgatcatcggccagtgcatctacaccttcaccagcattttctccctgatccccggcgtggcccacagcctcgccgtggagctgtgcgtccccgggctgcacggctgggccaccatgctcttgctgctgacgttctgcttcgggtggatcctcatccccttcttctccatgatcctgctgaagatcctcatcgccttcgcgtacttgtgctcgaagtataacacagacagcaagttcaagatcctgatcgagaaggtgaagaaggagtaccagaagaccatgggctccatggtgtgcgaggtctgccactacgagtgcgagaccgccaaggagctcgagagccaccgcaagtcctgccccatggggagctgcccctattgcctgaacccggccgaggccaccacctccgccctgcaagcgcacttcaaggtgtgcaagctcaccagccggttccaggacaacctgcgcaagtccctgggcgcctacgagcccaagcagggctgctaccggaccctcagcctcttccgctaccggtcccgcttcttcgtgggtttcatctggtgcctgctcctggtcctggagttgatagtgtgggccgccagcgcggagacgcaaaacctgaactccggctggacagacaccgcccacgggagcggcatcatccccatgcggaccgacctggagctcgacttctccctgccgagctccgccagctacacgtatcgccgccagctgcagaaccccgccaacgagcaggagaaaatccccttccaccttcagatctccaagcaggtcatccacgccgagatccagcacctgggccactggatggacgggacctttaacttaaagaccgcgttccactgctacggctcatgcgagaagtacgcctacccctggcagaccgccgggtgcttcatcgagaaggactacgagtacgagagcggctgggggtgcaacccgcccgactgccccggcgtgggcacggggtgcaccgcctgcggcgtgtacctcgacaagctgaagtccgttgggaaggccttcaagatcgtcagcctgcggtacacccgcaaggcgtgcatccagctcggcaccgagcagacgtgcaagtccgtggacagcaacgactgcctggtgaccacctccgtcaaggtgtgcctgatcgggaccgtgagcaagttccagccctccgacacgctcctgttcctgggcccgctcgagcagggcgggctgattttcaagcagtggtgcaccacgacctgccagttcggcgaccccggggacatcatgtccacccccgtcggcatgaagtgccccgagctgaacgggtcattccggaagaagtgcgcctttgccaccaccccggtgtgccagttcgacggcaacaccctcagcggctacaaacgcatgatcgccacgaaggactccttccagtcattcaacgtgaccgagccccacatctccgcctcctccctggagtggatcgaccccgacagctccctgcgggaccacatcaacgtcatcgtggggcgcgacctcagcttccaggacctgtccgagaccccctgccaggtggacctggcgaccaccagcatcgacggcgcctgggggagcggcgtcgggttcaacctcgtgtgctccgtgagcctgacggagtgctccaccttcctgaccagcatcaaggcctgcgactccgccatgtgctacggcagcaccacggcaaacctcctccggggccagaacaccgtccacatagtggggaagggcgggcactccggcagcaagttcatgtgctgccacgacacaaagtgctcctcgaccggcctggtggccgccgccccgcacctcgaccgcgtcacggggtacaaccaggccgactccgacaagatcttcgacgacggcgcgccggagtgtgggatcagctgctggttcacaaagtccggcgagtggatcctgggggtgctgaacggcaactggatggtggtcgccgttctcgtggccctgttcatcctgagcatcttcctcttcaccctgtgctgcccccggcgcccctcctacgccaaggagcacaagccgtga

SEQ ID NO: 15089 - RNA, 3447 nt, synthetic construct
  misc_feature 1..3447: note = derived and/or modified CDS sequence (opt11) from PUUV(PUUV/Konnevesi/Mg_M105A/2005)__JQ319173.1__GP
  source 1..3447: mol_type = other RNA
atgggcaaatcctcgcccgtgtgcctgtacctaatcctccaaggcctactgctcataggcgcggtcaatgcacgcaacctcaacgaactgaaaatggagtgtccgcacaccataggcttaggccaaggcctagtcgtcggatctgtagagttacccccggtccccatccaacaggtcgaatcccttaaacttgagtcgtcatgcaacttcgacctccacaccagcacagcgggccaacaatcattcaccaaatggacctgggaaacaaagtccgatctagccgaaaacacccaggcctccagcaccagcttccagacaaaaagctccgaagtcaacctacgcggactctgcctcatccccaccttagtagtcgaaacagcggcccgcatgcgcaaaacgatcgcctgctacgacctctcctgcaaccagaccgtctgccaaccgacagtctacttaatggggcccatacaaacatgcctgacaacaaaatcctgcctcctgggcttaggcgaccagcgaatccaggtgaactatgaaagaacatactgcgtgtccggccagcttgtagaaggagtctgcttcaacccaattcacaccatggccctctctcaaccttcccacacctacgacatagtcaccgttatggtacgatgcttcctagtaatcaagaaagtaacctctggtgatagcatgaaaattgaaaagaactttgaaacgctcgtccagaaaacagggtgcacagccaacagtttccaaggatactacatttgtctcgtgggcagttcctcagaacccctctacgtacccaccctagacgactataggtccgccgaagtgctatcccgcatggcattcgctccccatggagaagaccacgatatcgaaaagaacgccatttcagcactaagaatagctggaaaagtcacgggaaaagctccctcaaccgaatcctcagacacagtccaaggcatagcgttttccgggtcacccttgtacaccagcaccggcgtcctcaccgccaaggacgatccggtctacatatgggccccggggatcatcatggaaggaaaccactccgtctgtgaaaagaaaacactgcccctcacatggacaggcttcatccccctccccggagagatagagaaaacgacacaatgcacagtcttctgcactttagccggccccggagccgactgtgaggcttactccgaaaccggcatcttcaacatctcctccccaacctgcctaatcaacagagtccaacgcttccgcggagccgaacagcaaatcaaattcgtgtgccaacgcgtcgacatggacatcacggtctactgcaacggggtaaagaaagtgattctaactaaaaccctagtaatagggcagtgtatctacacattcacgagcatattctccctaatccccggaatcgcacactccctagccgtcgaactttgcgtgcccggtttacacggctgggctacagtcctccttctgctgaccttctgcttcggatgggtactgatcccgaccatcaccatgatcctcctgaaaatcctcattgcattcgcctacctatgcagtaaatacaacaccgactcaaaattcaaaatcctagtagaaaaagtcaagaaagaataccagaaaacaatgggctccatggtctgcgaagtttgccaatacgaatgcgaaacagcaaaagaacttgaatcccacagaaaatcatgctcaatcggatcttgcccgtactgcctcaaccccagcgaagcaacacccagtgccctccaagcccacttcaaagtatgcaaattgacatccagattccaagagaacctcaagaaatctctcacaatgtacgaaccaatgcaaggatgctaccgaaccctctccctcttccgctaccgatcgcgcttctttgtcggcctcgtctggtgcatgctcctagtcctagaactgatagtatgggcagcatcagcagagactcaaaacctcaatgccggctggactgataccgcacacggatccgggatcataccaatgaaagccgacctcgaactcgacttcagcttaccatcatcagcatcatatacataccgccgacaactccaaaaccccgctaacgaacaagagaaaataccattccacctccaaatatcaaaacaagtaatacacgcggaaatccagcacctaggacattggatggacgccaccttcaacctaaaaacagcgttccactgctacggatcttgcgaaaaatacgcctacccatggcaaaccgcgggctgcttcgtagaaaaagattatgaatacgaaacagggtggggctgtaatcccccagactgccccggcgtcggcaccgggtgtacggcgtgtggcgtatacctagataaattaaagtccgtcggaaaagtattcaaaatagtgtcgctgcgatacacccggaaggtgtgcatacaacttggtaccgaacaaacctgtaaaaccgtggactccaacgactgcctcatcacgacatctgtcaaagtctgcctaatcggcaccataagcaaattccagccctccgacaccctcctctttctcggtcccctccaacaagggggactaatattcaagcaatggtgtaccacgacctgccaattcggcgatcccggtgatatcatgtccacccccaccggaatgaaatgtccagaactcaacggcagcttccgtaagaaatgcgcctttgcaaccaccccagtttgccagttcgacggcaacacgatttcgggttacaaacggatgatcgccaccaaagatagctttcaatcattcaacgttacagaaccccacataagcacaagcgctctggaatggatagacccagactcctctctgcgcgaccacatcaacgtaatcgtttcacgagacttaagtttccaagatctgtccgagacgccctgtcaaattgatttaactgcgtctgccattgacggtgcatggggtagcggagtaggcttcaatctggtctgcaccatcagcctcaccgaatgcagcaccttcctcacttccatcaaagcctgcgacgctgccatgtgctacggctcgacaactaccaacctagtccgtgggcagaacacaatacacgtcgtcggaaaaggtggacactccggcagcaagttcatgtgttgccacgacactaaatgctctagcacaggcctagtcgcagccgcaccccacctaaacagagtaacaggcttcaaccaggccgactccgacaagatctttgacgacggcgcccccgaatgcggcgtctcctgctggttcaagaaatccggcgagtgggtactaggcgtcttgaacggaaactggatggtggtcgcagtccttatcgccctactgatactttcaatattcctgtttgcactctgctgcccgcgccgaccatcttacaagaaagaacacaaaccctaa

SEQ ID NO: 15090 - RNA, 3447 nt, synthetic construct
  misc_feature 1..3447: note = derived and/or modified CDS sequence (opt11) from PUUV(PUUV/Konnevesi/Mg_M114B/2005)__JQ319175.1__GP
  source 1..3447: mol_type = other RNA
atgggcaagagctcccccgtgtgcctgtacctcatcctgcaggggctgctcctgttcggcgccgtcaacgcccgcaacctgaacgagctcaagatggagtgcccgcacaccatcgggctgggccaggggctggtggtggggagcgtcgagctcccgcccgtgccaatccagcaggtcgagtccctgaagctggagagctcctgcaacttcgacctccacaccagcacggcggggcagcaatccttcaccaagtggacctgggagatcaaaaacgatctggccgagaatacccaggccagctccacgagcttccagacgaagtccagcgaggtgaacctgcgggggctctgcctgatccccaccctggtggtggagaccgccgcacgcatgcggaagacgattgcgtgctacgacctcagctgcaaccagaccgtttgccagccaaccgtgtacctgatgggcccaatccaaacctgcctgacgaccaagagctgcctcctgggattaggcgaccagcgcatccaggtgaactacgagcggacctactgcgtctccggtcaactcgtggaaggcgtgtgcttcaaccccatccacacgatggccctgagccagcccagccacacgtacgacatcgtcaccatcatggtgcgctgcttcctggtcatcaagaaggtcaccagcggcgacaacatgaagattgagaagaatttcgagacccttgtgcagaagacaggatgtaccgcgaactccttccaaggctactacatctgcctggtgggaagcagcagtgagcccctgtacgtccccacactcgacgactaccggagcgccgaagtgctgtcccgcatggcgttcgcgccccacggcgaggatcacgacatcgagaagaacgcaataagcgccctgcggatcgccggcaaggtgacaggaaaagccccgtcaacggagagctccgacaccgtccagggcatcgctttcagcggcagccccctctacaccagcaccggcgtgctgacggccaaggatgaccccgtctacatttgggcccccgggatcatcatggagggcaatcactcggtgtgcgagaagaagacccttccgctcacctggaccggcttcatccccctgcccggggagatcgagaagacaacccagtgcaccgtgttctgcacccttgccggccccggggcggattgcgaggcctacagcgagacgggcatctttaatatctccagcccgacctgcctcatcaacagagtgcagcggttccgcggggccgagcagcagatcaagttcgtgtgccagcgggtggacatggacatcaccgtctactgcaacggcgtgaagaaggtcattctgaccaagaccctggtcatcgggcagtgcatctacacgttcacctccattttcagcctcatccctggtatcgcccactccctggccgtggagctgtgcgtgcccggcttacacgggtgggccaccgtcttactgcttctgaccttttgcttcggctgggtgttgatccccacgatcaccatgatcctactcaagatccttatcgccttcgcctacctatgcagcaagtacaacaccgactccaagttcaagatcttagtggagaaggtcaagaaggaataccagaagaccatggggagcatggtttgcgaagtgtgccagtacgaatgcgagacggccaaggagctggaaagccaccgcaagagttgcagcatcggctcctgtccgtactgcctgaaccccagcgaggcaaccccctcagcgctccaggcccacttcaaggtctgcaagctaaccagccggttccaggagaaccttaagaaatccctcaccatgtacgagcccatgcagggctgctaccgtacgctcagcctgttccggtatcgctcccggttctttgtggggttggtatggtgcatgctgctcgtcctcgagctgatcgtgtgggctgcctccgcggaaacccagaacctgaacgccggctggaccgacacggcccacgggtccggcatcattccaatgaaggcagaccttgagctggacttcagcctgccctccagcgcctcttacacgtaccgccggcagctccaaaaccccgcgaacgagcaggaaaagatcccgttccatctccagatctcaaagcaggttatccacgccgagattcaacacctgggccactggatggacgcaaccttcaatctgaagacagcgttccattgctacgggtcctgcgagaagtacgcctacccctggcagaccgcgggctgcttcgtggagaaggattacgagtacgaaacggggtggggatgcaatccgcccgattgccccggggtgggcaccggctgcaccgcctgcggggtatacctggacaagctcaagagcgtcggcaaagtgttcaagatcgtgagcctgcgctacacccgcaaggtctgcatccagctggggactgagcagacctgcaagaccgtggattccaacgactgcctgatcacaacgagcgtgaaggtctgcctcattggcaccatctcaaagttccaaccatcggacaccctgcttttcctcggccccctgcagcagggcggcctgatcttcaaacagtggtgcactactacctgccagttcggagaccccggcgacattatgagtaccccgaccggaatgaagtgccccgagctcaacggcagcttccggaagaagtgcgccttcgcgacgacccccgtctgccagttcgacgggaacaccatctccggatacaagcgcatgatcgccactaaggatagcttccagtccttcaacgttaccgagccccacatcagcacgtccgcccttgagtggatagacccggacagctccctgcgagaccacatcaacgtcatcgtgagccgcgacctttccttccaggacctgagcgagaccccctgccagatcgacctaatcgcgtccgccatcgacggcgcatgggggagcggggtcgggttcaacctcgtctgcaccgtgtccctgactgagtgcagcacgttcttaaccagcattaaagcgtgcgacgccgccatgtgctatggctccaccaccatcaacctcattcgggggcagaacacgatccacgtggtcggcaagggcgggcactctggctccaaattcatgtgctgccacgacaccaagtgctcatccaccgggctggtggccgccgcgccccacttagatcgcgtcacaggcttcaaccaagccgactccgataagatcttcgatgatggtgcccccgagtgcggggtctcctgctggttcaagaagtcgggcgagtgggtccttggcgtgctgaacggcaactggatggtcgtggccgtgctgatcgccctcctgatcctctccatctttctcttcgcgctgtgctgcccgcggcgccccagctacaagaaagagcacaagccctga

SEQ ID NO: 15091 - RNA, 3447 nt, synthetic construct
  misc_feature 1..3447: note = derived and/or modified CDS sequence (opt11) from PUUV(PUUV/Konnevesi/Mg_M78B/2005)__JQ319174.1__GP
  source 1..3447: mol_type = other RNA
atgggtaaaagttcccccgtctgcctttacctcatcctacaaggactgcttcttttcggagcagtaaacgcgcgcaacttgaatgaactcaaaatggaatgcccccacactattggcctcggccaaggtctcgtagtcggctccgtagagctcccacccgtgcctatccaacaagtagagagcctaaaactagaatcaagctgcaacttcgatctacacacatccacggccggacaacagagctttaccaaatggacatgggagattaaaaacgacctcgcagaaaacacccaagccagctcgacctcttttcaaacaaaatcatccgaagtaaacctccgcggcctctgcctcatcccaacgctagtggtggaaactgccgcacgcatgcgaaaaactatcgcctgctatgacttaagctgtaaccaaaccgtttgccagccaacagtgtatttaatgggccccatccaaacctgcctaaccactaaaagctgcctactcggacttggcgatcaacgaatccaagtcaactacgaaagaacatactgcgtgtctggccagctagtggaaggagtctgcttcaaccctattcacacaatggccctcagccaaccatcccacacctatgacattgtgaccatcatggtgcgctgctttttagttatcaagaaagtcacctctggcgacaacatgaaaatcgagaaaaacttcgaaacactggtacaaaagaccggctgcaccgcaaacgggtttcaaggatactacatctgcctcgtcggctcaagttcagagcccctctacgtacccacactagacgactatcggtcagcagaagtactatcacgcatggccttcgcgccgcacggcgaagaccatgacatcgagaaaaacgccatatctgcactacgtatcgcaggaaaggtcaccgggaaagccccctccaccgaatctagtgacaccgtacaaggaatcgccttctccggtagccccctgtacacttccaccggcgtcctcactgccaaagacgaccccgtctacatctgggcacccgggataatcatggaaggaaatcacagcgtctgcgaaaagaaaactcttcccctcacatggacagggttcatacccctccccggtgagatagagaaaacaacccaatgcaccgtattctgcaccctagcaggcccgggagccgactgcgaagcatactcggaaaccgggatcttcaatattagctccccaacctgtctaatcaaccgcgtccaaagattccgcggggccaaacaacaaatcaaatttgtatgccaacgggtcgacatggacatcaccgtctattgcaacggcgtgaagaaagtcattcttaccaaaaccctagtcatcggacaatgtatctacactttcactagcatcttctcccttatccccggtatagcacactcactcgccgtcgaactctgcgtacccggcctgcacggatgggccaccgtcttactccttctaacattctgttttggctgggtccttatccccaccatcaccatgatcctcctcaaaatcctcatcgccttcgcgtatctctgctccaaatataatacagactctaagttcaaaatacttgtagaaaaggtcaagaaagaataccagaaaaccatgggcagcatggtctgcgaagtatgccaatatgaatgcgaaaccgccaaagagctcgaatcacaccgcaaaagctgcagtatagggtcatgcccctactgcctaaacccatcagaagcaactccaagcgctctacaagctcacttcaaagtctgcaagctcacatcccgatttcaagaaaacctaaagaaaagcctcaccatgtacgaacccatgcaagggtgctaccgcacgctctcactcttccgctatcgctcccgcttcttcgtaggcctcgtctggtgcatgctcctagtactcgaactaattgtatgggccgcctcggcggagacccaaaacctcaacgccggatggactgacacagcccacggatcgggcatcatccccatgaaagcagatctagaattggactttagtctgccatcgtctgcctcctacacttaccgccgacaactccaaaaccctgccaatgagcaagagaaaatccccttccacctccaaatctcaaaacaagttatacacgccgaaatacaacacctgggccactggatggacgcgacatttaacctcaaaacagccttccactgctatggctcatgcgaaaaatacgcttacccatggcaaaccgccggttgcttcgtcgaaaaagactacgaatacgaaaccggctggggttgcaacccgcctgactgccccggcgttggcaccggctgcaccgcttgtggggtctatcttgataaactgaaatccgttggcaaagtatttaaaatagtatcgctgcgatacacccgcaaggtctgcatacagctgggcacagaacaaacctgcaaaacagtcgacagtaatgactgtctcatcaccacatcagtaaaggtctgtcttatcggcaccatctccaaattccagccttcggacactctactcttcctcggcccactccagcaaggaggactgatattcaaacagtggtgcaccaccacttgccagttcggtgaccccggggatataatgagtacaccaaccgggatgaaatgccccgaactaaatggcagctttcgtaagaaatgcgcattcgccactactcccgtgtgccaattcgacggtaacaccatctcaggctacaaacgcatgatcgctactaaagattccttccaatcattcaacgttacagagcctcacatctctacatccgccctagaatggatagacccggattcgtccctacgagatcatatcaatgttatagtgtcacgtgacctatccttccaagacctttccgaaacaccgtgccaaatcgatatgaccgcgtccgccatcgacggcgcatggggaagcggggtaggattcaacctcgtttgtacagtaagcctcaccgaatgttccaccttcctaacctccatcaaggcttgcgacgccgccatgtgctacggctccaccaccaccaacctcgttcgaggtcaaaacactatccacgtcgtaggaaaaggcggccactccggtagtaaattcatgtgctgccacgacactaaatgctcgagcaaaggcctcgtcgccgctgcgccccacctcgaccgagtaaccggatttaaccaagccgattcagacaaaatctttgacgacggcgctcccgaatgcggcgtatcctgctggttcaagaaatcgggggagtgggtgctaggcgtactcaacggcaactggatggtcgtcgcagtcctcatcgcacttctaatcctcagcatcttccttttcgcactctgttgcccccgcagaccctcatacaagaaagaacacaaaccctag

SEQ ID NO: 15092 - RNA, 3447 nt, synthetic construct
  misc_feature 1..3447: note = derived and/or modified CDS sequence (opt11) from PUUV(PUUV/Konnevesi/Mg_O78A/2005)__JQ319172.1__GP
  source 1..3447: mol_type = other RNA
atgggcaagtcgtcccccgtgtgcctataccttatcctgcaagggctgctcctgtttggcgccgtcaacgcccgcaacctgaatgagctcaagatggagtgcccgcacaccatcgggctgggccaagggctggtggtcggcagcgtagagctcccgcccgtgcccatccagcaagtcgagtccctgaaacttgagagctcctgcaacttcgacctccacaccagcacggccgggcaacagtcgttcaccaagtggacttgggagatcaagagcgacctggccgagaacacccaggccagtagcacgtccttccagaccaagagcagtgaagtgaacctgagggggctctgcttaatacctacactcgtggtggagacggcggcccggatgcggaagacgatcgcgtgctatgaccttagctgcaaccaaaccgtctgccagcccaccgtttacctgatgggccccatccagacctgcctaacaaccaagtcctgtctcctggggctaggcgaccagcgcatccaggtgaactacgagcggacctactgcgtcagcgggcaactcgtggagggcgtgtgcttcaaccccatccacaccatggcgctgtcccagccgagccacacatacgacatcgtcaccataatggttcgctgcttcctggtgatcaagaaggtgacctccggcgacagcatgaagatcgagaagaacttcgagaccctcgtgcagaagaccgggtgcaccgccaacagcttccaaggctactacatctgcctggtggggtcctcttccgagcccctgtacgtccccaccctcgacgactaccggagcgccgaggtgctatcccgaatggccttcgcgccccacggcgaagaccacgacatcgagaagaacgccatcagcgccctgcggatcgccggcaaggttacggggaaggccccgagcacggagagctccgacacagtccagggcattgccttcagcgggagcccactctacacaagcaccggcgtgctgacggccaaggacgatcctgtgtacatatgggcccccgggataatcatggagggcaaccactccgtgtgcgagaagaagacgttaccgctcacttggaccggcttcatacctctccccggggagatcgagaagacgacccagtgcacagtgttctgcaccctggccggccctggggcggactgtgaggcctacagcgagaccggcatcttcaacatttcctcgccgacctgcctcatcaaccgcgtccagcggttccgcggggccgagcagcagatcaagtttgtctgccagcgggtggacatggacatcaccgtctactgcaacggagtgaagaaggtcatcctgacaaagacgctggtcatcggccagtgtatctacacgttcacctctatctttagccttatccccgggatcgcccactccctagcggtggagctttgcgtgcccggcctccacgggtgggcgaccgtcctcctgctcttaaccttctgcttcggttgggtgctgattcccacaatcaccatgatccttctcaagatcctgatcgccttcgcctacctgtgcagcaagtataacaccgacagcaagttcaagatccttgtggaaaaggtcaagaaggagtaccagaagaccatggggagcatggtgtgcgaggtgtgccagtacgagtgcgagacggccaaggagctggagtctcaccgcaaatcctgctcgatcggctcatgtccgtactgccttaaccccagcgaggcgaccccatccgcactccaggcccatttcaaggtctgcaagctaaccagccggttccaagagaacctgaagaaatccctcaccatgtacgagcccatgcagggctgctacagaacactaagcctgttccggtaccgctcccggttcttcgttgggctcgtctggtgcatgctgttggtcttggagctgatcgtgtgggccgcgagcgcggagacccaaaacttgaacgccggctggaccgacaccgcccacgggtcgggtatcatccccatgaaggccgacctcgagctggacttctctcttccctctagcgcatcctacacgtacaggcggcagctccagaaccccgcgaacgagcaggagaaaataccgttccacctccagatcagcaagcaggtcatccacgccgagatccagcacctgggccactggatggacgccaccttcaacctgaagacagccttccattgttacgggagctgcgagaagtacgcgtacccctggcaaaccgcgggctgcttcgtggagaaggactacgaatatgagaccgggtggggctgcaacccgcccgattgtcccggggttggcaccggctgcaccgcctgcggggtgtacctggacaagctgaagtccgtaggcaaggtgttcaagatcgtgtccctccgttacaccaggaaggtctgcatccaactagggacggagcagacctgcaaaacagtcgactccaacgactgcctgatcacgacgagtgtgaaggtctgcctcatcggcaccatctccaagttccagccaagcgacaccctgctgttcctcgggcccttgcagcagggcggcctgatcttcaagcagtggtgcaccactacctgtcagttcggagaccccggcgacatcatgtccaccccgaccgggatgaagtgtcccgagctcaacggcagcttccgaaagaagtgcgccttcgccacgacccccgtgtgccagttcgacgggaacaccatctccggctacaagcgcatgatcgccaccaaggacagcttccagtcattcaacgtgaccgaaccccacatcagcacttccgctctcgagtggatcgacccggacagctccctgcgggaccacatcaacgtcattgtgagccgcgacctctccttccaggacctgagcgaaactccttgccaaatcgacctcaccgcctccgcgatcgatggcgcctgggggagcggcgtggggttcaatttagtctgcaccataagcctgacggaatgctccacctttctgaccagcattaaggcgtgtgacgccgcaatgtgctacggctccaccacgaccaacctcgtgcgggggcagaacaccatccacgtggtcggcaagggcgggcacagcggctccaagttcatgtgctgccacgacaccaagtgctcatccacggggctggtggccgccgcgccgcacctgaaccgcgtgaccggcttcaaccaggccgatagcgacaagattttcgacgacggcgcccccgagtgcggggtctcctgctggttcaagaagtccggcgagtgggtgctcggggtgctgaacggcaattggatggtcgtggccgtgctgatcgccttgctgatcctgagtatcttcctattcgcgctgtgctgcccacggcgcccctcctacaagaaagagcataagccctga

SEQ ID NO: 15093 - RNA, 3447 nt, synthetic construct
  misc_feature 1..3447: note = derived and/or modified CDS sequence (opt11) from PUUV(PUUV/Pieksamaki/human_kidney/2008)__JN831951.1__GP
  source 1..3447: mol_type = other RNA
atgggcaaaagctccccggtctgcctctacctgatcctccaaggcctactcctcttcggagccgtaaacgccagaaacctaaacgagctaaaaatggagtgcccccacactataggcctagggcaaggactcgtcgtaggcagcgtcgaacttccgcccgtccccatacaacaggtagagagcctaaaactcgaatcaagctgcaacttcgacctgcatacctccaccgccggccaacaatccttcacgaaatggacctgggaaatcaaatcggatctagccgaaaacacacaggcttcatccacctctttccaaaccaaatcatccgaagttaatctgaggggtctgtgccttatccccaccctagtggtggaaacagccgcgcgcatgagaaaaacaatcgcatgctacgacctctcatgcaaccaaacagtatgccaacccactgtttacttgatgggtccaatccaaacctgcctaaccacgaaatcatgcctgctcggcctcggcgaccagcgcatccaggttaactatgaacgaacttactgcgtatcaggccaactcgtcgaaggcgtatgtttcaacccaatccatactatggccttatcccaaccctcacatacatatgacgtcgtaacaatcatggtccgatgcttcctagtgatcaagaaagtgacatcgggcgattccatgaaaatcgagaaaaacttcgaaacactcgttcagaaaacaggctgcacagccaacaacttccaaggatattacatttgccttgtcggctctagctctgaacccctctacgtcccaacactcgacgactaccgatcagccgaggtcctgtcaagaatggcctttgcaccacacggagaggaccacgacattgagaaaaacgcgatatccgccctacgtatcgccggtaaggtcaccgggaaagctccctccaccgaatcctccgataccgtccaaggcattgcatttagtggctctccactgtacacctccacaggcgtgctaacggccaaagacgacccggtgtatatatgggccccaggcatcataatggaagggaaccactccgtctgcgaaaagaaaaccctaccactcacctggacgggatttataccgctcccaggagaaatagagaaaaccacacaatgcaccgtcttctgcacactcgcaggtcccggcgccgactgcgaagcatactccgaaacaggtatcttcaacatctcctcaccaacatgcctgataaaccgcgtacaacgcttccgcggcgccgaacagcagatcaagttcgtgtgccagcgcgtggacatggacatcaccgtctactgcaacggcgttaagaaagtcatactcactaaaactctcgtcattggacaatgcatttacaccttcacgagcatcttctctcttatacccggcatagcccattctctcgcggtagaactctgcgtccccggacttcacggctgggctaccgtcctcctactcttaaccttctgcttcggctgggtcctcatccccaccataaccatgatcctcctaaaaatcctcatcgccttcgcctacctctgctcgaaatataacactgacagtaaatttaagatcctcgtagaaaaagttaagaaagaataccagaaaacgatggggtctatggtctgtgaagtatgccaatacgaatgcgagaccgccaaagaactcgagtcccaccgcaagagctgtagcatcggatcatgcccctactgcctaaacccgagcgaagcaacgccatccgcgctccaggcacacttcaaagtatgcaaactaacctcacgcttccaggaaaacctcaagaaatcactcacaatgtacgagcccatgcagggctgttatagaacactcagcctcttccgctaccgatcgcgattcttcgtagggctggtgtggtgtatgctactcgtcctggaactcatcgtctgggccgcatccgcagaaacacaaaacctcaacgctggttggacagacactgcccatggctccggcatcatacccatgaaagcagatcttgaactcgattttagcctcccatcatcagcctcctacacctatagacgacaactacaaaacccggctaacgagcaggagaaaatcccatttcacctccagatttcaaaacaagtgatacacgctgaaatacagcacctgggacattggatggacgccaccttcaacctcaaaaccgctttccattgctacggcagctgtgagaagtacgcttacccatggcaaactgccgggtgcttcgtcgagaaggattacgaatatgagaccggctggggatgcaacccgcccgactgtcccggcgtgggcacaggctgcaccgcatgcggcgtctacctcgacaaactaaaatctgtcggaaaagttttcaaaatagtatcactgcgctacacccgaaaggtatgcatccagctcggcaccgagcagacgtgcaaaaccgtagacagcaacgactgtctcataacaacctccgtcaaggtctgcctcatcggaaccatcagcaagttccagccatcagacaccctcctattcctcggccctctccagcaaggaggcctcatctttaaacaatggtgcacaacgacctgccaattcggcgaccctggagacataatgtccacacccaccggtatgaaatgccccgaactcaacggttcgtttcgcaagaaatgtgccttcgccactaccccagtatgccaatttgacggtaacacgatctccggctacaaaagaatgatcgccacaaaagactcattccaatccttcaacgtcaccgaaccacacatatccacctccgccctcgagtggattgacccagactcctcccttcgagaccacataaacgtcattgtgtctcgcgacctatcatttcaagacctttccgaaacgccatgccaaattgacctaactgcctccgccatagacggcgcctggggctccggcgtcggattcaaccttgtatgtaccatcagcctcaccgagtgtagcacattcttaacatcaataaaagcctgcgacgcagcgatgtgttacggcagcaccaccactaacctagtacgaggacaaaacactatccatgtcgtcggcaaaggaggccattctggtagcaaattcatgtgctgccacgacaccaaatgctcctctaccggcctagtcgcagccgcaccccaccttgaccgagttaccggtttcaaccaagccgactcagacaagatcttcgatgacggcgcgccagaatgcggcgtcagctgctggttccgcaaatccggcgaatgggtcctcggagtactaaacggaaactggatggtcgtcgctgtcctcatcgccctactaattctgtcaatattcctattcgccctatgttgcccccgccgcccttcctacaagaaagaacacaaaccctaa

SEQ ID NO: 15094 - RNA, 3447 nt, synthetic construct
  misc_feature 1..3447: note = derived and/or modified CDS sequence (opt11) from PUUV(Samara_49/CG/2005)__AB433850.2__GP
  source 1..3447: mol_type = other RNA
atgggaaaactttcacctgtatgcctctacctcctcctgcagggactactgctttgcaaaacgggcacagctcgcaacctgaacgaactcaaaatggaatgcccacacaccatcggcctcggccagggactggttgtgggcagcgtcgagctacctcccgttcccatacaacaagtagagaccctaaaattggaaagctcatgcaacttcgacctccacacctcaaccgccggtcaacaagcattcacaaaatggacctgggagataaaaggagacctcgccgaaaacacgcaggcctcttcaacatccttccagaccaaaagctcagaggtcaaccttcgaggactctgcctgatccccactctagtgatagagacagccgcccggatgagaaagacgatcgcctgctacgatctcagctgcaaccaaaccgtatgccagcccacagtatatctaatgggtcccatccaaacctgcatcacaacaaaatcatgtctactggggctgggagaccaacgaatccaggtgaactacgaaaagacctattgtgtctccggccagcttgtcgaaggagtatgcttcaacccaatacacactatggcactatcgcaaccaagccacacctacgacatcgtaacgatgatggtccgatgcttcctagtcataaagaaagtaacctcaggtgactcaatgaaaatcgagaaaaactttgaaaccctcgtacaaaagaacgggtgcaccgcaaattcattccaagggtattacatctgcttaatcggctcaagctcagaaccgctctacgtccccaccctagacgactatcgctcggccgaagtcttgtcgcggatggctttcgcaccccacggtgaagatcacgacgtcgaaaagaacgccatctccgcactccgcatagccggcaaagtcaccggcaaagccccatccacagaatcctcagacaccgttcaaggcatcgccttcagcggatctcccctatacacctccacaggagtccttacagcaaaagacgaccccgtgtacatatgggcaccgggaattatcatggaaggtaaccactccgtctgcgaaaagaaaacgctaccactgacatggactggcttcatcagccttcccggtgaaattgagaaaacaacccagtgcaccgtattctgcacactcgcaggacccggagccgactgcgaggcttacagcgaaacaggcattttcaacatatcatccccaacctgcctcatcaaccgagtccaacgcttccgaggcgcagaacaacaaataaaattcgtatgccagcgagtcgatatggatatcacggtttactgcaacggcgtcaagaaagttatcctcacaaaaaccttagtcataggacagtgcatctacacattcacgagcatattctccctaatccccggcgtggcacactctctcgcggttgaactctgcgtccccggactacacggatgggccacaatgctactcctcctaacattctgcttcggatgggtcctaattcctaccatcaccatgatcctcctaaaaatcctaatcgccttcgcttacctatgcagtaaatacaacacagactccaaattccgcatactcatcgaaaaagtcaaacgcgaataccagaaaacaatgggatccatggtgtgcgaggtttgccaatacgaatgcgaaacagcaaaagaactagagtctcacaagaaatcctgttccattggctcttgcccctactgcctaaacccttctgaagccaccacgtcagccctacaagcccacttcaaagtctgcaaactcacatcccggttccaggaaaacctaagaaaaagcctaacagtgtacgaacccatgcaaggctgctaccgcacactaagcctcttccggtacagatcccgcttcttcgtaggattggtctggtgcgtactcctggtcctagaattaatcgtctgggccgcctcggccgaaacgcaaaacctcaacgcaggctggaccgacaccgctcacggaagcggcattatccccatgaaaaccgacctggaactagacttctccctaccctcatcagcgagttatacctatcgcagacaacttcaaaacccagccaacgaacaagaaaatatccctttccacctacaaataagcaaacaagtaatacacgcagaaatccaacacctcggccactggatggacgcaaccttcaatctaaaaaccgccttccactgctacgggtcttgcgaaaaatacgcttacccatggcagaccgccggctgcttcgtcgaaaaagactatgaatacgaaaccggctggggttgcaatcccccagactgccccggagtcggaacaggctgcaccgcatgcggtgcatacctcgacaaactaaaatccgtcggcaaagttttcaagatcgtatctctccgatacacaagaaaagtatgcatccaactaggaacagaacagacctgcaaaaccgtcgattctaacgactgcctgataaccacctccgtcaaagtctgcctaatcggaaccatcagcaagttccaaccatcagataccctactcttcctcggcccactccagcaaggcggcctaatattcaaacaatggtgcaccacaacctgccaattcggagaccccggcgacatcatgtcaaccccgaccggcatgaagtgtcctgatctcaacgggagcttccgcaagaaatgcgccttcgccacaacccccgtctgccaattcgacggaaacaccatcagcggttataaacggatgatagcgactaaagactccttccaatcctttaacgtaaccgaaccacacatctcagcctctgcgctcgaatggatagacccagattcaagtctgcgcgaccacattaacgtaattgtctccagagacctctccttccaagacctctccgaaaccccatgccagatagatctgagcacagcttccatcgacggagcctggggcagcggcgtaggtttcaaccttgtatgtaccgtaagcctaacagaatgctccgcatttctcacatcaataaaagcatgcgacgccgcaatgtgctacggctcaaccaccgcgaacctcatccgcgggcaaaacacgatccatatcgtgggaaagggtggccactccggcagcaagttcatgtgttgccacgatactaaatgctccacgaccggcctagtcgcggccgccccacaccttgaccgagtgacaggctacaaccaagcagactccgacaagatcttcgacgacggggccccagaatgcggaatgtcctgttggttcaagaaaagcggggaatggatactcggagtcctaaatgggaattggatggtcgttgcagtcttaattgcgctgcttgtactctccatcctcctgttcaccctttgctgcccccgccggccctcttacagaaaagaacacaagccctag

SEQ ID NO: 15095 - RNA, 3447 nt, synthetic construct
  misc_feature 1..3447: note = derived and/or modified CDS sequence (opt11) from PUUV(Samara_94/CG/2005)__AB433852.2__GP
  source 1..3447: mol_type = other RNA
atgggcaagctctctcccgtatgtctatacctccttctccaagggctactcctgtgcaacaccggaaccgcccgcaacctcaacgaactaaaaatcgaatgcccgcacacaatcggcctaggacaaggcctcgtagtcggtagcgtagaactcccaccagtaccaattcagcaagtagagacacttaaactagaatcctcatgcaacttcgacctacacacgtccacggcaggccagcaagcgttcaccaaatggacctgggagataaaaggcgacctcgccgaaaacacccaagcatcgtccacctcattccaaacaaaatcctcagaagtcaacctacgaggtctctgcctcatccctaccctcgtcatagaaacagccgcacgaatgcgcaaaaccattgcatgctacgacctctcttgcaatcaaactgtatgtcagcctaccgtatatctcatgggacccatacagacatgtatcaccacgaagtcatgcttactgggtctaggagaccagcggatacaagtcaactacgagaaaacatactgcgtaagcggccaactcgtcgaaggagtctgcttcaatcccatacataccatggcactctcacaaccaagccacacctacgacatcgtcactatgatggtacgctgcttcctcatcataaagaaagtgacctctggtgactccatgaaaatcgagaaaaatttcgaaaccctagtgcagaaaaacgactgcacagccaattcattccaaggatactacatctgcttcatcggatccagctcagaaccactttacgtcccaacactcgatgactaccgatcggccgaagtgctatcccgcatggccttcgctccccacggggaagaccacgacgttgagaaaaacgcaatatccgccctccgtatcgccggcaaagtaaccggtaaggccccttcaaccgaatcgagcgataccgtgcaaggtatcgcattctcgggctcgccgctctacactagcaccggggttctcgccgctaaagacgaccccgtatatatctgggcacctggcatcatcatggaaggaaaccactcaatttgtgaaaagaaaaccctcccgctcacatggacaggcttcatctcattaccgggagaaatcgagaaaaccacccaatgcactgtgttctgcaccctagcggggccgggtgccgattgcgaagcctactcagaaaccggcatattcaacatctcaagtccaacatgcctcatcaatagagttcaaagattccgaggcgcagagcaacagataaagttcgtctgccagcgagttgacatggacatcacagtatactgcaacggagtcaagaaagtaatcctaaccaagaccttagtcatcggccaatgtatctacaccttcacctcaatcttctcgctcatccctggagtagcacatagcctagcagtcgaactctgtgtacccggcctacacggctgggcgaccatgctactgctcctgaccttctgcttcggctgggtactgattcccaccataaccatgatcctattaaaaatcctgatcgccttcgcctacctgtgctcaaaatataacaccgattctaaattccgtatactaatagaaaaggtcaagaaagaataccagaaaactatgggatcaatggtatgcgaggtatgccaatacgaatgcgagaccgcaaaagagctggaaagccaccgaaaatcgtgcagtataggttcatgcccatactgcttaaacccttcggaagcaaccacatctgccctacaagcccacttcaaagtctgtaaattaacctcccgcttccaagagaacctcagaaaatcccttacggtgtacgaacccatgcaaggatgctacaggacgctatccctcttccgataccgctcccgattcttcgtaggcctcgtctggtgcgtgctactcgtcctcgaactaatcgtatgggccgcctcagcagagacccagaatctaaacgccggatggaccgacaccgcacacggatccggcatcattccaatgaaaactgaccttgaactagacttcagcctcccctccagcgcctcatatacctaccgaagacaactacaaaaccccgccaatgaacaagagaacatacctttccaccttcaaatttcaaaacaggtaatacacgcagaaatccaacaccttggccactggatggacgccaccttcaacttaaagaccgcgtttcactgctacggatcctgtgaaaaatacgcctacccctggcaaacggccggatgcttcgtcgaaaaagattacgaatacgaaacgggctggggctgcaacccaccagattgccctggcgtgggtacgggatgcactgcctgcggcgcctatcttgataaactgaaatctgtcggcaaggtctttaaaatcgtaagcctaaggtacacaagaaaagtgtgtatccaactaggaaccgaacaaacttgtaaaacagtagacagtaacgactgtctaatcactacaagcgtgaaagtctgtctcatcggaaccatctcaaaattccagccttccgacaccctcttattcctcggtccactccaacaaggcggactcatctttaaacaatggtgcacaaccacatgccaattcggcgaccctggtgacatcatgtcaactccaaccgggatgaaatgccccgacttaaacggctcatttcgtaaaaagtgcgccttcgccacaacacccgtctgccaattcgacggcaacactatctccggctacaaacggatgatcgccacgaaagactcattccagtccttcaatgtaaccgagccacacataagcgcaagtgcactagaatggatcgatcccgattcctcactccgcgaccacatcaacgtcatcgtgtcaagggacctcagcttccaggacctaagcgagacaccctgccaaatagatctcagcaccacctccatcgatggcgcatgggggtccggggttggtttcaacctagtgtgtaccgtctccctcacagaatgctccgcattcctgacttccataaaagcctgtgacgccgccatgtgttacggctcaacaaccgcaaaccttatccgcggccagaacacaatacacattgtcggcaaaggcggccactcgggcagcaaattcatgtgctgccacgacaccaaatgctcgacaaccggcctagtagccgccgcaccccacctagaccgagtcaccggatacaaccaagccgacagtgacaaaatcttcgacgacggagcgcccgagtgcggaatgtcatgctggttcaagaaatccggggaatggatcctcggagtcctgaatggcaattggatggttgtcgccgtactcatcgcactcctggtcctatccatccttctcttcaccctctgttgcccgcgccgcccctcataccgtaaagaacacaaaccttaa

SEQ ID NO: 15096 - RNA, 3447 nt, synthetic construct
  misc_feature 1..3447: note = derived and/or modified CDS sequence (opt11) from PUUV(Sotkamo)__NC_005223.1__GP
  source 1..3447: mol_type = other RNA
atgggaaaaagttccccggtctgtctctatctcatactccaaggactcttactcttcgacaccgtcaacgccaaaaatctcaatgagctcaaaatggagtgcccacatactattggcctcgggcaaggcctagtagtcggatcagtcgaactaccacccgttccaattcaacaaatcgaatccttgaaactcgagagctcttgcaattttgaccttcacacctcaaccgccggacaacaatcatttaccaagtggacctgggaaaccaagggagacctagccgaaaacacccaagctagctccacctctttccaaacaaaaagctccgaagtaaacctacgtggcctctgcctcatacccacactcgtcgtcgaaaccgccgctcgcatgagaaaaaccatcgcgtgctacgacctctcatgtaaccagaccgtatgccaacctaccgtttatctcatgggtcccatacaaacctgccttactaccaaaagttgtctccttggactcggagaccaacgtattcaagtaaactacgaacgaacatactgcgtctccggacaacttgtcgaaggcgtctgcttcaatcctatacacaccatggcactatcccaaccctcccacacctacgacatcgtgacgatcatggtacgttgcttcctcgtcatcaagaaggtcactagcggcgactcaatgaaaattgagaaaaacttcgaaacccttgtccagaagaccggatgcacagccaacggctttcaaggttactacatctgtctcatcggctcatcctccgaacctttatacgtccccacactagacgactatcgatctgcagaagtgctatcacgaatggccttcgcgccacacggcgaagaccatgacatcgagaaaaatgcagtatccgctctccgcatagctgggaaagtcacaggaaaagcccccagtacagagtcctccgacacagtccaaggaatagccttctcaggctccccactatacacctccacaggggtacttaccgccaaagatgaccccgtctacgtgtgggcccccggtataatcatggaaggtaaccactctgtttgtgagaagaaaacgctacccctaacctggaccggattcataccccttcccggcgaaatcgagaaaaccacccaatgtaccgtcttttgcacgctagcggggcccggagccgactgcgaagcatactccgaaaccggcatcttcaacataagcagccccacttgccttataaacagagtccaacgattccgaggggccgaacagcagataaagttcgtatgtcagagagtagacatggacatcaccgtatactgtaatggcgtcaagaaagtcatattaaccaaaacacttgtaatcggccaatgcatctatacattcacctcaatattctccatgatccccggcatcgcgcactccctcgcagtggaactgtgtgtccccggactccacggatgggccaccgtactcctccttctcacattctgcttcggctgggtcctcatcccaactatcaccatgatccttctgaaaatcctaatagccttcgcatacctctgctccaaatataacacagactccaaattcagaatacttgtggaaaaagtcaagaaagaataccagaaaacaatgggaagtatggtgtgcgaagtgtgccaatatgaatgtgaaacagccaaagaactcgaaagccaccgaaaatcctgctccataggctcatgcccatactgtcttaacccatccgaagctacccccagtgcgttgcaagcccacttcaaagtctgcaaacttaccagccgcttccaagagaatctaaagaaatcactcacaatgtacgaacccatgcaggggtgctaccgtacactcagcttattccgctaccgttcccgattcttcgtcgggttagtctggtgcatgctacttgtactcgaactcatcgtgtgggccgccagtgctgagacccaaaacctcaacgacggatggacagacaccgcccacggctcaggcatcatacccatgaaagcagacctcgaactagacttctcactaccctcctcggcatcgtacacgtatcgacgtcagctccaaaaccccgcaaacgagcaagagaaaataccatttcacctccagataagcaaacaagttatacatgcggaaatacagcacctcggccattggatggacgcaacattcaacctaaaaacggcctttcactgctatggcagctgcgaaaaatatgcctacccctggcagactgcaggatgcttcgtcgaaaaagactatgaatatgaaacaggctggggttgcaatcccccagactgccccggagtgggcacaggctgcaccgcctgcggcgtctacctcgacaaactcaaatctgtaggcaaagtgttcaaaatcgtctcacttcggtacacccgaaaagtctgcatccagctaggcacgggccagacttgcaaaaccgtcgactccaacgactgcctcattacaacaagcgtcaaagtatgcctcataggtacaatctccaaattccaaccctccgacacactcctcttccttgggccacttcaacaagggggcctaatcttcaaacaatggtgcacgacaacatgccaattcggagaccccggcgacattatgtccacccccaccggcatgaaatgtcccgaactaaacggctcctttcgcaagaaatgtgcctttgcaaccaccccggtatgccaattcgacgggaacaccatctccggctacaaacgcatggtcgccacgaaagactccttccagagcttcaacgtaaccgaaccccacatctccacatcagcacttgaatggatcgatctagactccagccttcgcgaccacatcaacgtgattgtgtcaagagacttgtccttccaagatctatcggaaactccatgccaagtagacctaaccacatccgcaacggacggagcctggggatcaggcgtgggattcaacctcgtatgcaccgtaagcctcacagaatgctccgcctttctgacctccatcaaagcatgccacgcagccatgtgctacgggtccaccaccaccaacctagtacgagggcaaaacaccatccacgttgtaggcaaaggcggccactcaggctctaaattcatgtgctgccacgacaccaaatgctcatccaccggactcgtcgccgccgcaccacacctcgaccgggtaaccggtttcaaccaagcagattccgacaaaatcttcgacgatggcgcccccgagtgtgggatgtcatgctggttcaagaagctcggggaatgggtcctcggagtcctaaatggaaactggatggtcgtagccgtactcatcgccctactcatccttagcatcttcctcttcgcactatgctgcccacgtcggccgtcttacaagaaagaccacaaaccttag

SEQ ID NO: 15097 - RNA, 3447 nt, synthetic construct
  misc_feature 1..3447: note = derived and/or modified CDS sequence (opt11) from PUUV(2009)__HE801634.1__GP
  source 1..3447: mol_type = other RNA
atgggtaaatcgtcccccgtctgtctatatctgatactacaaggcctcctccttttcgacaccgtcaacgcccgcaacctaaacgagcttaaaatggaatgtcctcacacaatcggcctcggccaagggctagtagtaggatccgtagaacttccacccgttcccatacagcaaatagaaagccttaagctcgaatcatcatgcaatttcgacctccacacctctacagccggccaacaatcgtttacgaaatggacctgggaaacaaaaggagacctggctgagaacacccaagcgtcctcaacatcattccagactaaatcctccgaggtaaacctacgtggactctgcctcatcccaactctagtcgtcgaaacagcagcccgcatgcgcaaaaccatagcctgctacgaccttagctgcaaccagacggtatgccaaccgaccgtgtaccttatgggccccatacaaacctgcttaactaccaagtcctgcttactaggcttaggcgaccaacggattcaagtcaactacgaacgtacgtattgcgtatccggacagctggtggaaggcgtttgttttaaccccatacacacaatggcactttcacaaccctcccatacctacgatatcgtcaccatcatggtacgttgctttctcgtcatcaagaaagtgacatccggagactccatgaaaatagagaaaaattttgagacactcgtacagaaaacaggctgcaccgccaacggcttccaagggtactacatctgcctgatagggtcttccagcgaaccactctacgtaccaacactagacgactaccgctccgccgaagtactctcgcgcatggccttcgccccgcacggtgaggaccacgacattgagaaaaacgcagtatccgccctcagaatcgcaggcaaagtcaccggcaaagccccctccacggaatcctccgacacagtccaaggtatcgccttctcagggtcacccttgtacaccagcacgggcgtcctcactgccaaagatgatcccgtatacgtgtgggcgcccggcatcatcatggaaggcaatcactctgtatgcgaaaagaaaacactcccgctcacctggacgggcttcatacccctaccaggcgaaatcgagaaaaccacccaatgcacagtcttctgcacactagcaggccctggcgcagactgcgaagcctactcagaaaccggaatcttcaacatttcttcacccacatgcctaatcaaccgggtacaacgcttccgcggggcagaacaacaaatcaaattcgtctgccagcgcgtcgacatggacataaccgtgtattgtaacggcgtaaagaaagtcatcctcaccaaaaccctcgtcatcggacagtgcatatacacgttcacatcgatattcagccttataccaggcatagcccactccctcgcagtagaactctgcgtcccaggcctccacggctgggccaccgtactcctactgctaaccttctgcttcggctgggtgctaatcccaacaataaccatgatactcctcaaaatacttatcgccttcgcctatctgtgctccaaatataatacagactccaaattcaaaatcctcgtagaaaaagtgaagaaagagtaccagaaaacaatgggatcgatggtctgcgaggtctgccaatatgaatgcgaaactgcaaaagaactcgaatcgcaccgcaaatcttgctcgatcggctcatgcccatattgcctcaacccaagcgaggccacaccatccgcattacaagcccacttcaaggtctgcaagctcacctcacgcttccaagaaaacctcaagaaaagcctaacaatgtacgaaccgatgcaaggctgctaccgcaccctctcgctgttccgttaccgctcacgcttcttcgtcggtctagtatggtgcatgcttcttgtgctggaactcatcgtatgggccgcttcggccgaaacacaaaacctgaacgcaggatggaccgacaccgcacacggttccggtataataccgatgaaagccgacttagaacttgacttttcccttccatcctctgcgtcctacacctaccgtcgccagctccaaaaccccgccaacgagcaagagaaaatcccattccacctacaaatctctaaacaagtcatccatgcagaaatacaacacttaggacattggatggacgcaaccttcaacttaaaaacagcattccactgctacgggtcctgtgaaaaatatgcatacccctggcaaacagcaggctgcttcgttgaaaaagactacgaatacgaaacaggatggggctgcaatcccccagactgtcccggagtaggcacaggatgcacggcctgtggggtgtaccttgacaaactcaagagcgtcggaaaagtattcaaaatagttagcctccgctacacccggaaagtctgcatccaactaggaactgaacagacctgcaaaaccgtagactcgaacgactgcctcattaccacctctgtcaaagtatgcctaatcgggaccatctcaaaattccaaccctcagacaccctattattcctcggccccctacagcaaggaggcctgatcttcaaacaatggtgcactaccacatgtcaattcggagaccccggggacataatgtccaccccaaccggcatgaagtgtcccgaattaaacggcagcttccgaaagaaatgcgccttcgccaccacccctgtatgtcaattcgacggaaacaccatctctggttacaaaagaatggtagccactaaagattcttttcaatccttcaacgtaaccgaacctcacatatctacctcagcactcgaatggatagacccagattcctccctccgcgaccatataaacgtgatagtttcgagagacctcagttttcaagacctatccgagacaccctgccaagttgacctaacaacctccgcgatagatggcgcatgggggtccggtgtaggcttcaacctcgtctgtactgtatctcttaccgaatgctccgcatttttaacgtccatcaaggcatgcgacgccgcgatgtgttatggctcaaccaccacaaacctagtacgcggacaaaacacaatccacgtcgtaggaaagggcggccactccggctcaaagttcatgtgctgccacgacaccaaatgctcctcaacgggcctcgtagcagcagcgccacacctcgatcgtgtaactggcttcaaccaggccgactccgacaaaattttcgacgatggcgccccagaatgcggaatgagctgctggttcaaaaagctcggcgaatgggtactcggggtactcaacggcaactggatggtcgtagccgtcttaatcgccctcttaatactgagcattttcctcttcgccctctgttgcccccgcagaccctcctataagaaagaacacaaaccttag

SEQ ID NO: 15098 - RNA, 3447 nt, synthetic construct
  misc_feature 1..3447: note = derived and/or modified CDS sequence (opt11) from PUUV(Umea/hu)__AY526218.1__GP
  source 1..3447: mol_type = other RNA
atgggcaagctgagccccgtgtgcctctacctgttcctgcagtgcctcctgctgtggtcccgcgggagcgctcggaacctaaacgagctgaagatggagtgcccgcacaccattggcctggggcagggcctcgtcatcgggtccgtggagttgccgccggtgcccgtccagcaggtcgagagcctgaaactcgaatccagctgcaatttcgacctgcacaccagcacggccacccagcagagcttcaccaagtggacgtgggagatgaaggacgatctagcagagaacacgcaggcctccagcacctccttccagaccaagagctccgaagtgaacctccgcggcctgtgcctgatcccgcccctcgtggtggagaccgcctcgcggacacgcaagaccatcgcctgcttcgacatctcctgtaaccagaccgtgtgccagcccaccgtctacctggttggccccatccagacgtgcatcaccacaaagagctgcctgctcgggctgggcgaccagcggatccaggtgaactacgagaagacctactgcgtctccgggcagctggtggagggcgtgtgcttcaacccggtccacacgatggtgctcagtcagccctcccacacctacgacatcgtgaccatgatggtccgctgcttcctggtggtgaagaaggtcaccagcggggacagcatgaagatcgagaagaacctggagaccctagtgcagaagaccgactgcaacgccaacggcttccaaggctactacatctgcctggttgggtccagctccgagcccctgtacgtccccaccctcgacgactaccggtccgcggaggtgctgtcccgcatggccttcgccccacacggcgaggaccacgacatcgagcgtaacgccgtaagcgcgctgcgcatcgtggggaaggtgaccggcaaagcaccctccacggaggccagcgacaccatccagggcatcgccttctccgggagccccctctacacctccaccggcgtcctgacggcgaaggacaaccccgtgtacgtgtggagcccgggcatcatcatggagggcaaccactccgtctgcgagaagaagaccctgccattgacttggaccgggttcatccccctgcccggcgagattggcaagacgagccagtgcaccgtgttctgcaccctggccgggccaggtgccgactgcgaggcatactccgagaccgggatcttcaacatcagctcccccacatgcctcattaaccgggcccagcgcttccgaggcgccgagcagcagatcaagttcgtgtgtcagcgcgtcgacatggacatcaccgtgtactgcaacgggatgaagaaggtgatccttaccaaaaccctggtcatcggccagtgcatctacaccttcacgtctatcttctccctcatccccggcatcgcgcacagcttggccgtggagctgtgcgtgcccgggctccacggctgggccaccgtcctgctgttactgaccttctgcttcgggtggatcctgatcccatttatcgccatgatcagcctgaagatcctcatcgccttcgcgtacctgtgctccaagtacaacaccgacagcaagttcaagatcctgatcgagaaggttaaaaaggagtaccaaaagacaatgggctccatggtttgtgaggtctgccagtacgagtgcgagaccgccaaggaactcgagagccacaggaagtcctgccctatcggcagctgcccatattgcctgaatccctccgaagccaccaccagtgcactgcaggcccactttaaggtgtgcaagctcacgtcccgcgtgcaggacaacctgcgcaagagcctggcggcctacgagcctaagcagggctgctacagaaccctctccctgttccggtaccgcagccggttcttcgtcggcttcatctggtgcatcctgcttgtgctggagctgatcatatgggccgcgtccgcggagacccaaaacttgaacagcgggtggaccgacacggcccacggctccgggatcatccctatgcgcaccgacctggagctggacttcagcctcccctccagcgcctcgtacacctaccgccggcagctgcagaacccggccaacgagcacgagaagatacccttccacctccagatctccaagcaggtcatccacgccgagattcagcacctgggccactggatggatgcgaccttcaacctgaagacggccttccactgctatggctcgtgcgagaagtacgcctacccgtggcaaaccgccgggtgcttcttcgaaaaggactacgagttcgaatccagctggggctgcaacccgcccgactgccccggggtgggcaccgggtgcaccgcctgcggtgtgtacctggacaagctcaaatccgtgggcaaggtcttcaagattatcagcctccgctacacgaggaaggcgtgcatccagctagggaccgagcagacctgcaagtccgtggacagcaacgactgcctggtgaccacgtcagtcaaggtgtgcctgatcggcaccgtgagcaagttccagccttccgacaccctcctgttcctggggcccctggagcaaggcgggctcatattcaagcagtggtgcaccacgacctgtcagttcggggaccctggcgacatcatgagcacccccaccgggatgaagtgtcccgagctgaacggctccttccgcaaaaagtgcgcctttgccacgacgcccgtctgccagttcgacgggaacaccatcagcggctacaagcggatgatagccaccaaggactccttccagagtttcaacgttacggacccgcacatctccaccagcgccctcgagtggatcgaccccgactccagcctccgcgaccacatcaacgtggtcgtgagccgggacctctccttccaggacctgagcgagaccccctgccaggtggacctcaccacctccagcatcgacggggcgtggggctccggcgtcgggttcaacctggtgtgcacggtgagcctgacagagtgctccaccttcttgaccagcatcaaggcctgcgactccgccatgtgctacggcagcaccaccatcaacttaatgcgcggtcagaacaccgtccacatcgtcggcaagggcgggcattccggcagcaagttcatgtgctgccacgacaccaagtgctccagcactggtcttgtggccgccgcgccccacttggaccgggtcaccggcttcaaccaggccgactccgacaagatcttcgatgacggggccccggagtgcggcatgagctgctggttcaagaaatccggcgagtggatcctgggggtgctgaacggcaactggctcgtggtcgccgtgctggtggccctgttcatcctcagcatcttcttattcaccctgtgctgcccacgccggccgatctacgcgaaggagcacaagccatga

SEQ ID NO: 15099 - RNA, 3447 nt, synthetic construct
  misc_feature 1..3447: note = derived and/or modified CDS sequence (opt11) from PUUV(P360)__L08755.1__GP
  source 1..3447: mol_type = other RNA
atgggagagctctcacccgtgtgcctctgccttcttctccaaggcctcctactttgcaacacgggcgcagcaagaaacctaaacgagctcaaaatggagtgcccccacaccatccgcctcggtcaaggacttgtcgtcggctcggtagaactcccctcgctaccaatccagcaagtagaaacactcaaacttgaatcctcctgcaacttcgacctacacacgtcaaccgcaggccagcaatcgtttacaaagtggacatgggagatcaaaggcgacttggccgagaacacgcaagcctcctcaaccagcttccaaaccaaatcctcagaagtaaacctccgcggactctgcttaatacccactctcgtcgtggaaaccgcggccagaatgagaaaaacaatcgcctgctacgatctgagctgtaaccaaaccgtatgccagcccacggtataccttatgggtccaatccaaacctgcatcacaaccaaatcctgtctgctatccctaggcgaccaacggatccaggtcaactacgaaaagacctactgcgtctccggccaactcgttgagggaatttgcttcaaccctatccacacgatggcgctgtcccagccttcccacacctacgacatcatgactatgatggtacggtgcttccttgtcattaagaaagtgacttcaggggatagcatgaaaatagaaaagaacttcgagacacttgtacagaaaaacggatgcacagcaaataacttccaagggtactacatctgcctaatcggatcctcctcggagccactgtacgtccccgctctagacgactatagaagcgccgaagtcctctcgagaatggcattcgcgccccacggcgaagatcacgacatcgagaaaaatgccgtctcagccatgagaatcgccggaaaagtcacgggcaaagccccgtctacagaatcaagcgacaccgtccaaggtatcgcgttctcaggatcacctctctacacctccaccggagtgcttacgagtaaagacgatcccgtctacatatgggcaccaggcatcataatggaagggaaccattcaatttgcgagaaaaagaccctccccctaacatggaccggctttatctccctccccggcgaaatcgaaaagacgactcaatgcaccgtcttctgtactctcgcgggcccaggagccgactgcgaagcgtattcagaaaccgggatcttcaacatctcgagtccaacatgtctaatcaaccgggtccaaagattcagagggtccgaacaacaaatcaaattcgtctgccagcgagtggacatggacatcacagtatactgcaacggaatgaaaaaggtgatcctaacaaaaaccctggtcataggccaatgcatatacaccttcacatcaatattctcactaatccccggagtagcccactcactagcagtcgaactatgcgtccccggactacacggatgggccacaatgctgctattattgaccttctgcttcggctgggtccttatcccaaccataaccatgatcctcctaaagatcctcatagccttcgcttacctctgctctaaatacaacaccgactccaaattcagaatactcatcgaaaaggtcaaacgcgaataccagaaaaccatgggaagtatggtctgtgaagtatgccaatacgagtgcgaaaccgcgaaagagctagagtcccaccgcaaaagctgctccataggcagctgcccatactgcctcaacccatcagaagccactacaagcgcgctccaagcacacttcaaagtctgtaaattaacctcccgattccaggaaaacctacgcaagtccctgaccgtttacgaacccatgcagggctgctacagaaccctatctctatttcgataccgctcccgattctttgttggtctagtatggtgcgtcctcctagtcctagaactaatagtctgggcggcaagtgccgaaacacaaaatctaaatgcaggctggaccgataccgcgcacggatccggcattatacccatgaaaacagacctggaacttgacttctcgctacccagctcagcgagctacacctaccgtcgacaactgcaaaatccagcgaatgagcaagagaaaatccccttccatctgcagctctcaaaacaggtaatccacgccgaaatccagcacctcggtcattggatggatgccacctttaaccttaaaacggccttccactgctacggaagttgtgaaaagtacgcctatccgtggcaaaccgcaggctgcttcatcgaaaaggattacgaatacgaaacaggatggggttgcaacccgcccgactgccccggcgtgggcaccggatgcactgcatgcggcgtctatctcgacaaacttaaatccgtcggaaaagtcttcaaaatagtaagcctgcgctacacacgcaaagtctgtatccagctcggaaccgagcagacctgcaaaaccgtcgattcaaatgactgtctaattacaactagcgtgaaagtctgcctgatcggtaccataagcaaattccaaccttccgacaccctactttttctaggcccactccaacaagggggcctcatcttcaaacagtggtgcacaaccacctgtcaattcggcgaccctggagacataatgtccacccccaccggcatgaaatgccccgaactaaacggctccttccgcaagaaatgcgccttcgcaacaacgcccgtatgccaatttgacggcaacacaatatctggatacaaacgaatgatcgctacgaaagactccttccaatcgttcaacgtcacagagccccacatctccacgagcgcgctcgaatggatagacccagactcaagcctacgcgatcacatcaacgtcattgtcagccgggacctaagttttcaagacctatcggaaaccccatgccaaatagacctcgcgaccgcctccatagacggcgcgtggggatccggtgtaggatttaacctcgtatgtaccgtatcgctgacagaatgcagtgcctttcttacatcaatcaaggcatgtgacgccgccatgtgctacggatccaccactgcaaatctcgtccgaggacaaaatactatacacatagtaggtaaaggcggccactcaggctccaaattcatgtgctgccacgataccaaatgttcttcaacaggactggtagcagccgcgccacaccttgaccgcgtaacaggatataaccaagccgactccgacaagatattcgacgacggcgcccccgaatgcggcatgagctgctggttcaaaaagtctggtgaatggatattaggggtcctcaacggcaactggatggtagtcgcagtactcgtagtcctcctcatcttatcaatcctcctgttcaccctatgctgcccgagaagaccttcctaccgaaaagaacataaaccctaa

SEQ ID NO: 15100 - RNA, 3447 nt, synthetic construct
  misc_feature 1..3447: note = derived and/or modified CDS sequence (opt11) from MUV(11-1)__JX028272.1__GP
  source 1..3447: mol_type = other RNA
atgggcaagatcagccccgtgtacctgtacctgctgttccagggcctgctcctgtggcgcgacggcctggcccggaatctcaacgagctgaagatggagtgtccgcatacaatcgggctgggccaagggctcgtaatcggctccgttgagctgccgcccgtccccctgcgccaggtagagagcctaaaactggagtccagctgcaacttcgacctgcacacctctacggccacccaacagagcttcaccaagtggatctgggagtccaagaacgacctcactgacagcacgcaggcgtccagcaccagttaccagaccaagagcaccgaggtgaacctcaagggcctgtgcctcgtgccaactctggtcatcgaaaccgccgcacggacccgaaagaccattgcctgcttcgatctgtcctgtaaccagacggtgtgccagcccaccgtgtatctcatcggccccatacagacctgcataaccaccaagagctgcctaatcggcctgggggatcaacggatacaggtcaactacgagaagacctactgcgtatccggccagcttgtggagggggtctgcttcaaccccatccacaccatggccctgtcccagccatcccacacctacgacgtggtgacgatgatggtccgctgcttcctggtggttaagaaggtcaccagcggcgattccatgaagatcgagaagaacttcgagaccctcgtgcaaaagaccgggtgcagcaacaataacttccaggggtactacgtatgcctgatcggcagctccagcgaacctctgtacgtcccaacgctcgatgactaccgatccgccgagattctgtctcgcatggccttcgcgccccacggtgaggaccatgacatagagcggaatgccatctccgccatgcgcatcgtaggcaaggtgacgggcaaggcgccgtcatccgagtcatccgacaccgtccaaggggtggcattcagcggcaacccactgtacacctccacgggggtcctgacctcaaaggacgacccggtgtacgtatgggcccccggtatcatcatggaggggaaccactccgtctgcgacaagaaaactttaccgctgacatggacgggctacatccccctcccaggcgagatcgagaagaccacccagtgcaccgtgttctgtacgctggctggtcccggcgcggactgcgaggcctacagcgagaccgggatcttcaacatctccagcccaacctgtctgatcaaccgcgtgcagcgcttccgaggagccgaacagcagataaagttcgtctgccagcgcgtggacatggacatcaccgtatactgcaacgggatcaagaaagtcattctcaccaagacgctggtaatcggacaatgtatctacacattcaccagtatcttcagcctcatgcccggcgtagcccactccctcgccgtcgagctgtgcgtgcccgggctgcacggctgggcaaccatgcttctgctgctcacattctgcttcggatggatcctgatcccaaccataaccctgattctgctgaagatcctgctggctttcgcgtatgtgtgcagtaagtacaacacagacagcaagttcaaaatcctaatagagaaggtgaagcaggagtaccagaagacgatgggctccatggtgtgcgaggtgtgccaacacgaatgcgagaccgcgaaggagctggagagccataagaagtcctgcccgatagggagctgcccctattgtcttaaccccgcggaggcgaccacctcagccctccaggcacatttcaaggtatgcaagctgacaagcagattccaagagaacttgcgcaaaagcctcacggtgtacgaacccaagcaggggtgctaccggaccctgagcctgttccgctaccggtcccgctgcttcgtgggtctcatctggtgcatcctcctgacattggagctgatcgtatgggccgccagcgcggaaactctaaacttaaacccggggtggaccgataccgctcacggatccgggatcgtgcccatgaaaaccgacctggagttagacttcagcctaccctccagcgcctcatatacgtaccggaggagccttcagaacccggccaatgagcaggagcaggtcccgttccatcttcagatcgagaaacaggtgatccatgccgagattcagcacctgggccactggatggacgccaccttcaacctcaagactgcattccattgctacggcgcctgcgagaagtacgcgtacccttggcagaccgcggggtgcttcgtggagaaggacttcgagttcgaaaacggatgggggtgcaacccgcccgactgccccggcgtggggactggttgcaccgcatgcggcgcctacctggacaagctcaagagcgtcggtaaggtgttcaagatcgtgagcctgcgctatacccggaaagcctgcatccagctggggaccgagcagacgtgcaagaacgtggactcaaacgactgcctcgtgacaacttccgttaaggtctgtctgatagggaccatcagcaagttccagcccagtgacacgctcctgttcctcggcccccttgagcagggcggaatcatcttcaagcagtggtgcaccactacctgccagttcggtgatcctggggacatcatgagtactcccattgggatgaagtgtcccgaactcaatgggtccttcaggaagaagtgcagcttcgcaaccacccccgtgtgccagttcgacggaaacaccatatccgggtataagcggatgatcgccaccaaggactccttccagtccttcaacgtgacggagccgcacatttctgccagcgccctggagtggatcgaccccgacagctcactgcgggaccacattaacgtggtcgtgggacgggacctccccttccaggatctgagcgagaccccctgccagatcgacctgtccaccagctccatcgacggcgcctgggggagcggggtcggcttcaacctcgtgtgctccgttagcctgacagaatgcttcacgtttctgaacagcatcaaggcctgtgacaccgcgatgtgctacggctccaccaccgccaatctagtccgcggtcagaacacggtgcacgtggtcggtaagggagggcattctggctccaagttcatgtgctgccacgacaccaagtgttctaacaccgggctgctggccgccgcgccgcacctcgaccgtgtcacgggctacaaccaggccgactccgacaaagtgttcgacgacggcgcccccgagtgcgggatgacgtgttggttcaagaagtccggtgagtggatcatgggggtcctgtccggtaattggatggtggtggccgtcctgatcaccctcctcgtgttatcgatattcctcttcgcgctgtgctgtccccgccgggcggcctacaagaaggagcataaaccttga

SEQ ID NO: 15101 - RNA, 3447 nt, synthetic construct
  misc_feature 1..3447: note = derived and/or modified CDS sequence (opt11) from MUV(11-4)__JX046483.1__GP
  source 1..3447: mol_type = other RNA
atggggaaaatttcgcccgtctatctctgcctcctcctgcagggcctcctgctatggcgcgacggcctagcccgtaacctcaacgagctcaagatggaatgtccccatacgatcggccttgggcaaggactcgtcataggctccgtagaactcccacctgtaccattgcggcaagtagaatcgctcaagctcgaatcttcatgcaatttcgacctacacacctccaccgcaactcaacagtccttcaccaaatggatctgggaatccaaaaacgacctaactgactcaacccaagcctcatcaacatcataccaaacaaaatccaccgaagtaaacctcaaaggcctctgcctagttcccacacttgtaattgaaacagccgcgcgaacccgtaaaaccatcgcctgctttgacctctcgtgcaaccagaccgtctgtcaacctaccgtctacctgataggcccaatccaaacatgcatcacaacaaaatcatgtcttatcggtctgggggatcaacgtatacaagtcaactacgagaaaacatactgcgtaagcggccagcttgtagaaggcgtgtgcttcaaccccatccacacgatggcgctctcccaaccctcccacacctacgacgtggtcaccatgatggtacgatgtttcctcgtagtaaagaaggttacctccggagactcaatgaagatcgagaaaaatttcgaaaccctcgtccagaaaactggatgctcaaacaataacttccaaggatactacgtatgcctcatcgggtcctcctcagaacccctttacgtaccaacactcgacgattaccgcagtgctgaaatactgtcccgcatggccttcgcgccccatggagaagaccacgacatcgaacgaaatgccatatccgccatgcgaatagtaggcaaagtcacgggaaaagccccatcttcggaatcgagcgacacagtacagggaatagcattctcgggaaacccactctatacgtccaccggagtgctcacgagcaaagacgacccagtgtacgtgtgggcccctggtatcatcatggaaggcaaccactcggtctgcgacaagaaaactctccccttgacatggacaggctacatcccattaccgggcgaaatcgagaaaacgacccaatgcacagtattctgcacccttgccggacctggagcagactgtgaagcgtactcggaaaccggcatcttcaatatatcttccccgacctgccttatcaaccgggtccaacggttccgcggtgctgaacaacaaatcaaattcgtatgccaaagagtcgacatggacataacggtctactgcaacggcattaagaaagtcatccttaccaaaaccttagttataggccagtgcatatacactttcacaagcatattcagcctcatgcctggagtagcccactcactcgcagtcgaactctgcgtacccggactacacggttgggcaacaatgcttctcctgctcaccttctgcttcggctggatcttaatacccaccataaccctaatcctgctgaaaatcctacttgcattcgcctatgtgtgctcgaaatacaacaccgacagcaaattcaaaatcctaatcgaaaaagtcaagcaagaataccagaaaaccatgggttcaatggtctgcgaagtatgccagcacgaatgcgagacggccaaggaactggagtcccacaagaaatcatgccctatcggttcttgcccatactgcctgaaccccgcagaggcaaccacctcagcgctacaggcccacttcaaagtgtgcaagctcacctcacgcttccaagaaaacctacgtaagagcctaacggtctacgaacccaaacaaggctgttaccggacacttagccttttccgttacagatcaagatgcttcgtcgggctcatctggtgcatactcctcaccttggaacttatcgtatgggccgcctccgccgaaaccctaaacctaaacccgggctggaccgacacagcacacggctccggaatagtccccatgcgaactgacctcgagctggacttctctctacccagcagcgcctcctacacctatcgccgttcgctccagaacccagcgaatgaacaagagcaaatccccttccacctccagattgaaaaacaagtaatacacgccgaaatccaacacctaggacactggatggacgcaaccttcaacttgaaaaccgccttccactgctacggagcatgcgaaaaatacgcctacccctggcaaaccgcaggctgcttcgtagaaaaggacttcgagttcgaaaacggctggggatgcaacccacccgactgccccggcgtcggcacgggttgcactgcctgcggagcatacctggacaaactaaaatcagtcgggaaagtcttcaaaatcgtctccctacgatacacaagaaaagcatgcatacaactcggaacagaacaaacttgcaaaaacgtagattccaatgactgcctagtaaccacttccgtaaaggtctgcctcataggaactatctccaaatttcaaccctccgatacccttctgttcctcggaccgctagaacaaggcggcatcatctttaaacaatggtgcaccacaacatgtcaattcggcgacccaggcgacatcatgtcgacacccatcggcatgaaatgcccagaactgaacggttcattccgcaagaaatgctcattcgctaccacacccgtctgccaattcgacggaaacacgatctcgggatacaagcgcatgattgctacaaaagacagcttccaatccttcaacgtcacagaaccgcacatcagcgccagcgccctagaatggatcgatcctgactccagcctaagagaccacataaacgtcgtggtagggcgcgacctacctttccaagacctatccgaaacaccctgccagatcgatttatccaccagctccatcgacggcgcatggggcagcggcgtcggcttcaacctcgtatgtagcgtttcactaaccgaatgctcaacattcctcacctccataaaagcatgcgacaccgcaatgtgttacggcagcaccacggccaacctcgttaggggtcaaaacactgtccacgtagtaggtaaaggagggcactccggttccaaattcgtctgctgccacgacacgaaatgttccaacactgggctactcgccgctgccccgcatctagaccgcgtaaccgggtacaaccaagccgactctgacaaagtattcgacgatggcgcacccgaatgcggcatgacgtgctggttcaaaaagtccggcgaatggataatgggcgtgctctccggcaactggatggtagtcgcggtccttatcaccctcctagtcctatccatattccttttcgccctatgctgcccacgacgcgctgcatacaagaaagaacacaagccgtaa

SEQ ID NO: 15102 - RNA, 3447 nt, synthetic construct
  misc_feature 1..3447: note = derived and/or modified CDS sequence (opt11) from MUV(11-5)__JX046486.1__GP
  source 1..3447: mol_type = other RNA
atgggaaaaatatcaccagtctacctttgcttacttctgcaaggcctcctcctgtggcgcgatggactcgcccggaatctaaacgagctcaagatggaatgcccacacaccataggcctcggtcagggccttgtaatcggctcagttgaactgccacctgtccctctccgacaagtcgagtccctaaaacttgagtcctcatgcaacttcgacctccacacgtccacagcaacacaacaatccttcaccaaatggatttgggaaagcaaaaacgacctcaccgactctacccaggctagctcgacctcctaccaaaccaagtccaccgaagtaaacttaaaagggctatgtctcgttcccaccctagtcatagaaaccgccgcccgcactcgcaaaacgatcgcctgcttcgacctcagctgtaaccagaccgtctgccaacctaccgtatatctcataggcccgatccagacatgcatcaccactaaaagctgcctgataggcctaggtgaccaacggatccaggtcaactacgagaaaacatactgcgtctccggtcaactcgtggaaggggtctgtttcaaccccattcacaccatggccctgagccagccctcccacacctacgacgtcgtaaccatgatggtcagatgcttcctcgtcgtaaagaaagtgacgagtggcgattccatgaaaatcgagaaaaacttcgaaaccctcgtccagaaaactggttgcagcaacaacaacttccagggctattacgtatgcctcataggtagctcatctgaaccactgtacgttcccacactagacgactaccgctccgccgaaatcctctcccgcatggccttcgcaccccacggcgaagaccacgacatcgaacgaaacgccataagcgccatgagaatcgtagggaaagtcaccggaaaggccccgtcctcagaaagttccgacacagtgcaagggatcgccttctctgggaacccactatacacaagcaccggcgtcctcacttccaaagacgaccccgtgtacgtttgggctcccggaatcataatggaaggcaaccactctgtatgcgacaagaaaacgctccccctcacatggacaggctatatcccgttaccaggcgaaattgagaaaacaacccaatgcaccgtcttctgcacacttgccggcccaggggctgactgtgaagcgtacagcgaaaccgggatcttcaatatctcctccccaacctgcctcatcaacagagttcaacgcttccgcggggccgagcagcagataaaattcgtgtgccagcgcgtcgacatggacatcacagtatattgcaacggtatcaagaaagtcatcctaactaaaaccctcgtcataggccaatgcatatacactttcacctctatcttcagtctcatgcccggggttgctcactctctagccgtcgaactatgcgtccccggcctccacggatgggcaaccatgcttctcctcctcaccttctgcttcggctggatcctcatccccacaatcacccttatcctcctcaaaatcctactagcattcgcttacgtctgctccaagtacaacaccgacagcaagttcaaaattcttatcgaaaaagtaaagcaagagtaccagaaaacaatgggaagcatggtatgtgaagtgtgccaacacgagtgtgaaacagcaaaggaactcgaatcccacaaaaagtcctgcccaatcggatcctgcccttactgcctcaaccccgccgaagcgacaacctccgcgctccaggcccactttaaagtctgtaaactcacctcacgcttccaagaaaacctacgcaagagcctcactgtatatgaacccaagcagggatgctaccgaacattgtcactgttccgataccgctccaggtgcttcgtcggactcatatggtgcatcttactcacccttgaactcgtcgtctgggccgcttcagccgagacgctcaacctcaaccctggttggacagacaccgcacatggctcaggcatagtcccaatgcgcactgatctcgaactagatttctcccttccttcctcggcctcctacacctaccgccgctctctccaaaatccagcaaacgaacaagagcaaatcccttttcacctacaaatagagaaacaagttattcacgccgaaatccaacaccttggccactggatggacgccacctttaacctcaaaacagcgttccattgctacggggcctgtgagaaatacgcctacccatggcagaccgccggctgcttcgtcgaaaaagatttcgagttcgaaaacggctggggatgcaacccgcccgactgcccaggcgtgggcaccggctgcaccgcttgcggtgcctaccttgacaaacttaaaagcgtcggtaaagtcttcaaaatagtatccctacgatacacccgcaaggcatgcatccaactaggaaccgaacagacctgtaagaacgttgactccaacgactgtctcgtcacgacctccgttaaagtatgcttgatcgggacaatcagtaaattccaacccagcgacaccttactgttcctcggaccccttgaacaagggggtattatattcaaacaatggtgcaccacaacctgccaattcggggaccccggagacataatgagcacacccatcggcatgaaatgcccagaattaaatggcagcttccgcaaaaagtgcagtttcgccacaaccccggtctgtcaattcgacggaaacaccatctccggctacaaacggatgatcgcaaccaaagattcctttcaatccttcaacgtcaccgaaccccacatatccgccagcgccctcgagtggatcgaccccgactcatcactacgtgaccacattaacgtagtcgttggaagagacctacccttccaagacctatcagaaacaccctgccagatagacctgtccacctcctcgattgacggcgcttggggctcaggagtcggctttaacctggtatgctcagtttccttaacagaatgcagtaccttcctaacatcgatcaaagcctgtgacactgccatgtgctacggatcaaccacagccaacctcgtccgcggtcaaaacaccgtgcacgtcgtcggaaagggaggtcattcaggatctaaattcgtatgctgtcacgatacaaaatgcagcaacactggactattagccgctgcaccccatctcgaccgcgttacaggctacaaccaggccgactcagacaaagtcttcgacgacggcgcacccgagtgcggtatgacatgctggttcaagaaatcgggggaatggatcatgggagtacttagcggcaattggatggtcgtagcagtcctcatcactctcctggtcttgtccatattcctcttcgcgctctgctgcccacgacgggccgcatacaagaaagagcacaaaccataa

SEQ ID NO: 15103 - RNA, 3408 nt, synthetic construct
  misc_feature 1..3408: note = derived and/or modified CDS sequence (opt11) from SANGV(SA14)__NC_034516.1__GP
  source 1..3408: mol_type = other RNA
atgatcatgtggggcctgctcctgctggccgccatcacattcccgtgccagtcgctcaagaacgtgtacgatatgaagatcgagtgcccgcattccgtcaacttcggggagagctccgtgatgggcaaagtgcaactgcccagcctgtccatcaccgaggccgagcagctcgtccccgagagctcctgcaacatggacaaccaccagtccctgtccgtgctgcagaaggccacaaagaccacctggcgcaagaaggccgaccacagcaacgccgggaaggactcctacgagctcatcaccagcgaaatccagttcaagggcgtgtgctccctgacgcacaagatgatcgaggagagccaccggctgcgccggtccgtcatctgctacgacctcagctgcaacaccacccactgcaagcccaccctgtacatggtggtgccggtccactcctgcaacatgatgaagtcctgcctgatcgggctcggcccctaccgcatccaggtggtgtacgagagaacgtactgcaccgtcggcgtgctgaacgaggggaagtgcttcgtgcccgaccagtccgtcgccaacatcgttaagaacggcattttcgacatcgtgagcgtccagatcatctgcttcttcatccgcatcaaggggagcacctacaagatcctggagaccgtgaagacggccatgaacggcaagtgcaatgggaccgacgacaaggtgcagggttactatatctgcctcctgggcgggaactccggccccatctacgtcccgagcggtaccgacttccgggccatggaggccctggccaacatgctccgcgcgccccacggcgaggaccacgacctgcccggcgaggagctggcctcctacagcatcgccggcaccatcgagggcaagatcccacacacggcatccagccagaacctcgagttcacagcctactccgggatcccgagctactctagcttctcagtgcacaccctcacccaggacggccagctgagctactcccccggcctcttccccaacctgaaccaaagcgactgcaagaagaacgcgctacccctcatctgggaggggacgatcgaactgccgggctactacgaggccatccacccctgcaacgtgttctgcgtcttctccgggcccggcgccagctgcgaggccttctccgaaggcgggatcttcaacatcaccagcccgacctgcctggtgtccaagcagaaccggttccgcgccgcggagcagcagatcaccttcgtctgccagcgggtggacatggacatcatcatctactgcaacgggcagaggaaggtgatcctcacgaagacgctggtcatcggccagtgcatctacagcatcaccagcctgttctccctcctgcccagcgtagcccactccatcgccatcgagctgtgcgtgccaggcttccacgggtgggccaccgccgcgctcctgacgacgttctgcttcggctggctgctcatccccagcatcacctacatcgtcctgctgatcctcaagttcatcgccgccatcttccacaacaccacgcaggagaacaagttcaaggccatcctgcggaagatcaaggaggagttcgagaagaccaaggggtccatggtgtgcgacatctgcaagtacgagtgcgagaccggcaaggagctgaaggcccacaatctcagctgcaaccagtcccagtgcccctactgcttcacccactgcgagatgacggagagcgcgttccaggcccactacaaggtgtgccaggccacccaccgcttccgggaggaccttaagaagaccatcaccccgcagaccatctcccccgggtgctaccgcacgctgaacctgttccggtacaaaagccgctgctacatcctcaccgtctggctgtgcctgctcatcctggaatccatcgcgtgggcggccagcgcttccgaaaccagcctgaaccccctctggaccgacaacgcccacggcgtgggcagcgtgcccatgcacacggacctggagctggacttcagcctcccgtccagcagcaagtacacctacaagcggaagctgacctcccccaccaaccccgagcaggccgtcagcctgcacatcgagatcgagtcccaggggatcgcggccgacgtgcacagcctcggccactggtacgacgcccgcctgaacctgaagacgtccttccactgctacggggcctgcaccaagtaccagtacccgtggcacaccgccaagtgccacttcgagcacgactttcagtacgagaacagctggggctgcaacccgcccgactgccccggcgtggggaccggctgtacggcttgcgggctctatctggatcagctgaaacccgtcggctccgcctataagctcatcaccgtgcggtacagccgcaaggtgtgcgtccagttcggggaggagaacctttgcaagaccatcgacatgaacgactgcttcatgtcccgccacgtgaaggtgtgtatcatcggcaccgtctctaagttctcccagggcgacacgctggtgttcctcgggcccctggagggcgggggcctgatcttcaaagactggtgcaccagcacgtgccagtacggggaccccggcgacatcatgagcccccgtgaccgtggcttcagctgcccggagttccccgggtccttcaggaagaagtgcaatttcgccaccacccccgtctgtgagtacagcggtaacatggtctccgggtacaagaaggtgatggccaccatcgacagcttccagtccttcaacaccagcctcatccacttcaccgaggagcgcatcgagtggaaggacccggacggcatgctgcgggaccacctgaacatcctcgtgacgaaggacatcgacttcgagaacctgggggagaacccgtgcaaggtcggcctgcagaccagctccattgagggcgcctggggcagcggcgtcgggttcacccttgtgtgccaggtctccctgatcgactgcgcgcgcttcctgaccagcatcaaggcatgcgacatggccatctgctacggcgcccagtccgtgagcctcgtgcgggggcagaacacggtcaagatcactggcaagggcgggcactccggcagctccttcaagtgctgccacgaggtggactgcagctccaccgggctgcaggcgagcgcgccccacctggacaaggtgaacggcatcagtgagcaggagaacgataaggtctacgacgacggcgcgccccagtgcggggtgagctgctggttcgtgaagtccggcgagtggatcagcgggatcctccacggcaactgggtcgtggtggtcgtgctggtcatcctgctcctgttctccctgattcttctgagcatcctgtgcccagtccgcaagcacaagcggagttga

SEQ ID NO: 15104 - RNA, 3408 nt, synthetic construct
  misc_feature 1..3408: note = derived and/or modified CDS sequence (opt11) from SANGV(SA14)__NC_034516.1__GP
  source 1..3408: mol_type = other RNA
atgatcatgtggggtctgctcctgctggccgccatcaccttcccctgccagagcctcaagaacgtgtacgacatgaagatcgagtgcccgcactccgtcaacttcggggagagctccgtgatgggcaaggtgcagctgcccagcctgtccatcaccgaggccgagcagctcgtacccgagagctcgtgcaacatggataatcaccagagcctgtctgtgctgcagaaggctacgaagaccacctggaggaagaaagccgaccacagcaacgccgggaaggactcctacgagctcatcacctcagagatccagttcaagggagtgtgctccctgacgcacaagatgatcgaggagagccaccggctgcgccggtccgtcatctgctacgacctcagctgcaacaccacccactgcaagcccaccctgtacatggtagtgccggtccactcctgcaacatgatgaagtcctgcctgatcgggctcggcccctaccgcatccaggtggtgtacgagcggacgtactgcaccgtcggggtgctgaacgaggggaagtgcttcgtgcccgaccagtccgtcgcaaacatcgtgaagaacggcatcttcgacatcgtgtcggtccagatcatctgcttcttcatccgcatcaaggggagcacctacaagatcctggagaccgtgaagacggccatgaatggcaagtgcaacggcaccgacgacaaggtgcagggctactacatctgcctcctgggcgggaactccggccccatctacgtcccgagcgggaccgacttccgggccatggaggccctggccaacatgctccgggcgccccacggcgaggaccacgacctgcccggcgaggagctggcctcctacagcatcgccgggaccatcgagggcaagatcccccacacggcctcaagccagaacctcgagttcaccgcctactccgggataccgagctactccagcttctccgtgcacaccctgacccaggacggccagctgtcctactcccccggcctctttccaaacctgaaccagagcgactgcaagaagaacgcgctgcctctcatctgggaggggacgatcgagctgccgggctactacgaggccatccacccctgcaacgtgttctgcgtcttttccgggcccggcgcctcatgcgaggccttcagcgaaggcgggatcttcaacatcacaagtccgacctgcctggtgtccaagcagaaccgtttccgcgccgcggagcagcagatcaccttcgtctgccagcgggtggacatggacatcatcatctactgcaacgggcagcgcaaggtgatcctcacgaagaccctggtcatcggccagtgcatctacagcatcaccagcctgttctccctcctgcccagcgtggcccactccatcgccatagagctatgcgtgcccggcttccacgggtgggccaccgccgcgctcctaacgaccttctgcttcggctggctgctcatccccagcatcacctacatcgtcctgctgatcctcaagttcatcgccgccatcttccacaacaccacgcaggagaacaagttcaaggccatcctgcggaagatcaaggaggagtttgagaagaccaaggggtccatggtttgcgacatctgcaaatacgagtgcgagaccggcaaggagctgaaggcccacaacctgagctgcaaccagtcccagtgcccctactgcttcacccactgcgagatgacggagagcgcgttccaggcccactacaaggtgtgccaggccacccaccggttccgggaggacctgaagaagaccatcaccccgcagaccatctcccccgggtgctaccgcacgctgaacctgttccggtacaagagccgatgctacatcctcaccgtctggctgtgcttactcatcctggagtccatcgcctgggcggccagcgcctccgaaaccagcctgaaccccctctggaccgacaacgcccacggcgtgggctccgtgcccatgcacacggacctggagctggacttcagcctcccttccagcagcaagtacacctacaagcgtaagctgacctcccccaccaaccccgagcaggccgtcagcctacacatcgagatcgagtcccaggggatcgctgccgacgtgcacagcctcggccactggtacgacgcccgcctgaacctgaagacgtccttccattgctacggggcctgcaccaagtaccagtacccgtggcacaccgcgaagtgccacttcgaacacgacttccagtacgagaacagctggggctgcaacccgcccgactgccccggcgtggggaccggctgcacggcgtgcgggctctacctggaccagctgaagcccgtcggctctgcctacaagctcatcaccgtgcggtacagccgcaaggtgtgcgtccagttcggggaggagaacctgtgcaagaccatcgacatgaatgactgcttcatgtcccgccacgtgaaggtgtgcatcatcggcaccgtcagcaagttctcccagggcgacacactggtgtttctcgggcccctggagggcgggggcctgatcttcaaggactggtgcaccagcacgtgccagtacggggaccccggagacatcatgagcccccgggaccgcggcttcagctgcccggagttccccgggtcctttaggaagaagtgcaacttcgccaccacccccgtgtgcgagtacagcggcaacatggtctccgggtacaagaaagttatggccaccatcgacagcttccagtccttcaacactagcctcatccacttcaccgaggagcgcatcgagtggaaggaccccgacggcatgctgcgggaccacctgaacatcctcgtaacgaaggacatcgacttcgagaacctgggggagaacccgtgcaaggtcggcctgcagacaagctccatcgagggcgcctgggggagcggcgtggggtttaccctcgtgtgccaggtctccctgatcgactgcgcgcgcttcctgaccagcatcaaggcctgcgatatggccatctgctacggcgcccagtccgtgagcctcgtgcgggggcagaacacggtcaagatcaccggcaagggcggtcactccggcagctccttcaagtgctgccatgaggtggactgcagctccaccgggctgcaggcgagcgcgccccacctggacaaggtgaacggcatctccgagcaggagaacgacaaggtctacgatgacggcgcgccccaatgcggggtgagctgctggttcgtgaagtccggcgagtggatcagcgggatcctccacggcaactgggtcgtggtggtcgtgctggtgatcctgctcctgttctccctgatcctcctgagcatcctgtgccccgtccgcaagcacaagcggtcctga

SEQ ID NO: 15105 - RNA, 3402 nt, synthetic construct
  misc_feature 1..3402: note = derived and/or modified CDS sequence (opt11) from SEOV(L99)__AF288298.1__GP
  source 1..3402: mol_type = other RNA
atgtggagcctcctcctgctggccgccctcgtgggccaggggtttgccctgaagaacgtcttcgacatgcgcatccagtgcccccactccgtgaacttcggcgagaccagcgtgtccgggtacaccgagctgccgcccctgagcctgcaggaggccgagcagctggtccccgagtcctcctgcaacatggacaaccaccagtccctcagcacgatcaacaaactgaccaaggtggtgtggcggaagaaggccaaccaggagctggccaaccagaactccttcgaggtcgtggagagcgaggtgtccttcaagggcctctgcatgctgaagcacaggatggtcgaggagtcataccggaaccgccggagcgtgatctgctacgacctggcctgcaacagcaccttctgcaagcccaccgtgtacatgatcgtcccgatccacgcctgcaacatgatgaagagttgcctcatcgggctgggcccctaccgaatccaggtggtgtatgagcggacgtactgcaccaccggcatcctgaccgaggggaagtgcttcgtccccgacaaagcagtggtgagcgccctcaagcgcggcatgtacgccattgcgtccatcgagacgatctgcttcttcatccataagaaggggaacacctacaagatagtcaccgccataaccagcgccatgggctccaagtgcaacaacacggacaccaaggtgcaggggtactacatatgcatcatcggcggcaacagcgcacccgtgtacgccccggcgggggaggacttccgggccatggaggtcttcagcggcataatcaccagcccccacggggaggaccacgacctgcccggggaggagatcgccacctaccagatctctggccagatcgaggccaagatcccccacacggtgtccagcaagtccctgaagctcatcgccttcgcggggatcccgagctactccagcacctccatcctggccgccagcgaggacggccgcttcattttctcccccgggctgttccccaacctcaaccagagcgtgtgcgacaacaacgccctgcccctgatatggcggggcctaatcgacctgaccgggtactacgaggccgtccacccgtgcaacgtcttctgcgtcctgtccggccccggcgcgagctgcgaggccttctccgagggcgggatcttcaacatcaccagccccatgtgcctcgtgtccaagcagaaccgcttccgtgccgctgagcagcagatcagcttcatatgccagcgcgtggacatggacattatcgtctactgcaacgggcagaagaaaacgatactaaccaagaccctggtgatcggccagtgcatctacaccatcacgtccctcttcagcctgctgcccggggttgcccacagcatcgcgatcgagctctgcgtcccaggcttccacggctgggcaaccgccgccctgctgattaccttctgcttcggatgggtgctcatccccgcgtgcacgctggccatcctgctcgtgctgaagttcttcgccaacatcctgcacacgtccaaccaggagaaccggttcaaggccatcctccgcaaaatcaaggaggagttcgagaagaccaagggcagcatggtctgcgagatctgcaagtacgagtgcgagaccctgaaggagctgaaggcgcacaacctctcctgcgtgcagggggaatgcccctactgcttcacccactgcgagcccacggagaccgcgatccaggctcactacaaggtgtgccaggccacccaccggttccgcgaggacctgaagaagaccgtcacgccgaagaacatcggccccgggtgctaccggaccctgaacctgttccgctacaagagccggtgctatatcctcaccatgtggaccctgctgctcatcatcgagtccatcctgtgggccgccagcgcggccgagatccccctggtgcccctctggaccgacaacgcccacggcgtgggctccgtcccgatgcacacggacctggagctggacttcagcctcccctccagctccaagtacgcctacaagcgccatctgaccaaccccgtgaacgaccagcagagcgtgtccctgcacatcgagatcgagagccaggggatcggcgccgacgtccaccacctcgggcactggtacgacgcgcgcctgaacctgaagaccagtttccactgctacggcgcctgcaccaagtaccagtacccgtggcacacggccaagtgccacttcgagaaggactacgagtacgagaacagctgggcctgcaacccgcccgactgccccggcgtggggaccggctgcaccgcgtgcgggctctacctggaccagctgaagcccgtgggcaccgccttcaagatcatctccgtccgctatagccgcaaggtgtgcgtgcagttcggggaggagtacctctgcaagacgatcgacatgaatgactgcttcgtcacccggcacgccaagatctgcatcatcggcacggtgagcaagttctcccagggggacaccctgctgttcctcgggcccatggagggcgggggcatcatattcaagcactggtgcacgagcacgtgccacttcggggaccccggcgacgtgatgggccccaaggacaagccgttctcttgccccgagttccccgggcagttccgcaaaaagtgcaacttcgccaccacccccatctgcgagtacgacggcaacatcatctcagggtacaagaaggtcctggccaccatcgactccttccagagcttcaacacctccaacattcacttcaccgacgagcggatcgagtggcgcgacccggacggcatgctgcgggaccacatcaacatcgtgatcagcaaggacatcgacttcgagaacctcgcggagtccccttgcaaggtggggctgcaggccgccaacatcgagggcgcctggggcagcggggtcggcttcaccctgacgtgccaggtgtccctcaccgagtgccccaccttcctgacaagcatcaaggcctgcgacatggcgatctgctacggggccgagtccgtgacgctgagccgcggccagaacaccgtccggatcaccgggaagggcggccactccgggagctccttcaagtgctgccacggcaaggagtgcagctccaccgggctccaggctagcgcgccccacctggacaaggtgaacggcataagcgagctggagaacgagaaggtgtacgacgacggcgccccggagtgcggggtcacgtgctggtttaagaaatccggcgagtgggtgatggggatcatcaacggcaactgggtggtcctcatcgtgctgtgcgtgctgctcctgttcagcctcatcctcctgtccatcctgtgccccgtccgcaagcacaagaagtcctga

SEQ ID NO: 15106 - RNA, 3402 nt, synthetic construct
  misc_feature 1..3402: note = derived and/or modified CDS sequence (opt11) from SEOV(Rn10-134)__JF693883.2__GP
  source 1..3402: mol_type = other RNA
atgtggagcctgctccttctagccgccttagtgggccagggcttcgccctgaagaacgtcttcgacatgcgcatccagtgcccccactccgtgaacttcggtgagaccagcgtgtccggatacaccgagctgccgcccctcagcctgcaggaggccgagcagttggtccccgagtccagctgcaacatggacaaccaccagtccctcagcaccatcaacaagctgaccaaggttatctggcggaagaaggccaaccaggagtccgccaatcagaacagcttcgaggtggtcgagtccgaggtgagcttcaagggcctgtgcatgctcaagcaccgcatggtggaggagagctaccggaaccgccggagcgtcatctgctacgacctggcctgcaactccaccttctgcaagcccaccgtgtacatgatcgtgccgatccacgcgtgcaacatgatgaagtcctgcctgatcgggctcggcccctaccgcatccaggttgtgtacgagcggacgtactgcaccaccggcatcctgaccgaggggaagtgcttcgtgcccgacaaggccgtcgtaagcgccctgaagcgcggcatgtacgccatcgcgagcatcgagacgatctgcttcttcatccaccagaaggggaacacctacaagatcgtgaccgcgatcacctccgccatgggcagcaagtgcaacaacacggacacaaaggtccaggggtactacatctgcatcatcggcggcaacagcgcccccgtttacgccccggcgggggaagacttccgggccatggaggtgttctccggcatcatcacctcaccccacggggaggaccacgacctcccaggcgaggagatcgccacctaccagatctccggccagatcgaggccaagatcccccacacggtcagctccaagaacctgaagctgaccgccttcgcggggatcccgagctactccagcacctccatcctcgccgccagcgaggacggccgcttcatcttctcccccgggctgttccccaacctgaaccagagcgtgtgcgacaacaacgccctccccctgatttggcggggcctgatcgacctcaccgggtactacgaggccgtgcacccgtgtaacgtcttctgcgtgctgtccggccccggcgcgagctgcgaggccttctccgagggcgggatcttcaacatcacgagccccatgtgcctggtctccaagcagaaccgcttcagggccgccgagcagcagatcagcttcgtgtgccagcgcgtggacatggacatcatcgtctactgcaacgggcagaagaagaccatcctcaccaagaccctggtgatcggccagtgcatctacacgatcacctccctgttcagcctcttacccggggtagcccacagcatcgcgatcgagctgtgcgtcccgggcttccacggctgggccaccgccgccctcctgatcaccttctgcttcggatgggtgttgatccccgcttgcaccctcgccatcctgctggtgcttaagttcttcgccaacatcctgcacaccagcaaccaggagaaccggttcaaggccatcctgcgcaagatcaaggaggagttcgagaagaccaagggcagcatggtctgcgagatctgcaagtacgagtgcgagaccctgaaggagctgaaggcccacaacctgtcttgcgtacagggggagtgcccctactgcttcacgcactgcgagcccaccgagacggcgatccaggcccactacaaggtgtgtcaggccacccaccggttccgcgaagacctcaagaagacggtcaccccgcagaacatcggccccgggtgctaccggaccctgaacctgttcagatacaagagccggtgctacatcctgaccatgtggaccctcctgctgatcatcgaatccatcctctgggccgccagcgcggtggagatcccgctggtgcccctgtggacggacaacgcccacggcgtcggctccgtgccgatgcacaccgacctagagctggacttcagcctgccctccagctcccgctacacctacaagcgccacctcaccaaccccgtgaacgaccagcagagcgtctccctgcacatcgaaatcgagtcgcaggggataggcgccgacgtgcaccacctggggcactggtacgacgcccggctcaatttaaagacgtccttccactgctacggcgcctgtaccaagtaccagtacccgtggcacaccgctaagtgccacttcgagaaggactacgagtacgagaacagctgggcctgcaacccgcccgattgccccggcgtggggaccggctgcacggcctgcgggctatacctcgaccagctgaagcccgtcggcaccgccttcaagatcatctccgtgcgctacagccgaaaggtgtgcgtccagttcggggaggagtacctgtgcaagaccattgacatgaacgactgcttcgtgacccgccacgcgaagatctgcatcatcggcacggtgtcaaagttctcccagggcgacaccctcctgttcctggggcccatggagggcgggggcatcatcttcaagcactggtgcactagcacgtgccacttcggggaccccggagacgtcatgggccccaaagataagccgttcatctgccccgagttccccgggcagttccggaagaagtgcaacttcgccaccacccccgtgtgcgagtacgatggcaacatcatctccgggtacaaaaaggtgctcgccaccatcgacagcttccaatccttcaacaccagcaacatccacttcacggacgagcgcatcgagtggcgagacccggacggcatgctgcgcgaccacatcaacatcgtcatctccaaggacatcgatttcgagaacctggccgagaacccctgcaaggtggggctccaggccgcgaacatcgagggcgcctggggcagcggggtgggcttcaccctgacctgccaggtctccctgaccgagtgccccacgttcctcaccagcatcaaggcctgcgacatggccatctgctacggggccgagtccgtgacgctgtcgcggggccagaacaccgtgaagatcacggggaagggcggccactccgggagctccttcaagtgctgccacggcaaggagtgcagcctgaccgggctccaggcgtccgcgccccacctggacaaggtcaacggcatcagcgagctggagaacgagaaggtgtacgacgacggcgccccggagtgcgggatcacgtgctggttcaagaagtccggcgagtgggtgatggggatcatcaacggcaactgggtcgtcctcatcgtcctgtgcgtactgctcctgttcagcctgatcctcctgagcatcctgtgccccgtgcgcaagcacaagaagtcctga

SEQ ID NO: 15107 - RNA, 3402 nt, synthetic construct
  misc_feature 1..3402: note = derived and/or modified CDS sequence (opt11) from SEOV(Gou3-e5)__AF288650.1__GP
  source 1..3402: mol_type = other RNA
atgtgggggttgctcctgctggctgccctcgtgggccagggcctggcgctgaagaacgtcttcgacatgaagatccagtgcccccactccgtgaacttcggggagacaagcgtgagcggctacaccgagctgcccccgctcccgctgcaggaggccgagcagctcgtccccgagtcctcctgtaacatggacaaccaccagagtctgagcaccatcaacaagctgacgaaggtgatttggcgaaagaaggccaaccaggagtccgccagccagaatagcttcgaggtggtcgagaacgaggtatccttcaagggtctctgcatgctgaagcacagaatggtggaggagtcctaccgaaatcggcgcagcgtcatttgctacgacctggcctgcaacaccaccttctgcaagcccacggtgtacatgatcgtccccatccacgcgtgcaacatgatgaagtcctgcctcatcggccttggcccctatcggatccaggtcatctatgaacgcacctactgcaccaccggcattctgacggagggcaagtgcttcgtgcccgacaaggccgtcgtcagcgctctcaagcgggggatgtacgccattgcgtccatagaaaccatctgcttcttcgtgcaccagaaaggtaacacctataagatcgtgagcgccatcacttccgcaatgggatctaagtgcaataacacggactccaaggtacagggctactacatctgcatcatcggagggaacagcgccccggtgtacgcccccgcgggtgaggatttccgcgccatggaggtgttcagcgggataatcacctcaccgcacggcgaagaccacgacctgcccggcgaggaaatcgccacctaccagatcagcgggcagatcgaggccaagataccgcacaccgtgtcaagcaagaacttgaagctcacggccttcgcgggcatcccctcctacagcagtaccagcatcctagccgcctctgaggacgggagattcatcttctcacccggcctgtttcccaatctcaaccagtccgtgtgcgacaacaatgccctgccgctgatctggcgcggtctcatcgacctgactggctactacgaggccatccacccctgcaatgtgttctgcgtcctaagcggccccggggcgtcatgcgaggccttctctgagggcgggattttcaacatcaccagccccatgtgcctggtgagcaaacaaaaccggttcagggccgccgaacagcagatctccttcatatgccagagagttgacatggacatcgtggtgtactgcaatggccagaagaagactatcctgacaaagaccctggttatcgggcagtgtatctacaccatcacgtctttattctccctgttgccgggcgtggcgcatagcatagcgatcgaactctgcgtgcctggcttccacgggtgggccaccgcagccttactggtcaccttctgcttcgggtgggtgctgatccccgcgtgcaccctggcagtgctcctcttcctgaagttcttcgccaacatcttacacacgtcaaaccaggagaatcgcttcaaggccatcctccggaagatcaaagaggagttcgagaaaaccaaaggttctatggtctgcgaaatatgcaagtacgaatgcgagaccctgaaggagctgaaggcccacaacctcagctgcgtgcagggcgagtgcccttattgcttcacccactgcgagccaacggagaccgcgatccaggcccactacaaggtctgtcaggccacccaccgcttccgggaggacctgaagaagaccgtcacgccgcagaacatcgggcccggctgctaccgcaccctgaacctgttccggtacaagagtcgctgctacatcctcactatgtggatactgctgctcgtgatcgaaagcatcctgtgggccgcctccgcggccgagattcccctcgtgccgttatggaccgacaacgcccacggcgtcggaagcgtgcccatgcacaccgacttggagctggacttctccctgccaagctccagcaagtacacctacaagcgtcacctgaccaacccggtgaatgaccagcagtcagtctctctgcatatcgagatcgagtcccaaggcatcggggccgatgtccaccacctcggccactggtacgatgcccgcctgaacctgaagacgagcttccactgttacggcgcgtgcaccaagtaccagtacccctggcacacggccaagtgccacttcgaaaaggactacgagtatgagaactcttgggcctgtaacccgcccgactgtcccggggtgggcaccgggtgcaccggctgcggattatatctggaccagctgaagcccgtcggaaccgcgttcaagatcatcagcgtacgctattctaggaaggtgtgcgtccagttcggagaggaatacctctgcaagacgatcgacatgaacgactgcttcgttacccggcacgcgaagatatgcatcatcgggaccgtgagcaagttcagtcaaggagacaccctcctattcctcgggcccatggagggcgggggcatcatcttcaagcactggtgcacgtccacgtgccacttcggcgaccccggggacgtcatgggcccgaaagacaagccctttatttgccccgagttccccgggcagttccgcaagaagtgcaacttcgccaccaccccggtttgcgagtacgacggcaacgtgatcagcgggtaccgcaaagtgctggcaaccatcgactccttccagtcattcaacacctccaacgtgcatttcaccgacgagaggatcgagtggaaggatccagacggaatgttacgcgatcacatcaacatcgttatcagcaaggacatcgacttcgagaaccttgccgagaacccgtgcaaggtcggccttcaagccgcgaacatcgagggggcctggggctccggggttgggtttacgttgacgtgccaggtcagcctcaccgagtgcccgaccttcttaacctcaatcaaggcttgcgacatggccatctgctacggggctgagagcgttacgctgtcccggggccagaacacgatcaagatcaccggcagagggggccacagcggcagcagtttcaaatgctgccacggcaaggaatgctccgcaaacggcctccaggcgagcgccccgcacctggacaaggtgaacgggatctccgagctggagaacgagaaggtgtacgatgatggcgcccccgagtgcgggataacgtgctggttcaagaagtccggcgaatgggtcatggggatcataaacggcaactgggtggtgctcatagtcctgtgcgtgctgctcttattctccctgatcctcctgagcatcctgtgtcccgtgcggaagcataagaaatcctaa

SEQ ID NO: 15108 - RNA, 3402 nt, synthetic construct
  misc_feature 1..3402: note = derived and/or modified CDS sequence (opt11) from SEOV(China)__EU163437.1__GP
  source 1..3402: mol_type = other RNA
atgtggagcctgctcctgctggccgccctcgtgggccaggggtttgccctgaagaacgtcttcgacatgcggatccagtgcccccactccgtgaagttcggcgagaccagcgtgtccgggtacaccgagctgccgcctctcagcctgcaggaggccgagcagctggtccccgagtccagctgtaacatggacaaccaccagtccctcagcacgatcaacaagctgaccaaggtgatctggcggaagaaggccaaccaggagtccgccaaccagaacagcttcgagatcctggagtccgaggtgagcttcaagggcctctgcatgctgaagcaccgcatggtcgaggagtcctaccggaaccgccggagcgtgatctgctacgacctggcttgcaactccaccttctgcaagccaaccgtgtacatgatcgtcccgatccacgcgtgcaacatcatgaagtcctgcctcatcgggcttggcccctaccgcatccaggtggtgtacgagcggacgtactgcaccaccggcatcctgaccgaggggaagtgcttcgtccccgacaaggccgtcgtgagcgccctcaagcgcggcatgtacgccatcgcgagcatcgagacgatctgcttcttcatccaccagaagggtaacaagtacaagatcgtcaccgccatcacctccgcaatgggcagcaagtgcaacaacaccgacacgaaggtgcaggggtactacatctgcatcatcggcggcaacagcgcccccgtgtacgccccggcgggggaggacttccgggccatggaggtcttctccggcatcatcaccagcccccacggggaggaccacgacctgcccggcgaggagatcgccacctaccagatttccggccagatcgaggccaagatcccccacaccgtgagctcccagaacctgaagctcaccgccttcgcggggatcccgagctactccagcacctccatcctggccgccagcgaggacggccgcttcattttctcccccgggctgttccccaacctcaaccagagcgtgtgcgacaacaacgccctgccactgatctggcggggcctcatcgacctgaccggttactacgaggccgtccacccgtgcaacgtgttctgcgtgctgtccggccccggcgcgagctgcgaggccttctccgagggcgggatcttcaacatcaccagccccatgtgcctcgtctccaagcagaaccgcttccgggccgccgagcagcagatcagcttcatctgccagcgcgtggacatggacatcatcgtctactgcaacgggcagaagaagacgatcctgaccaaaacccttgtgatcggccagtgcatctacaccatcacgtccctcttcagcctgctgcccggggtggcccacagcatcgcgatcgagctctgcgtcccgggcttccacggctgggccaccgccgcgctgctgatcaccttctgcttcgggtgggtgctcatccccgcgtgcaccttggccatcttgttagtgctgaagttcttcgccaacatcctgcagacgtccaatcaggagaaccggttcaaggccatcctccgcaaaatcaaggaggagttcgaaaagaccaagggcagcatggtctgcgagatctgcaagtacgagtgcgagaccctaaaggagctgaaggcccacaacctctcctgcgtccagggggagtgcccctactgctttacccactgcgagcccacggagaccgcgatacaggcccactacaaggtgtgccaggccacccaccggttccgcgaggacctgaagaaaaccgtcacgccgcagaacatcggccccgggtgctaccggaccctgaacctgttccgctacaagagccggtgctacatactcaccatgtggaccctgctgctcatcatcgagtccatcctgtgggctgccagcgcggccgagatccccctggtgcccctctggaccgacaacgcccacggcgtgggctccgtcccgatgcacacggacctggagctggacttcagcctcccctcctcgtccaagtacacctacaagcgccacctgaccaaccccgtgaacgaccagcagagcgtgtccctgcacatcgagatcgaaagccaggggattggcgccgacgttcaccacctcgggcactgctatgacgcccgcctgaacttgaagacctccttccactgctacggcgcgtgcacgaagtaccagtacccgtggcacacagccaagtgccacttcgagaaagactacgagtacgagaacagctgggcctgcaatccgcccgactgccccggcgtggggaccggctgcaccgcctgcgggctctacttggaccagctgaagcccgtgggcacggcgttcaagatcatctccgtccggtacagccgcaaggtgtgtgtgcagttcggggaggagtacctctgcaagacgatcgatatgaacgactgcttcgtcacccggcacgccaagatctgcatcattggaaccgtgagcaagttcagccagggcgatacgctgctgttcctcgggcccatggaaggcgggggcatcatcttcaagcactggtgcaccagcacgtgccacttcggggaccccggcgacgtgatgggcccgaaggacaagcccttcatttgccccgagttccccgggcagttccgcaagaagtgcaacttcgccaccacccccgtctgcgagtacgacggcaacatcatctccgggtacaagaaagtgctggccaccatcgacagtttccagtccttcaaccggagctacatccacttcaccgacgagcgcatcgagtggcgggacccggacggcatgctgcgcgaccacatcaacatcgtgatctccaaggacatcgacttcgagaatctagccgagaacccctgcaaggtcgggctgcaggcggccaacatcgagggcgcctggggcctcggggtgggcttcaccctcacgtgccaggtgagcctgaccgaatgccccaccttcctgacctccatcaaggcctgcgacatggctatctgctacggggcggagagcgtcacgctctcccggggtcaaaacaccgtgaagatcaccgggaagggcggccacagcgggtccagcttcaagtgttgccacggcaaggagtgctccagcaccgggctgcaggcctccgcgccccacctggacaaggtgaacggcatctcagagctagagaacgagaaggtctacgacgatggcgccccggagtgcgggatcacgtgctggttcaagaagtccggcgagtgggtgatggggatcatcaacggcaactgggtggtcctgatcgtgctgtgcgtgctccttctgttcagcctcatcctgctgagcatcctctgccccgtccgcaagcacaagaagtcctga

SEQ ID NO: 15109 - RNA, 3402 nt, synthetic construct
  misc_feature 1..3402: note = derived and/or modified CDS sequence (opt11) from SEOV(DPRK08)__JX853576.1__GP
  source 1..3402: mol_type = other RNA
atgtggtctctgctcctgctggccgccctcgtaggccaggggtttgcactgaagaacgtcttcgacatgcgaatccagtgcccccacagcgtgaacttcggtgaaaccagcgtgtccgggtataccgagctgccgccgctcagcctgcaggaggcggagcagctggtccccgagtccagttgcaacatggacaatcaccagtcactcagcacgattaacaaattaaccaaggtgatctggaggaagaaggccaaccaggagtccgccaaccagaacagcttcgaggtggtcgagtccgaggtgagctttaagggcttgtgcatgctcaagcaccgcatggtggaggaatcctaccggaaccgccggagcgtaatatgctacgatctggcctgcaactcgaccttctgcaagcccaccgtgtacatgattgtgccgatccacgcgtgcaatatgatgaagtcctgcctgatcgggctcggcccctaccgcatccaggttgtgtacgagcgaacgtactgcaccaccggcatcctgaccgaggggaagtgcttcgtgcccgacaaggccgtcgttagcgccctgaagcgcggaatgtatgccatcgcgtcgatcgagacgatctgcttcttcatccaccagaaggggaacacctacaagatcgtgaccgccatcacctccgccatgggctcgaagtgcaacaacacggacaccaaggtccaggggtactacatctgcataatcggcggcaacagcgcccccgtgtacgccccggcgggggaggatttccgggccatggaagtgttcagtggcatcatcaccagcccccacggggaggaccacgacctccccggagaggagatcgccacctaccagatctccggccagatcgaggccaagatcccccacacggtcagctccaagaacctgaagctgaccgccttcgcagggatcccgtcttacagtagcacctcaatattagccgccagcgaggacggccgcttcatattctcccccgggctgttccccaacctgaaccagagcgtgtgcgacaacaacgccctccccctgatctggcggggcctgatcgacctcaccggctactacgaggccgtgcacccgtgcaacgtcttctgcgtgttaagcggccccggcgcaagctgtgaggccttctccgaaggcgggatcttcaacatcactagccccatgtgcctggtctccaagcagaaccgcttccgggccgccgagcaacaaatcagcttcgtgtgccagcgcgtggacatggacatcatcgtctactgcaacgggcagaagaagaccatcctcaccaaaacccttgtgatcggccagtgcatctacaccatcacctccctgttcagcctcctgcccggggtggcccacagcatcgcgatcgagctgtgcgtgccgggcttccacggatgggccaccgccgccctcctgatcaccttctgcttcgggtgggtgctgatcccggcgtgcacgctggccatactgctggtgctcaagttcttcgcaaacatcctgcacacctccaaccaggagaaccggttcaaggccatcttacgcaagatcaaggaggagttcgagaagaccaagggcagcatggtctgcgagatctgcaagtacgagtgcgagaccctcaaggagctgaaggcccacaacctgtcctgcgtgcagggagagtgtccctactgcttcacgcattgcgagcccactgagaccgcgatccaggcccactacaaggtgtgccaggccacccaccggttccgcgaggacctcaagaagacggtcactccgcaaaacattggccccgggtgctaccggaccctgaacttatttcgctacaagagccggtgctacatcctgaccatgtggaccttgctgctcataatcgagtccatcctctgggccgccagcgcggccgagatccccctggtgcccatctggacggacaacgcccacggcgtgggctccgtcccgatgcacaccgacctggagctcgacttcagcctgccctccagctccaagtacacgtacaagcgccacctgaccaaccccgtgaacgaccagcagtcggtgtccctccacatcgagatcgagagccaggggatcggcgcggacgtccaccacctggggcactggtacgacgcccgcctgaacctcaagacatccttccactgctacggcgcctgcaccaagtaccagtacccgtggcacaccgccaagtgccacttcgagaaggactacgagtatgagaactcatgggcctgcaatccgcccgactgccccggcgtcgggaccggctgcacggcctgcgggctgtacctggaccagctgaagcccgtggggaccgcgttcaaaatcatctccgtcaggtacagccgcaaggtgtgcatgcagttcggggaggaatatctgtgtaagaccatcgacatgaacgactgcttcgtgacccggcacgccaaaatctgtatcatcggcacggtaagcaaattctcccagggcgacactctcctcttcctggggcccatggagggcgggggcatcatattcaagcactggtgtaccagcacgtgccacttcggggaccccggcgacgtgatgggccccaaggacaagccgttcatctgccccgagttccccgggcagttccgcaagaagtgcaacttcgcaaccactccggtgtgcgagtacgacggcaacatcatctccggctacaagaaggtcctggccaccatagacagcttccagtccttcaacaccagcaacatccacttcacggacgagaggatcgagtggcgcgaccctgacggtatgctccgggaccacatcaacatcgtgatatccaaggacatcgacttcgagaacctggccgagaacccctgcaaggtggggctgcaggcggccaacatagagggcgcttggggctctggagtcggcttcaccctaacctgccaggtgtccctgaccgagtgtcccacgttcctgaccagtatcaaggcctgcgacatggccatctgctacggggcggagtccgtgaccctcagccgcggccagaacaccgtcaagatcacggggaagggcggccactccgggagctccttcaagtgctgccacggcaaagagtgcagctccaccgggctgcaggcctccgctccacacctggacaaggttaacggcatctccgagctcgagaacgagaaggtgtacgacgacggagccccggagtgtggcgtaacctgctggttcaaaaagtccggcgagtgggtcatgggaatcatcaacggcaactgggtggtcctgatcgtcctgtgcgtgttgctgctgttcagcctcatcctgctgagcatcttatgccccgtccggaagcacaagaagtcctga

SEQ ID NO: 15110 - RNA, 3402 nt, synthetic construct
  misc_feature 1..3402: note = derived and/or modified CDS sequence (opt11) from SEOV(Fj372/2013)__KP645197.1__GP
  source 1..3402: mol_type = other RNA
atgtggagcctgctcctgctggccgccctcgtgggcccggggttcgcactgaagaacgtcttcgacatgcgcatccagtgcccccacagcgtgaacttcggcgagaccagcgtgtccgggtacaccgagctgccgcccctcagcctgcaggaggccgagcagctggtccccgagtccagctgcaacatggacaaccaccagtccctcagcaccatcaacaaactgacgaaggtgatatggcagaagaaggccaaccaagagtccgccaaccagaacagcttcgaggtggtcgaatccgaggtgagcttcaagggcctgtgcatgctcaagcaccggatggtggaggagtcctaccgcaaccggcgcagcgtcatttgctacgacctggcctgcaactccaccttctgcaagcccaccgtgtacatgatcgtgcccatccacgcgtgcaacatgatgaagtcctgcctgatcgggctcggcccctaccggatccaggtcgtgtacgagcgcacgtactgcaccaccggcatcctgaccgaggggaagtgcttcgtgccagacaaggccgtcgtgagcgccctgaagcggggcatgtacgccatcgcgagtatcgagacgatctgcttcttcatacaccagaaggggaacacctacaagatcgtgaccgccatcacctccgcaatgggcagcaagtgcaacaacacggacaccaaggtccaggggtactacatctgcatcatcggcggcaacagcgccccggtgtacgcccccgcgggggaggacttccgcgccatggaggtgttctcgggcatcatcacctctccccacggggaggaccacgacctccccggcgaggagatcgcgacttaccagatctccggccagattgaggccaagatcccgcacacggtcagctccaagaacctgaagctgaccgccttcgcggggatcccctcctactcaagcacctccatcctcgccgccagcgaggacggccggttcatcttctcccccgggctgttccccaacctgaaccagagcgtgtgcgacaacaacgccctcccgctgatctggcgcggcttaatcgacctcaccgggtactacgaggccgtgcacccctgcaacgtcttctgcgtgctgtccggccccggcgcgagctgcgaggccttctccgagggcgggatcttcaacatcacgagccccatgtgcctggtctccaagcagaaccggttccgcgccgccgagcagcagatcagcttcgtgtgccagcgggtggacatggacatcatcgtctactgcaacgggcagaagaagaccatcctcaccaagaccctggtgatcggccagtgcatctacacgatcacctccctgttcagcttgctgccgggggtcgcccacagcatcgcgatcgagctgtgcgtccccggcttccacggctgggccaccgccgccctcctgatcaccttctgcttcgggtgggtgctgatccccgcgtgcacgctcgccatcctgctggtgctcaagttcttcgcaaacatccttcacacctccaaccaggagaaccgcttcaaggccatcctgcggaagatcaaggaggagttcgagaagacgaagggtagcatggtctgcgagatctgcaagtacgagtgcgagaccctcaaggagctgaaggcccacaacctgtcctgcgtgcagggggagtgcccctactgcttcacgcactgcgagccgaccgagaccgcgatccaggcccactacaaggtgtgccaggccacccaccgcttccgggaggacctcaagaagacggtcacgcctcagaacatcggccccgggtgctaccgcaccctgaacttgttccggtacaagagccgctgctacatcctgaccatgtggaccctcctgctgatcatcgagtcaatactctgggccgccagcgctgccgagatccccctggtgccgctgtggaccgacaacgcccacggcgtgggctccgtccccatgcacaccgacctcgagctagacttcagcctgcccagttcctccaagtacacctacaagcggcacctcaccaacccggtgaacgaccagcagagcgtgtccctgcacatcgagatcgagagccaggggatcggcgccgacgtccaccacctcgggcactggtacgacgcccgcctcaacctgaagacgtccttccactgctatggcgcgtgcaccaagtaccagtacccctggcacaccgccaagtgccacttcgagaaggactatgagtacgagaactcctgggcctgcaacccgcccgactgccccggagtggggaccggctgcacggcctgcgggctctacctcgaccaactgaagcccgtgggcaccgcgttcaagatcatctccgtccgctacagccggaaggtgtgcgtgcagttcggtgaggagtacctgtgcaagaccatagacatgaacgactgcttcgtcacccgccacgccaaaatctgcatcatcggcacggtgagcaagttctcccagggcgacacactcctgttcctggggcccatggagggcgggggcatcatcttcaaacactggtgcaccagcacgtgccacttcggagaccccggcgatgtgatgggcccgaaggacaagcccttcatctgccccgagttccccgggcagttccggaagaagtgcaacttcgccaccaccccggtctgcgagtacgacggcaacatcatctccgggtacaagaaggtgctcgccaccatcgacagcttccagtccttcaacaccagcaacatccacttcacggacgagcgcatcgagtggcgggaccccgacggcatgctgcgcgaccacatcaatatcgtgatctccaaggacatcgacttcgagaacctggccgagaacccctgcaaggtcgggctccaggcggccaacatcgagggcgcctggggaagcggggtgggtttcaccttaacctgccaggtgtccctgaccgagtgccccacgttcctcaccagcatcaaggcatgcgacatggccatctgctacggggcagagtccgtcaccctgagccggggccagaacaccgtgaagattaccggcaagggcggccactccgggagctccttcaagtgctgccacggtaaggagtgcagctccaccgggctgcaggccagcgccccgcacttagacaaggtgaacgggatctccgaactggagaacgagaaggtctacgacgacggcgcccctgagtgcgggatcacgtgctggttcaagaagtccggcgagtgggtgatggggatcatcaacggcaactgggtggtcctgattgtgctctgcgtgctgctcctgttcagcctgatcctgctcagcatcctgtgccccgtccgcaagcacaagaagtcctga

SEQ ID NO: 15111 - RNA, 3402 nt, synthetic construct; identical to SEQ ID NO: 11825
  misc_feature 1..3402: note = derived and/or modified CDS sequence (opt11) from SEOV(HeB38)__JN377554.1__GP
  source 1..3402: mol_type = other RNA

SEQ ID NO: 15112 - RNA, 3402 nt, synthetic construct
  misc_feature 1..3402: note = derived and/or modified CDS sequence (opt11) from SEOV(JiangxiXinjianRn-07-2011)__KP859513.1__GP
  source 1..3402: mol_type = other RNA
atgtggtcactgctccttctcgccgccctcgtgggccagtgcttcgcactgaagaacgtcttcgacatgcgcatccagtgcccccacagcgtgaacttcggggagacctctgtgtcaggctataccgaactgccgcccctctctttgcaggaggctgagcagctggtccccgagtcctcttgcaacatggacaaccaccagtccctcagcaccatcaataagctgaccaaggtgatctggcgaaagaaggcgaaccaggagtccgccaatcagaacagcttcgaggtggtcgaatccgaggtgagcttcaaggggctgtgcatgctcaagcaccgaatggtagaagagtcctaccggaaccgccggagcgtcatctgctacgacctggcctgcaactccaccttctgtaagcccacggtgtacatgattgtcccgatacacgcgtgtaacatgatgaagtcctgcctgatcggcctcgggccataccgcatccaggtcgtgtacgagcggacctattgcaccactggcattctgaccgagggcaagtgcttcgtgcccgacaaggccgtcgtgagtgccctgaaacgcggaatgtacgccatcgcgagcatcgagaccatctgcttcttcatccatcagaagggcaacacctataagatcgtgaccgccatcacctcagccatggggtcgaagtgcaacaacacggacaccaaagtccagggctactacatctgtatcatcgggggcaacagcgctcccgtgtacgccccggctggcgaggacttccgtgccatggaggtgttctccgggatcatcacgagccctcacggcgaggatcacgacctccccggtgaggagatcgccacgtaccaaatctccggccagatcgaggccaagatcccccacacggtgagctccaagaatctgaagctgaccgccttcgcggggattccgtcgtactccagcacctccatcctcgccgccagcgaggatgggagatttatcttttccccaggcctcttccccaacctgaaccagtccgtgtgtgacaacaatgccctccccctgatctggcgggggctgatagacctaaccggctattacgaggccgtgcatccatgcaacgtcttctgcgtgctttccgggcccggcgcgagctgcgaggccttctccgagggagggatcttcaacatcacgagccccatgtgcctggtctccaagcagaaccgcttccgagccgccgagcagcaaattagcttcgtgtgccagcgcgtggacatggacatcatcgtctactgtaacggccagaaaaagacaattctcaccaagaccctggtgattgggcagtgcatctacacgatcacctccctgttcagcctcctgcccggcgtggcccactcgatcgcgatcgagctgtgcgtcccggggttccacggctgggccactgccgccctcctgatcactttctgctttggctgggtgctgatccccgcctgcacgctcgcgatcctgctggtgctcaagttcttcgccaacatcctgcacacttccaaccaggagaatcggttcaaggccatactgcgcaaaatcaaggaggagttcgaaaagaccaaggggagcatggtctgcgagatctgcaagtacgaatgcgagaccctgaaggagctgaaggcccacaacctgtcctgcgtccagggcgagtgcccctattgcttcacgcactgcgagcccaccgagaccgcgattcaagcccactacaaggtatgccaggccacccatcggttccgcgaggacctcaagaagacggtcacccctcagaacatcgggcccggctgctaccggaccctgaacctgtttcgctacaagagccggtgctacatcctgaccatgtggactctcctgctcataatcgaatccatcctctgggcggcctctgcggccgagatcccattggtgcccctgtggacggacaacgctcacggagtcggctccgtcccgatgcacaccgacctcgagctggacttctcactgccctccagctccaagtacacctacaagaggcacctcaccaacccggtgaacgaccagcagagcgtgtcactgcacatcgagatcgagagccagggaatcggggccgacgtgcaccacttgggccactggtacgacgcccgcctcaacctgaagacatccttccactgttacggggcgtgtaccaagtaccagtacccgtggcacaccgcgaagtgtcacttcgagaaggactacgagtacgagaacagctgggcctgcaacccgccggactgccccggcgtgggcacaggctgcacggcctgcggcctgtacttagaccagttgaagcccgtgggaaccgcgttcaagatcatctccgtccggtacagtcgtaaggtctgcgtgcagttcggcgaagaatacttctgcaagaccatcgacatgaacgattgcttcgtcactcggcacgccaagatctgcatcatcgggacagtgagcaagttctcccaaggcgacaccctcctcttccttggacccatggaaggcggcgggatcatcttcaagcactggtgcaccagcacgtgtcacttcggggaccccggggacgtaatgggccccaaggacaagccgtttatctgccccgagttccccggccagttccgcaagaaatgtaacttcgccaccacccccgtctgcgaatacgacgggaacatcatttccggctacaagaaggtgctggccacaatcgactccttccaatccttcaacaccagcaacatccacttcacggacgagcggattgaatggcgcgacccggacgggatgctccgggaccacatcaacatcgtcatctccaaggatatagacttcgagaacctggccgagaacccctgcaaggtcggcctgcaggcggcaaacatcgagggggcctggggcagcggcgtggggttcaccctgacatgccaagtgtccctcaccgagtgccccacgttcttaaccagcattaaggcctgcgacatggccatctgctatggcgcggagtccgtcaccctcagccgcgggcagaacacagtgaagatcacaggcaagggcgggcactcgggcagctccttcaagtgctgccacggaaaggagtgcagctccaccggcttgcaggccagcgcgccccacctggacaaggtgaacgggatctccgagctcgaaaacgaaaaggtgtacgacgatggcgccccggaatgcggcataacctgctggttcaagaagtcaggggaatgggtgatgggcatcatcaatgggaactgggtggtcctgatcgtgctgtgcgtgctcctgctgttcagcctcatcctgctgtcgattctctgccccgtccggaagcacaagaagtcgtga

SEQ ID NO: 15113 - RNA, 3402 nt, synthetic construct
  misc_feature 1..3402: note = derived and/or modified CDS sequence (opt11) from SEOV(LYON/Rn/FRA/2013/LYO852)__KF387724.1__GP
  source 1..3402: mol_type = other RNA
atgtggagcctcctcctcctggccgcccttgccggacaggggttcgcgctgaagaacgtgttcgacatgcgcatccagtgcccccacagcgtcaacttcggcgagaccagcgtgtccgggtacaccgagctgccgccccttagcctgcaggaggccgagcagttggtgccggagtccagctgcaacatggacaaccaccagtccctcagcaccatcaacaagctgaccaaggtcatctggcggaagaaggccaaccaggagtccgcgagccagaactccttcgaggtggtggagagcgaggtctcattcaagggcctgtgcatgctccgccaccggatggtggaagagagctacaagaaccgccggtccgtgatctgctacgacctggcgtgcaacagcaccttctgcaagcccaccgtctatatgatcgtaccgatccacgcctgcaacatgatgaagtcctgcctgatcgggctcgggccctaccgcattcaggtggtttacgaacggacgtactgcacaactggcatcctgaccgaggggaagtgcttcgtgcccgacaaggccgtggtcagcgccctgaagcgcggcatgtacgcgatcgcctccatcgagacgatctgcttcttcatccaccagaaggggaacacctacaagatcgtgacggccatcaccagcgccatgggcagcaagtgcaacaacacggacaccaaggtgcaggggtactacatctgcatcattggtggcaactccgcccccgtatacgcgccggccggggaggacttccgggccatggaagtgttcagcggcatcatcaccagcccccacggggaggaccacgatctccccggcgaggagatcgccacctaccagatcagcggccagatcgaggccaagatcccccacacggtgtccagcaagaacttaaagctgaccgcgttcgccgggatcccgtcctacagcagtaccagcatcctcgccgcttccgaggacggccgcttcatcttcagccccggactgttccccaacctgaaccagtccgtctgcgacaacaacgccctccccctgatctggcggggcctgatcgacctcaccgggtattacgaggcggtgcacccgtgcaacgtgttctgcgtcctgagcggccccggcgcctcctgcgaggccttcagcgagggcgggatcttcaacatcacgtcgcccatgtgcctggtgagcaagcagaaccgcttccgggctgccgagcagcagatctccttcgtctgccagcgcgtggacatggatatcatcgtgtactgcaacgggcagaagaagaccatcctcaccaagaccctggtcatcggccagtgcatctacacgatcaccagccttttcagcctcctacccggggtggcgcactccatcgccatcgagctttgcgtgccgggcttccacggctgggccaccgccgcgctcctgatcaccttctgcttcgggtgggtcctgatccccgcctgcacgctcgccatcctgctggtgctcaagtttttcgccaacatcctgcacaccagcaaccaggagaaccggttcaaggccatcctgcgcaagatcaaagaagagttcgagaagaccaagggctccatggtgtgcgagatttgcaagtacgagtgcgagaccctcaaggagctgaaggcgcacaacctgagctgcgttcagggggagtgcccctactgcttcacgcactgcgagcccaccgagaccgccatccaggcccactacaaggtgtgccaggccacccaccggttccgcgaggacctcaagaagacggtgaccccgcagaacatcggccccggttgctaccgaaccctgaacctgttccgctacaagtcacggtgctacatcctgaccatgtggaccctcctgctgatcatcgagagcatcctctgggccgcgtccgccgccgagatccccctagtccccctgtggacggacaacgcccacggcgtgggcagcgtgccgatgcacaccgacctcgagctggacttctccctgcccagctccagcaagtacacctacaaacgccacctcacgaaccccgtcaacgaccagcagtccgtgagcctgcacatcgagatcgagtcccaggggatcggcgccgacgtgcaccacctggggcactggtacgacgcacgcctcaacctgaagacgagcttccactgctacggcgcctgcaccaagtaccagtacccgtggcacaccgccaaatgccacttcgagaaggactacgagtacgagaactcctgggcctgcaacccgcccgactgccccggcgtcgggaccggctgcacggcgtgcgggctgtacctcgaccagctgaagcccgtgggcaccgctttcaagatcatcagcgtgcggtacagccgcaaggtctgcgtgcagttcggggaggagtacctgtgcaagaccatcgacatgaacgactgcttcgtgacccggcacgccaagatctgcatcatcggcacggtctccaagttcagccagggcgataccctcctgttcctggggcccatggagggcgggggcatcatcttcaagcactggtgcacctccacgtgccacttcggggaccccggcgacgtgatgggccccaaggacaagccgttcatctgccccgagtttcccgggcagttccgcaagaagtgcaacttcgccaccacccccgtgtgcgagtacgacggcaacatcatcagcgggtacaaaaaggtcctcgccaccatcgactccttccagagcttcaacacctccaacatccacttcacggacgagcggatcgagtggcgcgaccccgatggcatgctgcgtgaccacatcaacatcatcatcagcaaggacatcgacttcgagaacctggcggagaacccctgcaaggtggggctccaggccgccaacatcgagggcgcctggggctccggggtgggcttcaccctgacctgccaggtcagcctgaccgagtgccccacgttccttacctccatcaaggcctgcgacatggcgatctgctacggggccgagagcgtgaccctgtcccgcggccagaacaccgtgaagatcacggggaagggcggccacagcggttccagcttcaagtgctgccacggcaaggagtgctccctgaccgggctccaggccagcgctccccacttagataaggtcaacggcatctccgagctggagaacgagaaggtgtacgacgacggcgccccggagtgcgggatcacgtgctggttcaagaaatccggcgagtgggtgatggggatcatcaacggcaactgggtcgtgctcatcgtgctgtgcgtcttccttctgttcagcctgatcttactctccatactgtgccccgtccggaaacacaagaagtcctga

SEQ ID NO: 15114 - RNA, 3402 nt, synthetic construct
  misc_feature 1..3402: note = derived and/or modified CDS sequence (opt11) from SEOV(Seoul-Baxter/NYC-D1_M)__KJ950863.1__GP
  source 1..3402: mol_type = other RNA
atgtggagcctgctcctgctggccgccctcgtgggccaggggtttgccctgaagaacgtgttcgacatgaagatccagtgcccccacagcgtgaacttcggcgagaccagcgtgtccgggtataccgagctgccgccccttagcctgcaggaggccgaacagctggtcccggagtccagctgcaacatggacaaccaccagtccctcagcaccatcaacaaactgaccaaggtgatctggcgcaagaaggccaaccaggagtccgccaaccaaaacagcttcgaggttgccgagtccgaggtcagcttcaagggcctgtgcatgctcaagcaccggatggttgaggagtcctaccgcaaccggcgcagcgtgatctgctacgacctggcgtgcaactccaccttctgcaagcccaccgtttacatgatagtgccgatccacgcctgcaacatgatgaagtcctgcctgatcgggctcggcccctaccggatccaggtggtctacgagcgcacgtactgcaccacaggcatcctgaccgaggggaagtgcttcgtacccgacaaggccgtggtcagcgcactgaagcggggtatgtacgcgatcgcctcgatcgagacgatctgcttcttcatccaccagaaggggaatacctacaagatagtgaccgccatcacctccgccatgggcagcaagtgcaacgacacggacaccaaggttcaggggtactacatctgcataatcggcggcaacagcgcccccgtctacgcgccggccggggaggatttccgcgccatggaggtgttcagcggcatcatcaccagcccccacggggaggaccacgacctccctggcgaggagatcgccacctaccagatctccggccagatcgaggccaagatcccccacacggtgagcagcaagaacctgaagctgaccgcgttcgccggaatcccgagctactcctcgacctccatcctcgccgccagcgaggacggccgtttcattttctcccccgggctgttccccaatctgaaccagagcgtctgtgacaacaacgccctccccctggtgtggcgcggcctgatcgacctcaccgggtactacgaggcggtgcacccgtgcaacgtcttctgcgtgctgtccggccccggcgccagctgcgaggccttttccgagggcgggatcttcaacatcacgtcgcccatgtgcctggtctccaagcagaaccggttccgcgccgccgagcagcagatcagcttcgtgtgccagcgggtggacatggacatcatcgtctactgcaacgggcagaagaagactatcctcaccaagacactggtgatcggccagtgcatctacacgatcacctccctgttcagcctcctgcccggggtagcgcacagcatcgccatcgagctgtgcgtcccgggcttccacggctgggccaccgccgcgctcctgatcaccttctgcttcgggtgggtgctgatccccgcctgcacgctcgccatcttactggtgttgaagttcttcgccaacatcctgcacacgtccaaccaggagaaccgcttcaaggccatcctgcggaagatcaaggaggagttcgagaagaccaagggcagcatggtctgcgagatctgcaagtacgagtgcgagaccctcaaggagctgaaggcgcacaacctgtcctgcgtgcagggggagtgcccctactgcttcacgcactgcgagcccaccgagaccgccatccaggcacactacaaggtgtgtcaggccacccaccgcttccgggaggacctcaagaaaacggtcacgccgcagaacatcgggcccgggtgctaccgcactctgaacctgttccggtacaagagccgctgctacatcctgaccatgtggaccctcctcctgatcatcgaatccatcctctgggccgcgagcgccgccgagatccccctggtgcccctgtggacggacaacgcccacggcgtgggctccgtcccgatgcacaccgacctcgagctggacttcagcctgccctccagctccaagtacacctataaacggcacctcaccaacccagtgaacgaccagcaaagcgtgagtctgcacatcgagatcgagagccaggggatcggcgccgacgtccaccacctggggcattggtacgacgcgcgcctcaacctgaagacgtccttccactgctacggcgcctgcaccaagtaccagtacccgtggcacaccgccaaatgccacttcgagaaggactacgagtacgaaaacagctgggcctgcaacccgcccgactgccccggcgtggggaccggctgcacggcgtgcgggctgtacctcgaccagctgaagcccgtgggcaccgccttcaagatcatctccgtccgctacagccggaaggtgtgcctgcagttcggggaggagtacctctgcaagacaatcgatatgaacgattgcttcgtgacccgccacgtcaagatatgcatcatcggcacggtgagcaagttctcccagggcgacaccctgctgttcctcgggcccatggagggcgggggcatcatattcaagcactggtgcaccagcacgtgccacttcggggaccccggcgacgtgatgggccccaaagacaagccgttcatctgccccgagttccccgggcagttccggaagaagtgcaatttcgccaccacccccgtctgcgagtacgacggcaacatcatctccgggtacaagaaggtgctggccacgatcgacagcttccagtccttcaacaccagcaacatccacttcacggacgagcgcatcgagtggcgggacccggacggcatgctgcgcgaccacatcaacatcgtgatctccaaggacatcgacttcgagaacctcgccgagaacccttgcaaggtcgggctgcaggcggccaacatcgaaggcgcctggggcagcggggtgggcttcaccctgacctgccaggtgtccctcaccgagtgccccacgttcctgaccagcatcaaagcctgcgacatggccatctgctacggggcggagtccgtcaccctgagccggggccagaacaccgtgaagatcacggggaagggcggccactccggaagctccttcaagtgctgccacggcaaggagtgcagctccaccgggctccaggccagcgcgccccacctggacaaggtgaacggcatctccgagctggagaacgagaaggtctacgacgacggcgccccggagtgcgggatcacgtgctggttcaagaagtccggcgagtgggtgatggggatcatcaacggcaactgggtggtcctcatcgtgttgtgcgtgctgctcctattcagcctgatcctcctgagcatcctgtgccccgtccgcaagcacaagaagtcctga

SEQ ID NO: 15115 - RNA, 3402 nt, synthetic construct
  misc_feature 1..3402: note = derived and/or modified CDS sequence (opt11) from SEOV(Singapore/06(RN41))__GQ274942.1__GP
  source 1..3402: mol_type = other RNA
atgtggagcttactcctgctggccgccctcgccggccaggggttcgccctgaagaacgtgttcgacatgcgcatccagtgcccccactccgtcaatttcggcgagaccagcgtgtccgggtacacagagctgccacccctcagcctgcaggaggccgagcagctggtgcccgagtccagctgcaacatggacaaccaccagtcactcagcaccatcaacaagctgaccaaggtcatctggcggaagaaggccaaccaggagtccgccagccagaactccttcgaggtggtggagagcgagatctccttcaagggcctgtgcatgctcaagcaccgcatggtcgaggagagctaccggaaccgtcggtccgtgatctgctacgacctggcatgcaacagcaccttctgcaagcccaccgtgtacatgatcgtcccgatccacgcttgcaacatgatgaagtcctgcctgatagggctcggcccctaccgcatccaagtggtgtacgagcggacgtactgcaccacaggcatcctgaccgaggggaagtgcttcgtccccgacaaggccgtggtgagcgctctgaagcgcggcatgtacgcgatcgcctccatcgagacgatctgcttcttcatccaccagaaggggaacacctacaagatcgtcaccgccatcaccagcgccatgggctcaaagtgcaacaacacggacaccaaggtgcaggggtactacatctgcatcatcggcggcaactccgcccccgtgtacgcgccggcgggggaggacttccgggccatggaggtcttcagcggcatcatcaccagcccccacggggaagaccacgacctccccggcgaggagatcgccacctaccaaatcagcggccagatcgaggccaagatcccccacacggtgtccagcaagaacctgaaacttaccgcgttcgccgggatcccgtcctacagctccaccagcatcctcgccgcctccgaggacggccgcttcatcttcagccccggcctgttccccaacctgaaccagtccgtgtgcgacaacaacgccctccccctgatctggcggggcctgatcgacctcaccgggtactacgaggcggtccacccgtgcaacgtgttctgcgtgctgagcggccccggcgcctcctgcgaggccttcagcgaaggtgggatcttcaacatcacgtcccccatgtgcctggtcagcaagcagaaccgcttccgggccgccgagcagcagatctccttcgtgtgccagcgcgtcgacatggacatcatcgtgtactgcaacgggcagaagaagaccatcctcaccaagaccctggtgatcggccagtgcatctacacgatcaccagcctgttcagcctcctgcccggagtcgcgcactccatcgccattgagctgtgcgtgcccggcttccacggctgggccaccgccgcgctcctgatcaccttctgctttgggtgggtgctgatccccgcctgcacgctcgccatcctgctggtcctcaagttcttcgccaacatcctgcacaccagcaaccaggagaaccggttcaaggccatcctgcgcaagattaaggaggagttcgagaagaccaagggctccatggtctgcgagatctgcaagtacgagtgcgagaccctcaaggagctgaaggcgcacaacctgagctgcgtgcagggggagtgcccctactgcttcacgcactgcgagcccaccgagaccgcgatccaggcccattacaaggtctgccaggccacgcaccggttccgcgaggacctcaagaaaacggtgaccccgcagaacatcggccccgggtgctaccggaccctgaacctgttccgctacaagtcccggtgctacatcctgaccatgtggaccctcctgctgatcatcgagagcatcctctgggccgcgtccgccgccgagatccccctggtgcccttatggaccgacaacgcccacggcgtcggcagcgtgcccatgcacaccgacctcgagctggacttctccctgcccagctccagcaagtacacctacaagcgccacctcactaaccccgtgaacgaccagcaatccgtcagcctgcacatcgagatcgagtcccaggggatcggtgccgatgtgcaccacctggggcactggtacgacgcgcgcctcaacctgaagacgagcttccactgctacggcgcctgcaccaagtaccagtacccgtggcacactgccaagtgccacttcgagaaggactacgaatacgagaactcctgggcctgcaacccgcccgactgccccggcgtggggaccggctgcacggcgtgcgggctctacctcgaccagttgaagcccgtcggcaccgccttcaagatcatcagcgtgcggtacagccgcaaggtgtgtgtccagtttggggaggagtacctgtgcaagaccatcgacatgaacgactgcttcgtcacccggcacgccaaaatctgcatcatcggaacggtgtccaagttcagccagggcgacaccctcctgttcctagggcccatggagggcgggggcatcatcttcaagcactggtgcacctccacgtgccacttcggggaccccggcgacgtcatgggccccaaggacaagccgttcatctgccccgagttccccgggcagtttcgcaagaagtgcaacttcgccaccacccctgtgtgcgagtacgacggcaacatcatcagcgggtacaagaaggtgctcgccaccatagactccttccagagcttcaacacctccaacatccacttcacggatgagcggatcgagtggcgcgacccggacggcatgctgcgggaccacatcaacatcgtcatcagcaaggacatcgacttcgagaatctggcggagaacccctgcaaagtggggctccaggccgccaacatagagggcgcctggggttccggggtgggcttcacgctgacctgccaggtcagcctgaccgagtgccccacgttcctcacctccatcaaggcctgcgacatggcgatctgctacggggccgagagcgtgaccctgtcccgaggccagaacaccgtgaagatcacggggaagggcggccacagcgggtccagcttcaagtgctgtcacggcaaggagtgctccagcaccgggctgcaggcgtccgcgccccacctcgacaaggtcaacggcatcagcgagctggagaacgagaaggtgtacgacgacggcgccccggagtgcgggatcacgtgctggttcaagaagtccggcgagtgggtcatggggatcatcaacggcaactgggtggtcctgatcgtgctctgcgtcctgctcctgttctccttgatcctgctcagcatcctgtgtcccgtgaggaagcacaagaagtcctga

SEQ ID NO: 15116 - RNA, 3402 nt, synthetic construct; identical to SEQ ID NO: 11830
  misc_feature 1..3402: note = derived and/or modified CDS sequence (opt11) from SEOV(11CSG)__AB618131.1__GP
  source 1..3402: mol_type = other RNA

SEQ ID NO: 15117 - RNA, 3402 nt, synthetic construct
  misc_feature 1..3402: note = derived and/or modified CDS sequence (opt11) from SEOV(5CSG)__AB618130.1__GP
  source 1..3402: mol_type = other RNA
atgtggagcctgctcctgctggccgccctcgccggccagggtttcgccctgaagaacgtgttcgacatgcgcatccagtgcccccactccgtcaacttcggcgagaccagcgtgtccgggtacaccgagcttccgcccctcagcctgcaggaggccgagcagctggtgcccgagtccagctgcaacatggacaaccaccagtccctcagcaccatcaacaagttaaccaaggtcatctggcggaagaaggccaaccaggagtccgccagccagaactccttcgaggtggtggagagcgaagtctcctttaaaggcctgtgcatgctcaagcaccgcatggtggaggagagctaccggaatcgccggtccgtgatctgctacgacctggcgtgcaacagcaccttctgcaagcccaccgtctacatgatcgtgccgatccacgcctgcaacatgatgaagtcctgcctgatcgggctcggcccctaccgcatccaggtggtctacgagcggacatactgcaccaccggcatcctgaccgaggggaagtgcttcgttcccgacaaggccgtggtcagcgccctaaagcgcggcatgtacgcgatcgcctcgatcgagacgatctgcttcttcatccaccagaaggggaacacctacaagatcgtgaccgccatcaccagcgccatgggcagcaagtgcaataacacggacaccaaggtgcaggggtactacatctgcatcatcggcggcaactccgcccccgtctacgcgccggccggggaggacttccgggccatggaggtgtttagcggcatcatcaccagcccccacggggaggaccacgacctccccggcgaggagatcgccacctaccagatcagcggccagatcgaggccaagataccccacacagtgtccagcaagaacctgaagctgaccgcgttcgccgggatcccgtcctacagctccaccagcatcctcgccgcctccgaggacggccgcttcatcttcagccccgggttattccccaacctgaaccagtccgtctgcgacaacaacgccctccccctgatctggcggggcctgatcgacctcaccgggtactacgaggcgatccatccatgcaacgtgttctgcgtgctgagcggccccggcgcctcctgcgaggccttcagcgagggcgggatcttcaacatcacttcccccatgtgtctcgtcagcaagcagaatcgcttccgggccgccgagcagcagatatccttcgtgtgccagcgcgtcgatatggacatcattgtgtactgtaacgggcagaagaagaccatcctcaccaagaccctggtgatcggccagtgcatctacacgataacgagcctgttcagcctcctgcccggggtcgcgcactccatcgccatcgagctgtgcgtgcccggcttccacggatgggccaccgccgcgctcctgatcaccttctgcttcgggtgggtgctgatccccgcctgcacgctcgctattctgctggtcctcaagttcttcgccaacatcctgcacaccagcaaccaggagaaccggttcaaggctatcctgcgcaagatcaaggaggagtttgagaagaccaagggatccatggtgtgcgagatctgtaagtacgagtgcgagaccctcaaggagctgaaggcgcacaacctgagctgcgtgcagggggaatgcccctactgcttcacgcactgcgagcctaccgagaccgccatccaggcccactacaaggtctgccaggccacccaccggttccgcgaggacctcaagaagacggtgaccccgcagaatatcgggcccgggtgctaccggaccctgaacctgttccgctacaagtcccggtgctacatcctgaccatgtggaccctcctgctgatcatcgagagtatcctctgggccgcgtccgccgccgagatccccctggtgcccctgtggacggacaacgcccacggcgtcggcagcgttccgatgcacaccgacctcgagctggacttctccctgcccagctccagcaagtacacctacaagcgccacctcacaaatcccgtgaacgaccagcagtccgtcagcgtgcacatcgagatcgagtcccaggggatcggcgctgacgtgcatcacctgggtcactggtacgacgcgcgcctgaacctcaagacgagcttccactgctacggagcctgcaccaagtaccagtacccgtggcacaccgccaaatgccacttcgagaaggactacgagtacgagaactcctgggcctgcaacccgccggactgccccggcgtcggaaccggctgcacggcgtgcgggctgtacctggatcagctcaagcccgtaggcaccgccttcaagatcatcagcgtacggtacagccgcaaagtctgcgtgcagttcggggaggagtacctgtgcaagaccatcgacatgaacgactgcttcgtgacccggcacgccaagatctgcatcatcggcacggtctccaagttcagccagggcgacaccctcctcttcctggggcccatggagggcggcgggatcatcttcaagcactggtgcacctccacttgccacttcggggaccccggggacgtgatgggccccaaggacaagcccttcatctgccccgagttccccgggcagttccgcaagaagtgcaacttcgccaccacccccgtgtgcgagtacgacggcaacaccatcagcgggtacaagaaggtcctggccaccatcgattccttccagagcttcaacacgtccaacatccacttcaccgacgagcggatcgagtggcgcgacccggacggcatgctccgggaccacatcaacatcgtgatcagcaaggacatcgacttcgagaacctggcggagaacccctgcaaagtggggctgcaggccgcgaacatcgagggcgcctggggctccggggtcggcttcaccctgacctgccaggtgagcctgacggagtgccccaccttcctgacctccatcaaggcctgcgacatggcgatctgctacggggccgagagcgtgaccctctcccgcggccagaatacggtcaagatcaccggaaagggcggccacagcgggtccagcttcaagtgctgccacggcaaggagtgctccagcaccgggctgcaagcctccgcgccccacctggacaaggtgaacggcatctcggagctcgagaacgagaaggtctacgacgacggcgccccggagtgcgggatcacgtgctggttcaagaagtccggcgagtgggtcatggggatcatcaacggcaactgggtggtgctgatcgtcttatgcgtgctcctgctgttctccctcatcctgctgagcatcctctgccccgtgcggaagcacaaaaagtcctga

SEQ ID NO: 15118 - RNA, 3402 nt, synthetic construct
  misc_feature 1..3402: note = derived and/or modified CDS sequence (opt11) from SEOV(80-39)__S47716.1__GP
  source 1..3402: mol_type = other RNA
atgtggtcactgttactgctggccgcattggtgggccaggggttcgccctgaagaacgtcttcgacatgcgcatccaatgcccgcactccgtcaagttcggcgaaacaagcgtgtccgggtacaccgagcttccgcctctcagcctgcaggaggccgagcaactggtccctgagtccagctgcaacatggataaccaccaatccctcagcaccatcaacaaactgaccaaagtgatctggagaaagaaagccaaccaggagagcgccaaccagaacagcttcgagttaatggagtcagaggtcagcttcaagggcctctgcatgctaaagcaccgcatggtcgaggagtcctaccggaaccgccgaagcgtgatctgctacgatctggcctgcaacagtaccttctgcaagcccaccgtgtacatgatagtcccgatccacgcgtgcaacatgatgaagtcctgcttaatcgggctgggcccctaccgcgtccaggtggtgtacgaaaggacgtactgcaccaccggaatcctgaccgaagggaagtgctttgtccccgacaaggccgtagtctccgcgctcaagcgcggcatgtatgccatagcgagcatagagacgatctgcttcttcatccaccagaaagggaacacctacaaaattgtgaccgctatcacatccgccatgggcagtaagtgcaacaacacagacaccaaggtgcaggggtactacatatgtatcatcggcgggaacagcgcccccgtgtacgccccggcaggggaggactttcgggccatggaagtgttctcaggcataatcaccagcccccacggggaagaccacgacctgcccggcgaggagatagccacctaccagatctcgggccaaatcgaggccaagatccctcatacggttagctccaagaatctcaagctcaccgccttcgcggggatccctagctactccagcacctccatacttaccgctagcgaggatggccgtttcatcttcagtcccgggctgtttccgaacttgaaccagagcgtctgcgacaacaacgccctgccgctgatctggcggggcctcattgacctaaccgggtactacgaggccgtgcacccgtgcaatgtgttctgcgtcctctctggcccgggggccagctgcgaagcgttctccgagggcggcattttcaacattacctcgccgatgtgcctcgtctccaagcagaatcgcttccgggcagccgagcaacaaatctcgttcgtctgccagcgcgttgacatggacatcatagtgtattgcaacgggcagaagaagacgatactgaccaagacgctcgtcatcggccagtgcatctacaccattacctcactcttcagccttctgcccggagtggcccacagcatcgccatcgagctctgcgtgccgggcttccacggctgggccaccgccgccctgcttatcacgttctgctttgggtgggtcctcatccccgcctgcaccctggcgatcctgctggtgttgaagttcttcgccaacatcctgcacacctccaatcaagaaaaccggttcaaggccatcctccgaaagatcaaggaggagttcgagaagaccaagggcagcatggtgtgcgagatctgcaagtacgaatgcgagactttgaaggagctgaaggcacacaacctcagttgcgtgcagggggagtgcccatattgcttcacacattgcgagcctaccgagacggccattcaggcgcactacaaggtgtgccaggccacgcaccggtttcgcgaggacctgaagaagacggtgactccccagaatatcggcccaggatgctaccggaccctgaacctgttccgctacaagagccggtgctacatcctaaccatgtggacgctgctgctcatcatagagtccatcctgtgggccgccagcgccgcggagattccattggtccccctgtggaccgacaatgcccacggcgtcggctccgtaccaatgcacaccgacctggagctggacttcagcctcccctccagctcccgctatacgtacaagcgccatctgacgaacccagtcaacgaccagcagagcgtgtccctccacatcgagatcgaatcgcaggggatcggcgccgacgttcaccacctcgggcactggtacgacgcccgactcaacctgaagacctccttccactgttacggagcctgcacgaagtaccagtatccgtggcacacggcgaagtgccacttcgagaaggattacgagtacgagaacagctgggcatgcaacccacccgactgccctggcgtcggcacgggctgtacggcctgtgggctctacctagaccagctgaagcccgtgggcaccgccttcaagataatctccgtgcgctacagcaggaaggtctgcgtgcagtttggggaggagtacctctgcaagactatcgatatgaacgactgcttcgtgacgcgtcacgccaagatatgcatcataggaactgtcagcaaattctcccagggcgatacccttctgttcttggggcccatggagggcggaggcatcatcttcaagcactggtgcaccagcacgtgccatttcggcgaccccggcgatgtgatgggccccaaggacaagccatttatctgcccggagttccccggtcaattccggaagaagtgtaacttcgccaccacccccgtgtgcgagtacgacggcaacatcatttccggatacaagaaggtcctggccaccatcgatagcttccagtccttcaacaccagcaacatccacttcaccgatgagcggatcgagtggcgggacccagacggcatgttacgcgaccacatcaatatcgtgatttccaaggacatcgacttcgagaacctcgccgagaacccttgcaaggtggggctgcaggccgcgaatatcgagggcgcctggggcagcggggtgggcttcacgctgacgtgccaggtgtccctcacggagtgccccacatttttaaccagcataagagcctgcgatatggccatttgctacggggccgagtccgtgaccctgagccgcggccagaacacagtcaagattactgggaagggcggacatagcgggagctccttcaagtgctgccacggcaaggagtgcagcctcaccgggctgcaagcgtccgcgccccacctggacaaggtgaacggcatcagcgagctagagaacgaaaaagtgtacgacgatggcgccccggagtgcggcatcacgtgctggttcaagaaatccggcgagtgggtcatgggcatcatcaatggcaattgggtggtgctgatcgtcctgtgcgtactcctactgttcagcctcatcctgctgagcatcctctgccccgtgcggaagcacaaaaagagctga

SEQ ID NO: 15119 - RNA, 3402 nt, synthetic construct
  misc_feature 1..3402: note = derived and/or modified CDS sequence (opt11) from SEOV(93HBQ3)__KM115585.1__GP
  source 1..3402: mol_type = other RNA
atgtggagcttgctcctgctggccgccctcgtgggtcaagggttcgccctgaagaacgtcttcgacatgcgcatccagtgcccccacagcgtgaaatttggcgagaccagcgtctcggggtataccgagctgccgcccctcagcttgcaagaggccgagcaactggtccctgagtccagctgcaacatggacaaccaccaatccctcagcaccatcaacaagctgaccaaggtgatctggcagaagaaggcaaaccaggagtccgccaaccaaaactcatttgaggtggccgaatccgaggtgagcttcaagggcctgtgcatgctcaagcaccgaatggtggaagaatcctaccgcaatcgccgcagcgtgatctgctacgaccttgcgtgcaactcaaccttttgcaagcccactgtctacatgatcgtaccgatacacgcctgcaacatgatgaagtcctgcctgatcgggttgggcccctacagaatccaggtggtctacgaacgcacgtactgtaccaccggcatcctgaccgaggggaagtgcttcgttccagacaaggccgtggtatccgccctaaaacggggcatgtacgcgatcgccagcatcgagactatctgcttcttcatacaccagaaggggaacacctacaagatcgtgaccgccatcacctccgcaatgggcagcaagtgcaacaacacggataccaaggtgcaggggtactacatctgcataataggcgggaacagcgcacccgtctacgccccgtctggggaagacttccgcgccatggaggtcttcagcggcatcatcatgagcccccacggggaggatcacgacctccccggagaggagatagccacctaccaaatttcaggccagatcgaggccaagatcccccacaccgtaagctcaaagaacctgaaacttacggccttcgcgggaataccgtcctacagctccaccagcatcctcgccgcctccgaggatggaagattcatcttctctcccgggttattccccaacctaaaccagtccgtttgcgacaacaacgccctccccttgatctggcggggcctgatcgacctcacagggtactacgaggccgtgcacccttgcaatgtcttctgcgtcctgagcggccccggcgcgtcctgcgaggcctttagcgagggcgggatctttaacatcacgtcccctatgtgcctggtgagcaaacagaatcggttccgcgccgcggaacagcaaatctctttcgtctgccaacgggtggacatggacatcatcgtgtattgtaacggacagaagaagacgatcctcaccaagaccctggtcatcggccaatgcatctacaccatcacgagtttgttcagcctcctgcccggggtggcccactccatcgcgatcgagctgtgcgtgccgggcttccacggttgggccaccgccgccttgctgatcaccttctgcttcggttgggtcctgatccccgcgtgcactctcgccattttactggtgctcaagttcttcgccaacatcctgcacacaagcaaccaggagaaccgtttcaaggccatcttacggaaaataaaggaagagtttgaaaagaccaagggctccatggtgtgcgagatttgcaagtacgagtgcgaaaccctcaaagagctgaaagcccacaacctgagctgcgtccaaggggagtgcccctactgcttcacccactgcgagcccacggagaccgctatccaggcacactacaaggtgtgccaggcaacccacagattccgggaggatctcaagaagaccgtgacaccccagaacatcggacccgggtgttatagaaccctgaacctgttccggtacaagtctaggtgttacatcctgaccatgtggacgctcctcttgatcatcgagagcatcctctgggccgcgtccgcggccgagatccccctggtccccctatggaccgacaacgcacacggcgtgggctcagtgccgatgcacacggatctcgagctcgacttctccctgcccagctccagcaagtacacttacaagcgccacctcacgaaccccgtcaacgaccagcagtccgtgtcactgcacatcgagatcgagtcgcaggggatcggcgcggacgtgcaccacctgggtcattggtacgacgctcgcctcaacctgaagaccagcttccactgctacggtgcgtgcacgaagtaccaatacccgtggcacaccgccaaatgccacttcgagaaggactacgagtacgagaactcctgggcttgcaacccgcccgactgtcccggggtcgggaccggctgcaccgcttgcgggctgtacctcgaccagctgaagcccgtgggcacggccctgaagatcatcagcgtgcgctatagccggaaggtgtgcgtacagttcggagaggagtatctctgcaagaccatcgacatgaatgactgcttcgtgacgcgccacgccaagatatgcatcatcggaaccgtctccaaattttcccagggcgatacgcttctgttcctcgggccgatggagggcggtgggatcatcttcaagcactggtgcacttcgacgtgccacttcggggaccccggcgacgttatgggccccaaggacaagccgttcatttgccccgagtttcccgggcagttccggaagaagtgcaactttgccaccacccccgtgtgcgagtacgacggaaacatcatcagcgggtacaagaaggtcctcgccaccatcgactccttccagagcttcaatacttctaacatccacttcaccgacgagcgcatcgaatggcgagaccctgacggcatgctgcgcgaccacatcaacatcgtaatctcaaaggacatcgacttcgagaaccttgccgagaacccgtgcaaggtggggctgcaggcggccaacatcgagggcgcctgggggtccggggtcggcttcacgctgacctgccaggtgagcttaaccgagtgccccaccttcctcacgtccataaaggcctgcgacatggccatctgctacggggcggagtccgtaactctgctgcggggccaaaacacggtcaagatcaccgggaagggaggccactcagggagctccttcaagtgctgccacggcaaggagtgcagctccacggggctgcaggccagcgctccccacctggacaaggtaaacggcatctccgaattagagaacgagaaagtgtatgatgacggcgcccctgaatgcgggataacgtgctggttcaagaagtccggcgagtgggtcatggggattatcaacggcaactgggtggtgctaatcgtcctgtgcgttctcttactgttctctttaatcctgttaagtatcctctgtcccgttaggaagcacaagaagagttag

SEQ ID NO: 15120 - RNA, 3402 nt, synthetic construct
  misc_feature 1..3402: note = derived and/or modified CDS sequence (opt11) from SEOV(93HBQ4)__KM115586.1__GP
  source 1..3402: mol_type = other RNA
atgtggagcctgctcctgctggccgccttagtgggccaggggttcgccctgaagaacgtcttcgacatgcgcatccagtgcccccacagcgtgaacttcggcgagaccagcgtgtccgggtacaccgagctgccacccctcagcttgcaggaggccgagcagttggtccccgagtccagctgcaacatggacaaccaccagtccttaagcaccatcaacaagctgaccaaggtgatctggcgtaagaaggccaaccaggagtccgccaaccagaacagctttgaggtggctgagtccgaggtctcgttcaagggcctgtgcatgctcaagcaccgcatggtagaggaatcctaccggaaccgccggagcgtgatctgctacgacctggcgtgcaactccaccttctgcaaacccacggtctacatgatcgtgccgatacacgcctgcaacatgatgaagtcctgcctgatcggtctcggcccctaccgtatccaggtggtctacgagcggacgtactgcaccaccggcatcctgaccgaggggaagtgcttcgtacccgacaaggccgtggtgtccgccttaaagcgcggaatgtatgcgatcgccagcatcgagacgatctgcttcttcattcaccagaaggggaacacctacaagatcgtgaccgccatcacctccgccatgggcagcaagtgcaacaacacggataccaaggtgcagggctactacatatgcatcatcggcggcaacagcgcccccgtctacgcgccgtccggggaggacttccgggccatggaggtcttcagcggcatcatcatgagcccccacggggaggaccacgacttacccggcgaagagatcgccacctatcagatcagcggccagatcgaggccaagatcccccacaccgtgtccagcaagaacctgaagctgacggccttcgccgggatcccgtcctacagctccaccagtatcctcgccgcctccggcgacagcagattcatcttctcccccggtctgttccctaacctgaaccaaagcgtatgcgataacaacgccctccccctgatctggcggggcctgatcgacctcaccgggtactacgaggccgtgcacccatgcaacgtgttctgcgtgctgtccggccccggcgcgagctgcgaggccttctccgaaggcgggatcttcaacatcaccagccccatgtgcctggtgtccaagcaaaaccgcttcagagccgccgagcagcagatcagcttcgtctgccagcgcgtggacatggacatcatcgtgtactgcaacgggcagaagaagacgatcctcaccaagaccctggttatcggccagtgtatctacaccatcacgtcacttttcagtctcctgcccggggtggcccacagcatcgcgatcgagttatgcgttccgggcttccacggctgggccactgccgccctcctgatcaccttctgcttcgggtgggtcttgatccccgcgtgcaccctcgccatcctgctggtgctcaagttcttcgccaacattctgcacacgtccaatcaggagaaccggttcaaggccatcctgcgcaaaatcaaggaggagttcgaaaagaccaagggcagcatggtgtgcgaaatctgcaaatacgagtgcgagacccttaaggagctgaaggcccacaacctttcctgcgtccagggggagtgcccctactgcttcacccactgcgagcccaccgaaaccgcgattcaggcacactacaaggtgtgccaggccacccaccggttccgcgaggacctcaagaagaccgtgacgccgcagaatatcggccccgggtgctaccggaccctgaacctgttccgctacaagagccggtgctacatcttgaccatgtggaccctcctgctgatcatcgagtccatcctctgggccgccagcgcggcagagatccccctggtccccctgtggaccgacaacgcccacggcgttggttccgttccgatgcacacggacctcgagctcgacttcagcctgccctccagctccaagtacacctacaagcgccatctcaccaaccccgtgaacgaccagcagagcgtgtctctgcacatcgagattgagagccagggcatcggcgccgacgtgcaccatctgggacactggtatgacgcccgcctcaacctgaagaccagcttccactgctacggcgcgtgtacgaagtaccagtacccctggcacaccgccaagtgccacttcgagaaggactacgagtacgaaaacagctgggcctgtaacccgcccgactgccccggcgtcgggaccggctgcaccgcctgcgggctgtacctcgaccagctgaagcccgtgggcacggcgttcaagatcatcagcgtacggtactcccgcaaggtctgcgtgcaatttggggaggagtacctgtgcaagaccatcgacatgaacgactgcttcgtgacccggcacgctaagatctgcatcatcggaactgtgagcaagttctcccagggcgacacgctgctgttcctgggacccatggagggcggcggcatcatcttcaagcactggtgcacctcgacgtgtcacttcggggaccccggcgacgtgatgggccccaaggacaagccgttcatctgcccagagttccccgggcaattccgcaagaagtgcaacttcgccactacccccgtatgcgagtacgacggaaacatcatctccgggtacaagaaggtcctcgctaccatcgacagctttcagtccttcaacacaagcaacatacacttcaccgacgagacgatcgagtggcgggacccggacggcatgctgcgtgaccacatcaatatcgtaatctccaaggacatcgacttcgaaaacctggccgagaacccctgcaaggtggggctccaggcggccaacatagagggcgcctggggcagcggggtcggcttcaccctgacctgccaggtgtccctcaccgagtgccccacatttttaaccagcatcaaggcctgcgacatggccatctgctacggggcggagtccgtgaccctgagccggggccagaacactgtcaagataactgggaagggcggccactccgggagctccttcaagtgttgccacggcaaggaatgcagctctaccgggctgcaggcctcagcgccccacctagacaaggtgaacgggatatccgagctggagaacgagcgcgtgtacgacgacggcgccccggagtgcgggatcacgtgctggttcaagaagtccggtgagtgggtcatggggatcatcaacggcaactgggtggtgctgatagtcctctgcgtgctgctcctgttcagcctaatcctgctctccatcctctgccccgtgcggaaacacaagaagtcctga

SEQ ID NO: 15121 - RNA, 3402 nt, synthetic construct; identical to SEQ ID NO: 11835
  misc_feature 1..3402: note = derived and/or modified CDS sequence (opt11) from SEOV(B1)__AB457790.1__GP
  source 1..3402: mol_type = other RNA

SEQ ID NO: 15122 - RNA, 3402 nt, synthetic construct; identical to SEQ ID NO: 11836
  misc_feature 1..3402: note = derived and/or modified CDS sequence (opt11) from SEOV(B1)__AB457791.1__GP
  source 1..3402: mol_type = other RNA

SEQ ID NO: 15123 - RNA, 3402 nt, synthetic construct; identical to SEQ ID NO: 11837
  misc_feature 1..3402: note = derived and/or modified CDS sequence (opt11) from SEOV(B1)__AB457792.1__GP
  source 1..3402: mol_type = other RNA

SEQ ID NO: 15124 - RNA, 3402 nt, synthetic construct
  misc_feature 1..3402: note = derived and/or modified CDS sequence (opt11) from SEOV(B1)__AB457793.1__GP
  source 1..3402: mol_type = other RNA
atgtggagcctactcctgctcgccgcgctcgtcggccaggggttcgcgctgaagaacgtcttcgacatgcgcatccagtgcccccacagcgtgaacttcggcgagaccagcgtctccgggtacaccgagctgccgcccctcagcctgcaagaggccgagcagctcgtccccgagtccagctgcaacatggataaccaccaatccctcagcacgatcaacaagctgaccaaagtcatctggcagaagaaagccaaccaggagtccgccaaccagaacagcttcgaggtggttgagtcagaggtgagcttcaaaggcttgtgcatgctcaagcaccggatggtggaggagtcctaccgcaatcggcgcagcgtgatatgctacgaccttgcctgcaactccaccttctgcaagccaaccgtgtacatgatagtgccgatccacgcgtgcaacatgatgaaatcctgtctgatcgggctcggcccatatcggatccaagtggcttacgagcgcacgtactgcaccaccgggatcctgaccgaggggaaatgcttcgtgcccgacaaggccgtggtctctgcccttaagcggggcatgtacgcgatagccagcatcgaaacgatctgtttcttcatccatcaaaaggggaacacctacaagatcgtgaccgccatcacctccgccatgggcagcaagtgcaacaacaccgacaccaaggtgcaggggtactacatctgcatcatcggcggcaacagcgcccccgtctacgcgccggccggagaggatttccgcgccatggaggtgttctccggtatcatcaccagcccccacggtgaggatcacgacctccccggcgaggagattgcaacctaccagatcagtggccagatagaagccaagattccccacacggtgagctccaagaacctccggctgaccgcgttcgccggaatcccgagctactcctccacctccatcctcgccgccagcaaggatggccatttcatattctcccccgggctgttccctaatctgaaccagtcagtctgcgacaacaacgccctccccttaatctggcgcggcctgatcgacctcaccgggtattacgaggcggtgcacccctgcaacgtgttctgcgtcttatccggcccgggcgcaagctgcgaggccttctccgagggcgggattttcaacatcacgtctcccatgtgcctggtctccaagcagaatcggtttcgcgccgccgagcagcagatctcgttcgtctgccagcgggtcgacatggacatcatagtgtactgcaacgggcagaagaagaccattctcactaagaccttagtcatcggccagtgcatctatacgattacatccctgttctcactcctgcccggggtggcgcacagcatagccatcgaactgtgtgtgccgggcttccatgggtgggcgaccgccgcgctcctgatcaccttctgcttcgggtggatcctgatccccgcgtgcacgctcgcaatcctattagtcctcaagttcttcgcgaacatcttgcacacctccaaccaggagaacagattcaaggccatcctgcggaagatcaaagaggagttcgaaaagacaaaaggcagcatggtgtgcgagatctgcaaatacgagtgcgagaccttaaaggagctgaaggcgcacaatttatcctgcgtgcagggggagtgcccctactgcttcacgcactgcgaacccaccgagaccgccatccaggcccactacaagatctgccaggccacccaccgcttccgggaggacctcaagaagacggtcactccgcagaacatcggcccggggtgctatcgcaccctgaacttgttccgttacaagtcgcgctgctatatcctgaccatgtggaccctcctgttgatcatcgagtcgatcctttgggccgcaagcgccgccgagatccccctggtgcccctgtggacagacaacgcccacggcgtgggctccgtgccgatgcataccgacctcgagctggacttcagcctgccgagtagcagtaagtacacctacaagcggcacctcaccaaccccgtgaacgatcagcagagcgtgtccctgcacatcgagatcgagagccaggggatcggcgctgacgtccaccacctggggcactggtacgacgcgcgcctcaatctgaaaacgtccttccactgctacggcgcctgcaccaagtaccagtacccgtggcacaccgccaagtgtcacttcgagaaggactacgaatacgaaaattcctgggcctgcaacccgcccgactgccccggcgtggggaccggctgcacagcatgcggcctgtacctcgatcagctgaaacccgtgggcaccgccttcaaaatcatctctgtccgctatagccgaaaggtgtgtgtgcagttcggggaggaatacctgtgcaagaccatcgacatgaacgactgcttcgtcacccgccacgccaaaatttgtatcatcgggaccgttagcaagttctcccagggcgacaccctcctgtttctggggcccatggagggcggcggcatcatcttcaagcactggtgcacctccacgtgccactttggtgacccgggcgacgtgatgggccccaaggacaagccgttcatctgccccgagttccccgggcagttccggaagaagtgcaacttcgccaccacccccgtctgtgagtacgacggtaacatcatctccggatacaagaaggtgttggccaccatcgactcgttccagtccttcaacaccagcaacatccacttcacggatgagcgcatcgagtggcgggacccggacggcatgctgcgcgaccatatcaacatcgttatctcgaaggacatcgacttcgaaaacctcgcggagaacccctgcaaggtcgggttacaggccgccaacatagagggcgcctgggggagcggggtgggctttaccctgacctgccaggtgtccctaaccgaatgtcccactttcctcacgagcatcaaggcgtgcgacatggcgatctgctacggggccgagtccgtcaccctgtcgagaggacagaacacagtgaagattacggggaagggcggccactccgggagctcattcaagtgttgccacggcaaggagtgcagctccaccgggcttcaggcctcagcgccccatctcgacaaggtgaacggcatctccgagctggagaacgagaaggtctacgacgacggcgccccggagtgtggtgtgacctgctggttcaagaagtccggagagtgggtgatggggatcatcaacgggaactgggtcgtgctgatcgtgctctgcctgctgctcctattctccctgatcctcctgagcatcctgtgccctatccgcaagcacaagaagtcctga

SEQ ID NO: 15125 - RNA, 3402 nt, synthetic construct
  misc_feature 1..3402: note = derived and/or modified CDS sequence (opt11) from SEOV(B1)__AB457794.1__GP
  source 1..3402: mol_type = other RNA
atgtggagcctgctcctgatggccgccctggtgggccaggggttcgccctcaagaacgtcttcgacatgcgcatccagtgcccccacagcgtgaacttcggcgagaccagcgtgtccgggtacaccgagctgccgcccctgagcctccaggaggctgagcagctagtgcccgagtccagctgcaacatggataaccaccagtccctgagcacaatcaacaagctcaccaaggtgatctggcaaaagaaggccaaccaggagtccgccaaccagaacagcttcgaggtggtcgagtccgaggtgagcttcaagggcctgtgcatgctgaagcacagaatggtggaggagtcctaccgcaaccgacgcagcgtcatctgctacgacctcgcctgcaactccaccttctgcaagcccaccgtgtacatgatcgtcccgatccacgcgtgcaacatgatgaaatcctgcctgatcgggctgggcccctaccggatccaggtcgcctacgagcgcacgtactgcaccaccgggatcctcaccgaggggaagtgcttcgtgcccgacaaggccgtggtctcggccctgaagcggggcatgtacgcgatcgccagcatcgagacgatctgcttcttcatccaccagaaggggaatacctacaagatcgtgaccgccatcacctccgccatgggcagcaagtgcaacaacacggacaccaaggtgcaggggtactacatctgcatcatcggcggcaacagcgcccccgtctacgcgccggccggggaggacttccgcgccatggaggtgttctccggcatcataaccagcccccacggggaggaccacgacctgcccggcgaggagatcgccacctaccagatctccggccagatcgaggccaagatcccccacacggtcagctccaagaacctccggctgaccgcgttcgccgggatccctagctactccagcaccagcatcctggccgccagcaaggacggccacttcatcttctcccccgggctgttccccaacctgaaccagagcgtatgcgacaacaacgccctgcccctcatctggcgcggcctgatcgacctgaccgggtactacgaggcggtgcacccgtgcaacgtgttctgcgtcctctccggcccaggcgccagctgcgaggccttctccgagggcggaatcttcaacatcacgagccccatgtgcctggtgtccaagcagaatcggttccgcgccgccgagcagcagatcagcttcgtctgccagcgggtggacatggacatcatcgtgtactgcaacgggcagaagaagaccatcctgaccaagaccctcgtcatcggccagtgcatctacacgatcacctccctgttcagcctgctccccggggtggcgcacagcatcgccatcgagctatgcgtgccgggcttccacggctgggccaccgccgcactgctcatcaccttctgcttcgggtggatcctgatccccgcctgcacgctggccatcttactggtcctcaagttcttcgccaacatcctccacacctccaaccaggagaaccgcttcaaggccatcctgcggaagatcaaggaggagttcgagaagaccaagggcagcatggtgtgcgagatctgcaagtacgagtgcgagaccctgaaggagctcaaggcgcacaacctgtcctgcgtgcagggggagtgcccctactgcttcacgcactgcgagccgaccgagacggccatccaggcccactacaagatctgccaggccacccaccgctttcgggaggacctgaagaagacggtcaccccgcagaacatcggccccgggtgctaccgcaccctcaacctgttccggtacaagagccgctgctacatcctgaccatgtggaccctactcctgatcatcgagtccatcctgtgggccgcgagcgccgccgagatccccctcgtgcccctgtggacggacaacgctcacggcgtagggtccgtcccgatgcacaccgacctggagctcgacttcagcctgccctccagctccaagtacacctacaagcggcacctaaccaaccccgtgaacgaccagcagagcgtgtccctccacatcgagatcgagagccaggggatcggcgctgacgtccaccacctggggcactggtatgacgctcggctcaacctcaagacgtccttccactgctacggcgcctgcacaaagtaccagtacccgtggcacaccgccaagtgccacttcgagaaggactacgagtacgagaacagctgggcctgcaacccgcccgactgccccggcgtggggaccggctgcacggcgtgcgggctgtacctggatcagctcaagcccgtgggcaccgccttcaagataatctccgtccgctacagccggaaggtgtgcgtgcagttcggggaggagtacctgtgcaagaccatcgacatgaacgactgcttcgtcactcgccatgccaagatttgcatcatcggcacggtgagcaaattctcccagggcgacaccctcctcttcctggggcccatggagggcgggggcataatcttcaagcactggtgcaccagcacgtgccacttcggggaccccggcgacgtgatgggccccaaggacaagccgttcatctgccccgagttccccgggcagttccggaagaagtgcaacttcgctaccacccccgtctgcgagtacgacggcaacatcatctccgggtacaagaaggtgctagccacgatcgacagcttccagtccttcaataccagcaacatccacttcacggacgagcgcatcgagtggcgggacccggacggcatgctccgcgaccacatcaacatcgtgatctccaaggacatcgacttcgagaaccttgcggagaacccctgcaaggtcggtctgcaggccgccaacatcgagggcgcctggggcagcggggtgggcttcaccctgacctgccaggtgtccctgacggagtgccccacgttcctgaccagcatcaaggcctgcgacatggcgatctgctatggggccgagtctgtcaccctcagccggggccagaacaccgtgaagatcacggggaagggcggccactccgggagctccttcaagtgctgccacggcaaggagtgcagctccaccgggctgcaggccagcgcgccccacctggacaaggtgaacggcatctccgagctggagaacgagaaggtatacgacgacggcgccccggagtgcggggtgacctgctggttcaagaagtccggcgagtgggtgatgggcatcatcaacggcaactgggtcgtgctgatcgtgctgtgcttgctgctcctcttcagcctgatcctgctcagcatcctgtgccccatccgcaagcacaagaagtcctga

SEQ ID NO: 15126 - RNA, 3402 nt, synthetic construct; identical to SEQ ID NO: 11840
  misc_feature 1..3402: note = derived and/or modified CDS sequence (opt11) from SEOV(B-1)__X53861.1__GP
  source 1..3402: mol_type = other RNA

SEQ ID NO: 15127 - RNA, 3402 nt, synthetic construct; identical to SEQ ID NO: 11841
  misc_feature 1..3402: note = derived and/or modified CDS sequence (opt11) from SEOV(BjHD01)__DQ133505.1__GP
  source 1..3402: mol_type = other RNA

SEQ ID NO: 15128 - RNA, 3402 nt, synthetic construct
  misc_feature 1..3402: note = derived and/or modified CDS sequence (opt11) from SEOV(Cherwell)__KM948593.1__GP
  source 1..3402: mol_type = other RNA
atgtggagcctgctcttgctggccgccctcgtgggccaggggagtgcgttgaagaacgtctttgacatgcgcatccagtgcccccacagcgtgaactttggcgagacctccgtgagcgggtacaccgaactgccacccttgtccctgcaggaggccgagcagctggtccccgagagctcctgcaatatggacaaccaccagagcctctccaccatcaacaagctgactaaggtgatctggcggaagaaggccaaccaagagagcgccaaccagaactcctttgaggtggtcgagagcgaggtgtccttcaagggcctgtgcatgctcaagcaccgcatggtggaggagagctaccggaaccgccggtccgtcatctgctacgacctggcttgcaacagcaccttctgcaagcctaccgtgtacatgatcgttccgatccacgcgtgcaacatgatgaaatcctgcctgatcggtctcggcccctaccgcatccaggtcgtgtatgagcggacgtactgtaccaccggcatcctgaccgaggggaagtgcttcgtgcccgacaaggccgtcgtgagcgccctgaaaaggggcatgtacgccatcgcgtccatcgagacgatctgctttttcatccaccagaaggggaacacctacaagatcgtgaccgcaatcacctcagccatgggcagcaagtgcaacaatacggacaccaaggtccaggggtactacatctgcatcatcggcggcaactccgcccccgtgtacgccccggcgggggaggactttcgggccatggaggtgttcagcggcatcatcaccagcccccacggggaggatcacgacctccccggggaggagatcgccacctaccagataagcggccagatcgaggccaagatcccccacacggtctcgagcaagaacctgaagctgaccgcgttcgcgggtatcccgtcctatagctccacctcgatcctggccgcctccgaggacggccgcttcatcttcagccccggactgttccccaacctgaaccagtccgtgtgcgacaacaatgccctccccctgatatggcggggactgatcgacctcaccgggtactacgaggccgtgcacccgtgcaacgtgttctgcgttctgagcggccccggcgcgtcctgcgaggccttcagcgagggcgggatcttcaacatcacgtcccccatgtgcttggtcagcaagcagaaccgcttccgggccgccgagcaacagatctccttcgtgtgccagcgcgtggacatggacatcatcgtctactgtaacgggcagaagaagaccatcctcaccaagaccctggttatcggccaatgcatctacacgattaccagcttattcagcctcctgcccggggtggcccactccatcgcaatcgagctgtgcgtcccgggcttccatggctgggccaccgccgccctcctcatcaccttctgcttcgggtgggtgctgatccccgcgtgcacgctcgccatcttgctggtactcaagttcttcgcaaacatcctgcacaccagcaatcaggagaaccgcttcaaggccatcctgcgcaagatcaaagaggagttcgagaagactaaaggctccatggtctgcgagatctgcaaatacgaatgcgagaccctcaaggagctgaaggcccacaacctgagctgtgtgcagggggagtgcccctactgcttcacccactgcgagcccaccgagaccgcgatccaggcccactacaaggtgtgccaggctacccaccggttccgggaggacctcaagaaaacagtcaccccgccaaatatcggccccggttgctaccggaccctgaacctgttccgctacaagtcccgctgctacatcctgaccatgtggaccctactgcttatcatcgagagcatcctctgggccgcctccgcggccgagatcccattggtgccgctgtggactgacaacgcccacggcgtgggcagcgtccccatgcacaccgacctcgagcttgacttctcactgcccagctccagcaagtacacctacaagcgccacctcaccaacccggtgaacgaccagcaatccgtgagcctgcacatcgagatcgagtcccaggggatcggggccgacgtgcatcacttagggcactggtacgacgcccgcctcaacctgaagacgagcttccactgctacggcgcgtgcaccaagtaccagtacccctggcataccgccaagtgccacttcgagaaggactacgaatacgagaacagctgggcctgcaacccacccgactgtccaggcgtggggaccggctgcacggcctgcggggtatatctggaccagctaaagcccgtaggcaccgcgttcaagatcgttagcgtgcggtacagccgcaaggtctgcgtgcagttcggggaggagtacctgtgcaagaccatcgacatgaacgactgcttcgtgacccggcacgctaagatctgcataatcggcacggtctccaagtttagccagggcgacaccctcctgttcctggggcccatggagggcgggggcatcatcttcaaacactggtgcaccagcacgtgccacttcggggaccccggcgacgtgatgggcccaaaggacaagcccttcatctgccccgagtttcccgggcagttcaggaagaagtgcaacttcgccaccaccccggtatgcgagtacgacggaaacatcatcagcggctacaagaaggtcctggccaccatcgactccttccagagcttcaacacttccaacatccacttcacggacgagcgaatcgagtggcgcgaccccgacggcatgctccgggaccacatcaacattgtgatcagcaaggacatagacttcgagaacctggccgagaacccctgcaaggtggggctgcaggcggccaacattgagggcgcctggggctccggggtcggcttcaccctgacctgccaggttagcctgaccgagtgccccacgttcctgacctccatcaaggcctgcgacatggccatatgctacggggcggaaagcgtgaccctctcccgcggccagaacaccgtcaagatcacggggaagggcggccacagcgggtccagcttcaagtgttgccacggcaaggagtgctccagcaccgggctgcaggcctccgccccgcacctggacaaggtgaacggcatcagcgagctcgagaacgagaaggtatacgacgacggcgcccccgagtgcggggtgacctgctggttcaaaaagagctccgagtgggtcatgggcatcattaacgggaactgggtggtcctgatcgtgttatgtgtgctcctgctgttcagcctcatactgctgtcaatcctctgccccgtccggaagcacaagaagtcctga

SEQ ID NO: 15129 - RNA, 3402 nt, synthetic construct
  misc_feature 1..3402: note = derived and/or modified CDS sequence (opt11) from SEOV(HaixingRn40)__GU592924.1__GP
  source 1..3402: mol_type = other RNA
atgtggagcctcctcttcctggccgccctggtgggccaagggttcgccctcaagaacgtcttcgacatgcgcatccagtgcccccactcagtgaacttcggcgagaccagcgtgtccgggtacaccgagctgccgcctctatccctccaggaggccgagcaactggtccccgagtccagctgcaacatggacaaccaccaatccctgagcacgatcaacaagctcaccaaggtgatctggcggaagaaggccaaccaggagtccgccaaccagaacagcttcgaagtggtcgagtccgaggtgagcttcaagggcctgtgcatgcttaagcaccgcatggtggaggagtcctaccggaaccgccggagcgtcatctgctacgacctcgcctgcaactccaccttctgcaagcccaccgtgtacatgatcgtgccgatccacgcgtgcaatatgatgaagtcctgcctgatcgggctgggcccctaccgcatccaggtcgtgtacgagcggacgtattgcaccaccggcatcctcaccgaggggaagtgcttcgtgcccgacaaggccgtagtgagcgccctgaagcgcggcatgtacgccatagcgagcatcgagacgatctgcttcttcatccaccagaaggggaacacctacaagatcgtgaccgccatcacctccgccatgggcagcaagtgcaacaacacggacaccaaggtccaggggtactatatctgcatcatcggcggcaactctgcccccgtgtacgccccggcgggggaagacttccgggcgatggaggtgttctccggcatcatcaccagcccccacggggaggaccacgatctgcccggcgaggagatcgccacctaccagatctccggccagatcgaggcaaagatcccccacacggtcagctccaaaaacctcaagctgaccgccttcgcggggatcccgagctatagcagcacctcaatcctggccgccagcgaggacggccgcttcatcttctcccccgggctgttccccaacctgaaccagagcgtgtgcgacaacaacgccctgcccctcatctggcggggcctgatcgacctgaccgggtactacgaggccgtgcacccgtgcaacgtcttctgcgtgctctccggccccggggcgagctgcgaggccttctccgagggcgggatcttcaacatcacgagccccatgtgcctggtctccaagcaaaaccgcttccgggccgccgagcagcagatcagcttcgtgtgccagcgcgtggacatggacatcatagtctactgcaacgggcagaagaagaccatcctgacccggaccctcgtgatcggccagtgcatctacacgatcacctccctgttcagcctgctccccggggtggcacacagcatcgcgatcgagctgtgcgtcccgggcttccacggctgggccaccgccgcgctgctcatcaccttctgcttcgggtgggtgctgatccccgcgtgcacgctggccatcctcctggtgctgaagttcttcgccaacatcctccacacctccaatcaggagaaccgcttcaaggccatcctgcggaagatcaaggaggagttcgagaagaccaagggcagcatggtctgcgagatctgcaagtacgagtgcgagaccctgaaggagctcaaggcccacaacctgtcttgcgtgcagggggagtgcccctactgcttcacgcactgcgagcccaccgagaccgcgatccaggcccactacaaggtgtgccaggccacccaccgcttccgggaggacctgaagaagacggtcacccctcagaacatcggccccgggtgctaccgtaccctcaacctgttccggtacaagtcacgttgctacatcctgaccatgtggaccctgctcctgatcattgaatccatcctgtgggccgccagcgcggccgagatccccctcgtgcccttgtggacggacaacgcccacggcgtgggctccgtccccatgcacaccgacctggagctcgacttcagcttgccctccagctccaagtacacctacaagcgccacctgaccaaccccgtgaacgaccagcagagcgtgtccctccacattgagatcgagagccaggggatcggcgccgacgtccaccacctggggcactggtacgacgcccggctgaacctcaagacgtccttccactgctacggcgcgtgcaccaagtatcagtacccgtggcacaccgccaagtgccacttcgagaaggactacgaatacgagaacagctgggcctgcaacccgcccgactgccccggcgtggggaccggatgcacggcctgcgggttatacctggaccagctcaagcccgtgggcaccgcgttcaagatcatctccgtccgctatagccggaaggtgtgcgtgcagttcggggaggagtacctgtgcaagaccatcgacatgaacgactgcttcgtcacccgccacgccaaaatctgcatcatcggcacggtgagcaagttctcccagggcgacaccctcctcttcctgggccccatggagggcgggggcatcatcttcaagcactggtgcaccagcacgtgccacttcggggaccccggcgacgtgatgggacccaaggacaagccgttcatctgccccgagttccccgggcagttccggaagaagtgcaacttcgccaccacccccgtctgcgaatacgacggcaacatcatctccgggtacaagaaggtgctggccaccatcgacagcttccagtccttcaacaccagcaacatccacttcacggacgagcgcatcgagtggcgggacccggacggcatgctccgcgaccacatcaacatcgtgatctccaaagacatcgacttcgagaacctggggcagaacccctgcaaggtcggcctgcaggccgcgaacatcgagggcgcctgggggtcaggcgtggggttcaccctgacatgccaggtgtccctgaccgagtgccccacgttcctgaccagcatcaaggcctgcgacatggccatctgctacggtgccgagtccgtcaccttaagccgcgggcagaataccgtgaagatcacgggcaagggcgggcactccggcagctcctttaaatgctgccacgggaaggagtgcagctccaccggcctgcaggcgagcgcgccccacctggacaaggtgaacggcatctccgacctagagaacgagaaggtctacgacgacggggccccggagtgcggcgtgacctgctggttcaagaagtccggggagtgggtgatgggcatcatcaacgggaactgggtcgtgttgatcgtgctgtgcgtcctcctgctgttcagcctcatcctgctgtcgatcctctgccccgtgcgcaagcacaagaagtcctga

SEQ ID NO: 15130 - RNA, 3402 nt, synthetic construct; identical to SEQ ID NO: 11844
  misc_feature 1..3402: note = derived and/or modified CDS sequence (opt11) from SEOV(HBQ17)__KM233655.1__GP
  source 1..3402: mol_type = other RNA

SEQ ID NO: 15131 - RNA, 3402 nt, synthetic construct; identical to SEQ ID NO: 11845
  misc_feature 1..3402: note = derived and/or modified CDS sequence (opt11) from SEOV(HBQ20)__KM233656.1__GP
  source 1..3402: mol_type = other RNA

SEQ ID NO: 15132 - RNA, 3402 nt, synthetic construct; identical to SEQ ID NO: 11846
  misc_feature 1..3402: note = derived and/or modified CDS sequence (opt11) from SEOV(HBQ43)__KM233657.1__GP
  source 1..3402: mol_type = other RNA

SEQ ID NO: 15133 - RNA, 3402 nt, synthetic construct
  misc_feature 1..3402: note = derived and/or modified CDS sequence (opt11) from SEOV(HBQ5)__KM233653.1__GP
  source 1..3402: mol_type = other RNA
atgtggagcctcctcttcctcgccgccctggtgggccaggggttcgccctcaagaacgtctttgacatgcgcatccaatgcccccacagcgtcaacttcggagagactagcgtgtccgggtacaccgagctgccgcccctgagcctccaggaggccgagcagctggtcccggagtcctcctgcaacatggacaaccaccagtccctgagcacgataaacaagctcaccaaggttatctggcgtaagaaagccaaccaggagtccgccaaccagaacagctttgaggtggtcgagtccgaggttagcttcaagggcctgtgcatgctgaaacaccgcatggtggaggagtcctacagaaaccgccggagcgtcatctgctacgacctcgcctgcaactccaccttctgtaagcccaccgtgtacatgatcgtcccgatccacgcgtgcaacatgatgaagtcctgcctgatcgggctgggtccctaccgcatccaggtcgtgtacgagcggacgtactgcaccaccggcatcctcacggaggggaagtgcttcgtgcctgacaaggccgttgtgagcgccctgaagcgcggcatgtacgccatcgcgagcatcgagacgatctgctttttcatccaccagaagggtaacacctacaagatcgtgaccgccatcacctccgccatgggcagcaagtgcaacaacacggacaccaaggtccaggggtactacatctgcatcataggcggcaacagcgcccccgtgtatgccccggcgggggaggacttccgggccatggaggtgttctccggcatcataactagcccccacggggaggaccacgatttacccggcgaggagatcgccacctatcagatctccggccagatcgaggcaaagatcccccacacggtcagctcgaagaacctcaagctgactgccttcgcggggatcccgagctactcctcgacgtccattctggccgccagcgaggacggtcgcttcatcttctccccggggctgttccccaacctgaaccagagcgtgtgcgacaataacgccctgcccctcatctggcgaggcctgatcgacctgacggggtactacgaggccgtgcacccgtgcaacgtcttctgcgtactctccggccccggcgcgagctgcgaggccttctccgagggcgggatcttcaacatcacgagtcccatgtgcctggtcagcaagcagaaccgctttcgggccgccgagcaacagatcagtttcgtgtgccaacgcgtggacatggacatcatcgtctactgcaacgggcagaagaagaccatcctgacaaagaccctcgttatcggccagtgcatctacacgatcacctccctgttctcactgctccccggggtggcccacagcatcgcgatcgagttatgcgtcccgggcttccacggctgggccaccgccgctctgctcatcaccttctgcttcggatgggtgctgatccccgcgtgcacgctggccatcctcctggtgctgaaattcttcgccaatatcctccacacctccaaccaggagaaccggttcaaggccatcctgcgcaagatcaaggaggagttcgagaagaccaagggcagcatggtatgcgagatctgcaagtacgagtgcgagaccctgaaagagctcaaggcccacaacttatcctgcgtgcagggggagtgcccctactgcttcacgcactgcgagcccaccgagaccgctatccaggcccactacaaagtatgccaggccacccaccggttccgcgaagacctgaagaagacggtcaccccgcagaatataggccccggttgctaccggaccctcaacctcttcagatacaagtcgcggtgttacattctgaccatgtggaccctgctcctgatcatcgagtccatcctgtgggccgccagcgcggccgagatccccctcgtgccgctgtggacggacaacgcccacggcgtgggctccgtcccgatgcacaccgacctggagctcgacttctcactgccgtcctcctccaagtacacgtacaagcgccacctgaccaatcccgtgaacgaccagcagagcgtctctctccacatcgagatcgaaagccaggggatcggcgctgacgtccaccatctggggcactggtacgacgcccgcctgaacctcaagacgtccttccactgctacggcgcgtgcaccaagtaccagtacccgtggcacactgccaagtgccatttcgagaaggactacgagtacgagaacagctgggcctgcaacccgcccgactgcccaggcgtggggaccggctgtacggcctgcgggctgtacctggaccagctcaagcccgtgggaacagcgttcaagatcatctccgtccgatactcccgcaaggtgtgtgtgcagttcggggaggagtacctgtgcaagactattgacatgaacgactgcttcgtcacccggcacgccaagatctgcatcatcggcacggtcagtaagttctcccaaggcgacaccctcctcttcctggggcccatggagggcgggggcataatctttaagcactggtgcaccagcacgtgccacttcggggaccccggcgatgtgatgggccccaaggacaagccgttcatatgccccgagttccctgggcagttccgcaagaagtgcaacttcgccaccacccccgtctgtgagtacgacggcaacatcatctccgggtacaagaaggtgctggccacgatcgacagcttccagtcctttaacaccagcaacatccacttcacggacgaacgtatcgagtggcgcgacccggacggcatgctccgggatcacattaacatcgtgatctccaaggacatagacttcgagaatttggccgagaacccctgcaaggtcgggctgcaagcggccaacatcgagggcgcctggggcagtggggtgggcttcaccctgacgtgccaggtgagcctgaccgagtgccccacgttcctgaccagcatcaaggcctgcgacatggccatctgctacggtgcggaatccgtcaccctgagccgcggccagaacaccgtgaagatcacggggaagggtggccactccgggagctcctttaagtgctgccacggcaaagagtgtagctccaccgggctgcaagccagcgcgccccacctggacaaggtgaacggcatctccgagctcgagaacgagaaggtctacgacgacggcgccccggagtgcggggtgacctgctggttcaagaagtctggcgagtgggtgatggggattatcaacggcaactgggtcgtgctgattgtcctctgcgtcctcctgctgttcagcctcatcctgttgagcatcctctgcccagtgcgtaagcacaagaaaagctag

SEQ ID NO: 15134 - RNA, 3402 nt, synthetic construct; identical to SEQ ID NO: 11848
  misc_feature 1..3402: note = derived and/or modified CDS sequence (opt11) from SEOV(HBT14)__KM233658.1__GP
  source 1..3402: mol_type = other RNA

SEQ ID NO: 15135 - RNA, 3402 nt, synthetic construct
  misc_feature 1..3402: note = derived and/or modified CDS sequence (opt11) from SEOV(HBT-3)__KM233661.1__GP
  source 1..3402: mol_type = other RNA
atgtggagcctcctcttcctggccgccctggtgggccaggggttcgcgctcaagaacgtcttcgacatgcgcatccagtgcccccacagcgtgaacttcggcgagaccagcgtgtccgggtacaccgagctgcctcccctgagcctgcaggaggccgagcagctggtccccgagtccagctgtaacatggacaaccaccaaagcctgagcacgatcaacaagctcaccaaggtcatctggcggaagaaggcgaaccaagagtccgccaaccaaaacagcttcgaggtggtcgagtctgaggtgagcttcaagggcctgtgcatgctgaagcaccgcatggtggaggagtcataccggaaccgccggtccgtcatatgctacgacctcccctgcaactccaccttctgcaagccgaccgtgtacatgatcgtgcccatccacgcctgcaacatgatgaagtcctgcctgatagggctgggcccctaccgcatccaggtcgtgtacgagcggacgtactgcaccaccggcatcctcaccgaggggaagtgcttcgtgcccgacaaggcggtcgtgagcgccctgaagcgcggcatgtacgccatcgccagcatcgagacgatctgcttcttcatccaccagaaggggaatacctacaagatcgtgaccgcgatcacctccgccatgggcagcaagtgcaacaacacggacaccaaggtccaggggtactacatctgcatcatcggcggcaacagcgccccggtgtacgcccccgccggggaggacttccgggcgatggaggtgttttccggcatcatcaccagcccccacggggaggaccacgacctgcccggcgaggagatcgccacctaccagatctccggccagatcgaggccaagatcccacacacggtcagctccaagaacctcaagctgaccgccttcgccgggatccccagctactccagcacctccatcctggcagccagcgaggacggccgcttcatcttctcccccgggctgtttcccaacctgaaccagagcgtgtgcgacaacaacgccctgccgctcatctggcggggcctgatcgacctgacggggtactacgaggccgtgcacccatgcaacgtcttctgcgtgctctccggccccggcgcaagctgcgaggcgttctccgagggcgggatcttcaacatcacgagccccatgtgcttggtctccaagcagaacaggttccgggccgccgagcagcagatcagcttcgtgtgccagcgcgtggacatggacatcatcgtctactgcaacgggcagaagaagaccatcctgaccaagaccctcgtgatcggccagtgcatctacacgatcacctccctgttcagcctactcccgggggtggcccacagcatcgccatcgagctgtgcgtccccggtttccacggctgggcgaccgccgccctgcttatcaccttctgcttcgggtgggtgctgatccccgcctgcacgctggcgatcctcctggtgctgaagttcttcgccaacatcctccacaccagcaaccaggagaaccggttcaaggccatcctgcgcaagatcaaggaggaatttgagaagaccaagggtagcatggtctgtgagatatgcaagtacgagtgcgaaaccttcaaggagctgaaggcccacaacctctcctgcgtgcagggggagtgcccctactgcttcacgcactgcgagccgaccgagaccgccatccaggcgcactacaaggtgtgccaggccacccaccggttccgcgaggacctgaaaaagacagtcacgccccagaacatcgggcccgggtgctaccggaccctgaacctcttccgctataagagccggtgctacatcctgaccatgtggaccctgctgctcatcatcgagtccatcctgtgggccgccagcgccgcggagatccccctggtgccgctctggaccgacaacgcccacggcgtcggctccgtccccatgcacaccgacctggagctggacttcagcctcccctccagctccaagtacacctacaagcgccacctgaccaacccggtgaacgaccagcagagcgtgtccctgcacatcgagatcgagagccaggggatcggcgccgacgtccaccatctcgggcattggtacgacgcccgcctcaaccttaagacgtccttccactgctacggcgcctgcaccaagtaccagtacccctggcacaccgcgaagtgccacttcgagaaggactatgagtacgagaacagctgggcctgcaacccgcccgactgccccggcgtggggaccggctgcacggcgtgcgggctctacctggaccagctgaagcccgtgggcaccgccttcaagatcatctccgtccggtacagccgcaaggtgtgtgttcagttcggggaggagtacctctgcaagaccatcgacatgaacgactgcttcgtcacccggcacgctaagatctgcatcatcggcacggtgagcaagttcagtcagggcgacaccctgctgttcctcgggcccatggagggcgggggcatcatcttcaagcactggtgcaccagcacgtgccacttcggggaccccggcgacgtgatgggcccgaaggacaagcccttcatctgcccggagttccccgggcagttccgcaagaagtgcaacttcgcgaccaccccggtctgcgagtacgacggcaacatcatttccgggtacaagaaggtgctggccaccatcgacagcttccagtccttcaacaccagcaacatccacttcacggacgagcggatcgagtggcgcgaccccgacggcatgctgcgggaccacatcaacatcgtgatctccaaggacatcgacttcgagaacctcgccgagaacccctgcaaggtcgggctgcaggccgcgaacatcgagggcgcctggggcagcggggtgggcttcaccctgacctgccaggtgtccctcaccgagtgccccacgttcctgaccagcatcaaggcctgcgacatggccatctgctacggggctgagagtgtcaccctgagccgcgggcagaacaccgtgaagatcacggggaagggcggccactccgggagctcattcaagtgctgccacggcaaggagtgcagctccaccgggctccaggcgagcgccccgcacctggataaggttaacggtatctccgagctggagaacgagaaggtctacgacgacggcgcccccgagtgcggggtgacctgctggtttaagaagtccggcgaatgggtgatggggatcatcaacggcaactgggtcgtgctcatcgtactgtgcgtcctgctcctgttcagcctgatcctcctgagcatcctctgccccgtgcggaagcacaaaaagtcctga

SEQ ID NO: 15136 - RNA, 3402 nt, synthetic construct
  misc_feature 1..3402: note = derived and/or modified CDS sequence (opt11) from SEOV(HBT49)__KM233659.1__GP
  source 1..3402: mol_type = other RNA
atgtggagccttctcttcctagccgccctggtgggccaggggtttgccctcaagaacgtctttgacatgcgcatccagtgcccccacagcgtgaacttcggcgagaccagcgtgtccgggtacaccgagttaccgcccctgagcctccaggaggccgagcagctggtccccgagtccagctgcaacatggacaaccaccagtccctgagcacgatcaacaagctcaccaaagttatctggcggaagaaggcaaatcaggagtccgccaaccagaacagcttcgaggtggtcgaatccgaggtatctttcaagggactgtgcatgctgaaacaccgcatggtggaggagtcctaccggaaccgccggagcgtcatctgctacgacctagcctgcaactccaccttctgcaagcccaccgtgtacatgatcgtgccgatccacgcgtgcaacatgatgaaatcctgcctgatcgggctgggcccctaccgcatccaggtcgtctacgagcggacgtactgcaccaccggcatactcactgaggggaagtgtttcgtgcccgacaaggccgtcgtgagcgccctgaaacgcggcatgtacgccatcgccagcattgaaacgatctgcttcttcatccaccagaaggggaacacgtacaaaattgtgaccgccatcacctccgccatgggcagcaagtgtaacaacacggacaccaaggtccaggggtattacatctgcataatcggcggcaacagcgcccccgtgtacgccccggcgggcgaggacttccgggccatggaggtgttttccggcatcatcacgtcgccccacggggaggaccatgacctgcccggcgaggagatcgccacctaccagatatcgggccagatcgaggccaagatcccacacacggtcagctccaagaacctcaagctgaccgcgttcgcggggatcccgagctactcaagcacctccatactggccgccagcgaggacggccgcttcatcttctcccccgggctgttccccaacctgaaccagagcgtgtgcgacaacaacgccctgcccctaatctggcggggcttgatcgacctcactgggtactacgaggccgtgcacccatgcaacgtcttctgcgtgctctccggcccgggagctagctgcgaggccttctccgagggcgggatcttcaacatcacgagccccatgtgccttgtttccaagcagaaccgcttccgggccgccgagcaacagatcagcttcgtgtgccagcgagtcgacatggacatcatcgtctactgcaacgggcagaagaagaccatcctgaccaagaccctcgtgatcggccagtgcatctacacgatcacttccctgtttagcctgctccccggggtggcccactcgatcgccatcgagctgtgcgtcccgggcttccacggctgggccactgccgccctgctcatcaccttctgcttcggttgggtgctgatccccgcgtgcacgctggccatattgctggtgctgaagttcttcgccaacatcctccacacctccaaccaggagaaccggttcaaggccatcctgcgcaagatcaaggaggagttcgagaaaaccaagggcagcatggtctgcgagatctgcaagtacgagtgcgagaccctcaaggagctcaaggcccacaacttatcctgcgtgcagggtgagtgcccctattgcttcacgcactgcgagccgaccgagaccgcgatccaggcccactacaaggtgtgtcaggccacccatcggttccgcgaggatctgaagaagacggtcaccccgcagaacatcggccccgggtgctaccggaccctcaacctgttccgctacaaaagccggtgctacatcctgaccatgtggaccctgctcctcatcatcgagtccatcctgtgggccgccagcgcggccgagatccccctcgtgcccctgtggacggacaacgcccacggcgtgggctccgtcccgatgcacaccgacctggagctcgacttcagcctgccctccagctccaagtacacctacaagcgccacctgaccaaccccgtgaacgaccaacagagcgtgtccctccacatcgagatcgagagccaggggatcggcgcggacgtctaccacctagggcactggtacgacgcccgcctgaacctaaagacgtcctttcactgctacggcgcgtgcaccaagtaccagtacccgtggcacacggccaagtgccacttcgagaaagactacgagtacgagaacagctgggcctgcaacccgcccgactgccccggcgtggggaccggctgcacggcctgtggcctgtacctggaccagctcaagcccgtgggcaccgcgttcaagatcatctccgtccgatacagccgcaaggtgtgcgtgcagttcggcgaggagtacctgtgcaagaccatcgacatgaacgattgcttcgtcaccaggcacgccaagatctgcatcatcggcaccgtgagcaagttctcccagggcgacaccctcctcttcctggggcccatggagggcgggggcatcatcttcaagcactggtgcaccagcacgtgccacttcggggaccccggcgacgtgatgggccccaaagacaagccgttcatctgcccagagttccccgggcagttccgcaagaagtgtaatttcgccaccacccccgtctgcgagtacgacggcaacattatctccgggtacaagaaggtgctggccaccatcgacagcttccagagcttcaacaccagcaacatccacttcacggacgagcggatcgagtggcgcgacccggacggcatgctccgggaccatatcaacatcgtgatctccaaggacatcgacttcgaaaatctggccgagaacccctgcaaggtcgggctgcaggcggccaacatcgaaggcgcctggggcagcggggtgggcttcaccctgacctgccaggtttcactcaccgagtgtcccacgttcctgacctctatcaaagcctgcgacatggccatctgctacggagcggagtccgtcaccctcagccgtggccagaacaccgtgaagatcacggggaagggcggccactccgggagctccttcaagtgctgccacggcaaggagtgcagctccaccgggctgcaggcctccgcgccccacctggacaaggtgaacggcatctccgagctcgaaaacgagaaggtctacgacgatggtgccccggagtgcggggtgacctgctggttcaagaagtcaggcgagtgggtgatgggtatcataaatggcaactgggtcgtgctgatcgtcctgtgcgtattgctgctgttcagcctcatcctgctgagcatcctctgccccgtgcggaagcacaagaagtcctga

SEQ ID NO: 15137 - RNA, 3402 nt, synthetic construct
  misc_feature 1..3402: note = derived and/or modified CDS sequence (opt11) from SEOV(HBT50)__KM233660.1__GP
  source 1..3402: mol_type = other RNA
atgtggtctctcctcttcctggccgccctggtgggccaggggttcgccctgaagaacgtcttcgatatgcgcatccagtgcccccacagcgtgaacttcggcgagactagcgtgtccgggtacaccgagctgccgcccctgagcctccaggaggccgagcagttggtccccgagtccagctgcaacatggacaaccaccagtccctgagcacgatcaacaagctcaccaaggtgatttggcgcaagaaggccaaccaggagtccgccaatcagaacagcttcgaggtggtcgagtccgaggtgagcttcaagggcctgtgcatgctgaagcaccgcatggtggaggagtcctaccggaaccgccggagcgtcatctgctacgacctcgcctgcaactccaccttctgtaagcccaccgtgtacatgatcgtgccgatccacgcgtgcaacatgatgaagtcctgcctgatcgggctgggcccctaccgcatccaagtcgtgtacgaacggacgtattgcaccacaggcatcctcaccgaggggaagtgcttcgtgcccgacaaggccgtcgtgagcgccctgaagcgcggcatgtacgccatcgcgagcatcgagacgatttgcttcttcatccaccagaaggggaacacctacaagatcgtgaccgccatcacgtccgccatgggcagcaagtgcaacaacacggacaccaaggtccagggttactacatctgcatcataggcggcaatagcgcccccgtgtacgccccggcgggggaggacttccgggccatggaggtgttctccggcatcatcaccagcccccacggggaagaccacgacctgcccggcgaggagatcgccacctaccagatctccggccagatcgaggccaagatcccccacacggtcagctccaagaacctcaagctgaccgccttcgcgggcatcccgagctactccagcacctccatcctggccgccagcgaggacggccgcttcatcttttcccccgggctgttccccaacctgaaccagagcgtgtgcgacaacaacgccctacccctcatctggcggggcctgatcgacctgacggggtactacgaggcagtgcacccgtgcaacgtcttctgtgtgctctccggccccggcgccagctgcgaagccttctccgagggcgggatcttcaacatcacgagccccatgtgcctggtctccaagcagaaccgcttccgggccgccgagcagcagatcagcttcgtgtgccagcgcgtggacatggacatcatcgtctactgcaacgggcaaaagaagaccatcctgaccaagaccctcgtgatcggccagtgcatatacacgatcacctccctgttcagtctgctccccggggtggcccacagcatcgcgatcgagctgtgcgtcccgggcttccacggctgggccaccgccgccctgctcatcaccttctgcttcgggtgggtgctcatccccgcgtgcacgctggccatcctcctggtgctgaagttcttcgccaacatcctccacacctccaaccaggagaatcggttcaaggccatcttgcgcaagatcaaggaggagttcgagaagaccaagggcagcatggtttgcgagatctgcaagtacgagtgcgagaccttaaaggagctcaaggcccacaatctgtcctgcgtgcagggggagtgcccctactgcttcacgcactgcgagcccaccgagacggcgatccaggcccactacaaggtctgccaggccacccaccggttccgcgaggacctgaagaagacggtgaccccgcagaacatcggccccgggtgctaccggaccctcaacctgttccgctacaagtcacggtgctacatcctgaccatgtggaccctgctcctgatcatcgagtccatcctgtgggccgccagcgctgccgagatacccttagtgcccctgtggaccgacaacgcccacggcgtgggctccgtcccgatgcacaccgacctggagctcgacttcagcctgccctccagctccaagtacacctacaagcgccacctgaccaaccccgtgaacgaccagcagagcgtgtccctccacatcgagatcgagagccaggggatcggcgccgatgtccatcacctggggcactggtacgacgcccgcctgaacctcaagacgtccttccactgctacggcgcgtgcaccaagtaccagtacccgtggcacaccgccaagtgccatttcgagaaggactacgagtacgagaacagctgggcctgcaacccgcccgattgtcccggcgtggggaccggctgcacggcttgcgggctgtacctggaccagctcaagcccgtgggcaccgcgttcaagatcatttccgtccggtacagccggaaggtgtgcgtgcagttcggagaggagtacctgtgcaagaccatcgacatgaacgactgcttcgtcacccggcacgccaagatctgcatcatcggcacggtgtctaagttctcccaaggcgacaccctcctcttcctggggcccatggagggcgggggcatcatcttccgtcactggtgcaccagcacgtgccacttcggggaccccggcgacgtgatgggccccaaggacaagccattcatctgccccgagttccccgggcagttccggaagaagtgcaacttcgccaccacccccgtctgcgagtacgatggcaacatcatatccgggtacaagaaggtgctggccaccatagacagcttccagtccttcaacaccagcaacatccacttcacggacgagcgcatcgagtggcgggacccggacggcatgctccgcgaccacatcaacatcgtgatctccaaagacatcgactttgagaacctggccgagaacccctgcaaggtcgggctgcaggcggccaacatcgagggcgcctggggcagcggggtgggctttaccctgacgtgccaagtgtccctgaccgagtgccccacgttcctgaccagtatcaaagcctgcgacatggccatctgctacggggcggagtccgtcaccctcagccggggccagaacaccgtgaagatcacggggaagggcggccactccgggagctccttcaagtgctgccacggcaaggagtgcagctccaccggtctgcaggccagcgcgccccaccttgacaaggtgaacggcatctccgagctcgagaacgagaaggtctacgacgacggcgccccggaatgcggggtgacctgctggttcaagaagtccggcgaatgggtgatggggatcatcaacggcaactgggtcgtgctgatcgtgctgtgcgtcctccttctgttcagcctcatcctgctgagcatcctctgccctgtgcgcaagcacaagaagtcctga

SEQ ID NO: 15138 - RNA, 3402 nt, synthetic construct
  misc_feature 1..3402: note = derived and/or modified CDS sequence (opt11) from SEOV(HuludaoRn101)__GU592923.1__GP
  source 1..3402: mol_type = other RNA
atgtggagcctgctcctgctggccgccctcgtgggccaggggttcgccctgaagaacgtcttcgacatgcgcatccagtgcccccactccgtgaactttggcgagaccagcgtgtcagggtacactgagctgccgcccctcagcctgcaggaggccgagcagctggtccccgagtccagctgcaacatggacaaccaccagtccctctccacgatcaacaagctgaccaaggtggtatggcggaagaaggccaaccaggagtccgccaaccagaacagcttcgaggtcgtggagtccgaggtgagcttcaagggcctgtgcatgctcaagcaccgcatggtcgaggagtcttaccggaaccgccggagcgtgatctgctacgacctggcctgcaactccaccttctgcaagcccaccgtgtacatgatcgtcccgatccacgcgtgcaacatgatgaagtcctgcctgatcgggctcggcccctaccgcatccaggtggtgtacgagcggacgtactgcaccaccggcatcctgaccgaggggaagtgcttcgtccccgacaaggccgtggtgagcgccctgaaacgcggcatgtacgccatcgcgagcatcgagacgatctgcttcttcatccaccagaaggggaacacctacaagatcgtcaccgccatcacctccgccatgggcagcaagtgcaacaacacggacactaaggtgcaggggtactacatctgcatcatcggcggcaacagcgcccccgtgtacgctccggcgggggaggacttccgggccatggaggtcttctccggcatcatcaccagcccccacggggaggaccacgacctccccggcgaggagatcgccacctaccagatctccggccagatcgaggccaagatcccccacacggtgagctccaagaacctgaagctgatcgccttcgcggggatcccgagctactccagcacctccattctcgccgccagcgaggactcccgtttcatattcagccccggcctgttccccaacctgaaccagtccgtgtgcgataacaacgccctccccctgatctggcggggactgatcgacctcaccggctactacgagactgtccacccgtgcaacgtgttctgcgtcctgagcgggcccggcgcctcctgcgaggcgttcagcgagggcgggatcttcaacatcacgtcccccatgtgtctggtgagcaagcaaaaccgcttccgggccgccgagcagcagatctctttcatctgccagcgcgtggacatggacatcatcgtctactgcaacggacagaagaagaccatcttgaccaagaccctggttatcgggcagtgcatttacacgatcaccagcctgttcagtctcttgcccggtgtggcccactccatcgccatcgagctgtgcgtcccggggttccacggctgggcgaccgccgccctgctgatcaccttctgcttcggctgggtgctgatccccgcctgcacgctcgcgatcctgctggtgctcaagttcttcgccaacatcctgcacaccagcaaccaagagaaccggttcaaggccatcctgcgcaagatcaaggaggagttcgagaagaccaaggggtccatggtctgcgagatctgcaagtacgagtgcgagaccttaaaagagttaaaggcccacaaccttagctgcgtgcagggcgaatgcccctactgcttcactcactgcgagcccaccgagaccgccatccaggcgcactacaaggtgtgccaggccacccaccggttccgcgaggacctcaagaagacggtaaccccgcagaacatcgggccaggctgctaccggaccctaaaccttttccgctacaagtcccggtgctacattctgaccatgtggaccctactgctgatcatcgagagcatcctctgggcagcttccgccgcggagatccccctggtgcccctgtggacggacaacgcacacggtgtgggcagcatcccgatgcacaccgacctcgagctggacttctccctgcccagctcaagcaagtacacctacaagcgccacctcacgaaccccgtcaacgatcagcaatctgtgtcgctgcacatcgagatcgagtcccagggcatcggggccgacgtgcaccacctgggccactggtacgacgcccgcctcaacctgaagacgagcttccactgctacggggcctgcaccaagtatcagtacccgtggcacaccgcaaaatgccacttcgagaaggactacgagtacgagaactcctgggcctgcaacccgcccgactgccccggcgtcggtaccgggtgcacggcttgtggcctgtacctcgaccagctgaagcccgtggggaccgccttcaagatcatcagcgtgaggtacagccgcaaggtctgcgtgcagttcggcgaggagtacctatgcaagaccatcgacatgaacgactgcttcgtgacccggcacgcgaagatctgcatcatcgggacggtctccaagttcagccagggcgacaccctcctgttcctgggccccatggagggcggcgggatcatcttcaagcactggtgcacctccacttgtcacttcggggaccccggggacgtgatgggccccaaggacaagccgttcatctgccccgagttccccggccagttccgcaagaagtgcaacttcgccaccacccccatctgcgagtacgacgggaatatcatcagcggctacaagaaggtgctcgccaccatcgactccttccagagcttcaacacctccaacatccacttcacggacgagcggatcgagtggcgcgacccggacgggatgctgcgggaccacatcaacgtcgtgatcagcaaggacatcgacttcgagaacctggccgagaacccctgcaaggttggcctccaggccgcgaacatcgagggggcctggggctccggcgtcgggtttactctgacctgtcaggtgagcctgaccgagtgccccacgttcctcacctccatcaaggcttgcgacatggccatctgctacggcgccgagtcggtgaccctgtcccgcggccagaacaccgtccggatcacgggcaagggcgggcacagcggctccagcttcaaatgctgccacgggaaggagtgctccagcaccggcctgcaggcgtccgcgccccacctcgacaaggtgaacgggatcagcgagctggagaacgagaaggtgtacgacgacggcgccccggagtgcggcgtgacctgctggttcaagaagtccggggagtgggtcatgggcatcatcaatgggaactgggtggtcctgatcgtgctctgcgtgctgctcctgttcagcctgatcctgctcagcatcctgtgccccgtccgcaagcacaagaagtcctga

SEQ ID NO: 15139 - RNA, 3402 nt, synthetic construct
  misc_feature 1..3402: note = derived and/or modified CDS sequence (opt11) from SEOV(Humber)__JX879768.1__GP
  source 1..3402: mol_type = other RNA
atgtggagcctgctcctgctggccgccctcgtgggccaggggttcgcgctgaagaacgtcttcgacatgcgcatccagtgtccccactccgtgaactttggcgagaccagcgtgtccgggtacaccgagctgccgcccctcagcctgcaggaagccgagcagctggtccccgagtccagctgcaacatggacaaccaccagtccctcagcacgatcaacaagctgaccaaggtgatctggcgtaagaaggccaaccaggagtccgccaaccagaacagcttcgaggtggtcgagtccgaggtgagctttaagggcctgtgcatgctcaagcaccgcatggtggaggagtcctaccggaaccgccggagcgtcatctgctacgacttagcctgcaactccaccttctgcaagcccaccgtgtacatgatcgtgccgatccacgcgtgcaacatgatgaagtcctgcctgatcgggctcggcccctaccgcatccaggtcgtgtacgagcggacatactgcaccaccggcatcctgacagaggggaagtgtttcgtgcccgacaaggccgtcgtgtccgccctgaagcgcggcatgtacgccattgcgagcatcgagacgatctgcttcttcgtgcaccagaaagggaacacctacaagatcgtcacagccatcacctccgccatgggcagcaagtgcaacaacacggacaccaaggtgcaggggtactacatctgcatcatcggcggcaacagcgcccccgtgtactccccggccggggaggacttccgggcgatggaggtcttcagcggcatcatcaccagcccccacggggaggaccacgacctccccggcgaggagatcgccacctaccagatcagcggccagatcgaggccaagataccccacacggtgtccagcaagaacctgaagctgaccgccttcgccgggatcccgtcctacagctccaccagcatcctagcggcctccgaggacggccgcttcatcttcagccccgggctgttccccaatctgaaccagtccgtgtgcgacaacaacgccctacccctgatctggcggggcctgatcgacctcaccgggtactacgaggccgtccacccgtgcaacgtgttctgcgtcctgagcggccccggcgcctcctgcgaggctttcagcgagggcgggatcttcaacatcacgtcccccatgtgcctggtgagcaagcagaaccgcttccgggccgcagagcagcagatctcctttatctgtcagcgcgtggacatggacatcatcgtctactgcaacgggcagaagaagaccatcctcaccaagaccctggtgatcggccagtgcatctacacgatcaccagcctgttttcactcctgcccggggtagcccactcgatcgccatcgagctgtgcgtcccgggcttccacggctgggcgaccgccgccctcctgatcaccttctgcttcgggtgggtgctgatccccgcctgcacgctcgccgtgctgctggtcctcaagttcttcgccaacatcctgcacaccagcaaccaggagaaccggttcaaggccattctgcgcaagatcaaggaggagttcgagaagaccaagggctccatggtgtgcgagatctgcaagtacgagtgcgagactctcaaggagctgaaggcccacaacctgagctgcatccaaggggagtgcccctactgcttcacgcactgcgagcccaccgagaccgccatccaggcgcactacaaggtgtgccaggccacccaccggttccgcgaggacctcaagaagacggtcacgccgcccaacattggccccgggtgctaccggaccctgaacctgttccgctacaagtcccggtgctacatcctgaccatgtggaccctcctgctgataatcgagagcatcctctgggccgcctccgccgcggagatccccctggtgccgctgtggacggacaacgcccacggcgtgggcagcgtccccatgcacaccgacctcgagctggacttctccctgcccagctccagcaaatacacctacaagcgccacctcaccaatccggtgaacgaccagcagtccgtgagcctgcacatcgagatcgaatcccaggggatcggcgccgacgtccaccacctggggcactggtacgacgcccgcctcaacctgaagacgagcttccactgctacggcgcctgcaccaagtaccagtacccctggcacaccgcgaagtgccacttcgagaaggattacgagtacgagaactcgtgggcctgcaacccgcccgactgccccggcgtgggaaccggctgcacggcctgtgggctgtacctcgaccagctgaagcccgtgggcaccgccttcaagatcatcagcgtccggtacagccgaaaggtgtgcgttcagttcggggaggagtacctgtgcaagacaatcgacatgaacgactgcttcgtcacccggcacgcgaagatctgcatcatcggcacggtgtccaaattcagccagggcgacaccctcctattccttgggcccatggagggcgggggcatcatcttcaagcactggtgcacctccacgtgccacttcggggaccccggcgacgtgatgggcccgaaggacaaacccttcatctgccccgagttccccgggcagttccgcaagaagtgcaacttcgccaccaccccggtctgcgagtacgacggcaacatcatcagcgggtacaagaaggtgctcgccaccatcgactccttccagagcttcaacacctccaacatccacttcacggacgagcggatcgagtggagagaccccgacggcatgctgcgggaccacatcaacatcatcatcagcaaggacatcgacttcgaaaacctggccgagaacccctgcaaggtcgggctccaggccgcgaacatcgagggcgcctggggctcaggggtcggcttcaccctgacctgccaggtgagcctgacagaatgccccacgttcctcacctccatcaaggcctgcgacatggccatatgctacggggccgagagcgtgaccctgtcccgcggccagaacaccgtcaagatcacggggaagggcggccacagcgggtccagctttaagtgctgccacggcaaggagtgctcgagcaacgggctgcaggcgtccgccccgcacctcgacaaggtgaacggcatcagcgagctggagaacgagaaggtgtacgacgacggcgcccccgagtgcggtgtgacctgctggttcaagaagtccggcgagtgggtcatggggatcatcaacggcaactgggtggtcctgatcgtgctctgcgtgctgctcctgttcagcctgatcctgctcagcatcctgtgccccgtccggaagcacaagaagagttga

SEQ ID NO: 15140 - RNA, 3402 nt, synthetic construct; identical to SEQ ID NO: 11854
  misc_feature 1..3402: note = derived and/or modified CDS sequence (opt11) from SEOV(Humber)__KM948597.1__GP
  source 1..3402: mol_type = other RNA

SEQ ID NO: 15141 - RNA, 3402 nt, synthetic construct
  misc_feature 1..3402: note = derived and/or modified CDS sequence (opt11) from SEOV(K24-e7)__AF288652.1__GP
  source 1..3402: mol_type = other RNA
atgtggtcactgcttctcctggccgccctcgtgggccaggggttcgcccttaagaacgtcttcgacatgagaatccaatgccctcacagcgtgaacttcggcgagaccagcgtttccgggtacactgagctaccgcccctctcgctgcaagaggccgagcagttagtccccgagtccagctgcaatatggacaatcaccagtcgctcagcacgattaacaagttaaccaaggtggtgtggcggaaaaaggcaaaccaggaatccgccaaccaaaacagcttcgaagtcgtagagtccgaggtgagcttcaagggcctgtgcatgctcaaacaccgcatggtcgaggagagttaccggaaccgccggagcgtaatctgctacgacctggcctgtaactccaccttctgcaagcctaccgtgtacatgatcgtcccgatccacgcgtgcaacatgatgaagtcctgtctgatcggtctcggcccctaccgcatccaggtggtgtacgagcggacgtactgcaccaccggcatccttaccgaagggaagtgttttgtaccgggcaaggccgtggtgagcgccctgaagcgtgggatgtacgccatcgcgagcatcgaaacgatatgtttcttcatccaccagaagggcaacacctataagatcgtcaccgccattaccagcgccatggggtcaaagtgcaacaacacggacacaaaggtgcagggctactacatctgcatcataggcgggaacagcgcgcccgtgtacgccccggcgggcgaggacttccgggccatggaggtcttctccgggatcatcaccagtccccacggcgaggaccacgacctgcccggcgaggaaatagccacctaccagatctccggtcaaatagaggcaaagatccctcacacggtgagctccaagaacctgaaacttatcgccttcgcaggcatcccgagttactccagcacctccatcctcgctgccagcgaggacgggcgcttcatcttctcccccggattattcccgaacttgaaccagagcgtatgcgacaacaacgccctgcccctgatctggcgggggctgatcgacctaaccggctactacgaggccgtccatccctgcaatgtcttccgcgtcctgtccggccccggggcgagctgcgaggccttctccgagggcgggatcttcaacatcaccagccccatgtgcctggtgtccaagcagaaccggttccgcgccgccgagcagcagatctcattcatctgccagcgggtagacatggatattatcgtctactgcaacggccagaagaagacgatactcaccaagactctggtgatagggcagtgcatctacaccatcacgtccctgttcagcctcctacccggcgttgcgcatagtatcgcgatcgagttgtgcgtcccgggttttcacgggtgggccaccgccgccctcttgattaccttctgcttcggctgggtgctgattcccgcgtgcacgctcgccatcctgctggtgctcaagttcttcgcgaatatcctgcacacttcaaaccaggagaaccgctttaaggcaatcctgcggaagataaaggaggagttcgaaaagaccaaggggagtatggtctgcgagatctgcaagtacgaatgcgagaccctcaaggagctgaaggcccacaatctgtcctgcgtgcagggagagtgtccctactgctttacccactgcgagccgacggagaccgcaatccaggctcactacaaggtgtgtcaagccacccaccgcttccgggaggacctcaagaagaccgtcacgccgcagaacatcgggcccggctgctaccgcaccctgaacctgttccggtacaagagccgctgttacatcttaaccatgtggaccttactgctgatcatcgagtccatcctctgggccgcaagcgctgccgaaatccctctggtgcccctgtggaccgacaatgcccacggcgtgggatccgtcccaatgcacacggacctcgagctggacttcagcctgccatcctcctcaaagtacacctacaagcgccacctcaccaacccagtgaacgaccagcagagcgtgtccctgcacatcgaaatcgagagccagggcatcggggccgacgtacaccatctgggccactggtacgacgcccggctcaacctgaagacctccttccactgttacggcgcgtgcaccaaataccagtacccgtggcacactgctaagtgccatttcgagaaggattatgaatacgagaacagttgggcctgcaacccgcccgactgcccaggggtgggcaccgggtgcaccgcctgtggcctgtacctcgaccagctaaagcccgtggggacggcgttcaagatcatctccgtccgctacagccggaaggtctgtatgcagttcggggaggagtacctgtgcaagaccatcgacatgaatgattgcttcgtgacccgccacgccaagatctgcatcatcggcaccgttagcaagttctcccagggagacacactattatttttaggacccatggagggcggcggcatcatctttaagcactggtgcaccagcacgtgccacttcggtgaccccggcgacgtgatgggtcccaaggacaagccgttcatctgtcccgagttccccggccagttccgaaagaagtgcaacttcgccaccacccccatctgcgagtacgacgggaacatcatatccgggtacaagaaggttctcgccacaatcgacagcttccagtccttcaacaccagcaacatccacttcaccgacgagcgcatcgagtggcgggatccggacggtatgctgcgcgaccacattaacatagtcatatccaaagacatcgacttcgagaacctggccgagaacccctgcaaggtgggcctccaggcggcaaacatcgagggcgcctgggggtctggcgtggggttcacactgacctgccaggtctccctgaccgagtgccccaccttcctaacgtcaatcaaggcctgcgacatggccatctgctacggagcggagagtgtgaccctgagcagagggcagaacaccgtgcgcatcaccgggcgaggcggacactccggaagctccttcaaatgctgccacggtaaggagtgcagctccacgggcctgcaggccagcgcgccccacttggacaaagtcaatggcatatccgagctggagaacgagaaggtatacgacgacggagcccctgagtgtggcgtgacctgctggttcaagaagtccggggagtgggtcatgggcataatcaacgggaactgggtggtgctgatcgtcctctgcgtgttactcctgttcagcctgatcttgctcagcatcctgtgccccgtgcgcaagcacaagaagtcctga

SEQ ID NO: 15142 - RNA, 3402 nt, synthetic construct
  misc_feature 1..3402: note = derived and/or modified CDS sequence (opt11) from SEOV(K24-v2)__AF288654.1__GP
  source 1..3402: mol_type = other RNA
atgtggagcctgctcctgctggccgccctcgtgggccaggggttcgcgctgaagaacgtcttcgacatgcgcatccagtgcccccacagtgtgaacttcggcgagaccagcgtgtccgggtacaccgagctgccgcccctcagcctgcaggaggccgagcagctggtccccgagtccagctgcaacatggacaaccaccagtccctcagcacgatcaacaagctgaccaaggtggtgtggcggaagaaggccaaccaggagtccgccaatcagaacagcttcgaggtcgtggagtctgaggtgagcttcaagggcctgtgcatgctcaagcaccgcatggtcgaggagtcctaccggaaccgccggagcgtgatctgctacgacctggcatgcaactccaccttctgcaagcccaccgtgtacatgatcgtcccaatccacgcgtgcaacatgatgaagtcctgcctgatcgggctcggcccctaccgaatccaggtggtgtacgagcggacgtactgcaccaccggcatcctgaccgaggggaagtgtttcgtccccgacacggcggtggtgagcgccctgaagcgcggcatgtacgccatcgcgagcatcgagaccatctgctttttcatccaccagaaggggaacacgtacaagatcgtcaccgccatcacctccgccatgggcagcaagtgcaacaacactgacaccaaggtgcaagggtattacatctgcatcatcggcggcaacagcgcccccgtgtacgccccggcgggggaggacttccgggccatggaggtcttctccggcatcatcaccagcccccacggggacgaccacgaccttccgggcgaggagatcgccccctaccagatctccggccagatcgaggccaaaatcccgcacacggtgagctcgaagaacctgaagctgatcgccttcgcggggatccccagctactcctcgacctccatcctcgccgccagcgaggacggccgcttcatcttctcccccgggctgttccccaacctgaaccagagcgtgtgcgacaacaacgccctcccgctgatctggcgcggcctgatcgacctcaccgggtactacgaggccgtccacccctgcaacgtgttctgcgtcctgtccggccccggggcgagctgcgaggccttctccgagggcgggatcttcaacatcaccagccccatgtgcctggtgtccaagcagaaccgcttccgggccgccgagcagcagatcagcttcatctgtcagcgcgtggatatggacatcatcgtctactgcaacgaccagaagaagacgatcctcaccaagaccctagtgatcgggcagtgcatctacaccatcacgtccctgttcagcctcctgccgggagtggcccactcaatcgcgatcgagctgtgcgtccccgggttccatggctgggccaccgccgccctcctgatcaccttctgcttcggctgggtgctgatccccgcgtgcaccctcgccatcctgctggtgctcaagttcttcgccaacatcctgcacacgtccaaccaggagaaccgattcaaagccatcctgcgcaagatcaaggaggagtttgagaagaccaaggggagcatggtctgcgagatctgcaagtacgagtgcgagaccctcaaggagctgaaggcccacaacctgtcctgcgtgcagggcgagtgcccctactgtttcacccactgcgagccgacggagaccgcgatccaggcccactacaaggtgtgccaggccacccaccggttccgcgaggacctcaagaagaccgtcacgccccagaacatcgggcccggctgctaccggacactgaacttgttccgctacaagagccggtgctacatcctgaccatgtggaccctcctgctgatcatcgagtccatcctctgggccgccagcgcggccgagatcccactggtgccgctgtggaccgacaacgcccacggggtgggctccgtccccatgcacacggacctcgagctggacttcagcctgccctccagctccaagtacacctacaagcgccacctcaccaacccggtgaacgaccagcagagcgtgtccctgcacatcgagatcgagagccagggcatcggtgcggacgtccaccacctgggccactggtacggggccaggctcaacctgaagacctccttccactgctacggcgcgtgcacgaagtaccaatacccctggcacaccgccaagtgccacttcgaaaaggactacgagtacgagaacagctgggcctgcaacccgcccgactgccccggcgtggggaccggctgcacggcctgcgggctgtacctcgaccagctgaagccagtgggcacggcgttcaagatcatctccgtccggtacagccgcaaagtgtgcatgcagttcggcgaggaatacctgtgcaagaccatcgacatgaacgactgcttcgtgacccgtcacgccaagatatgcatcataggcacagtcagcaagttctcccagggcgacacgctccttttcctggggcccatggagggcgggggcatcattttcaagcactggtgcaccagcacgtgccacttcggggaccccggcgacgtgatgggcccgaaggacaagcccttcatctgtcccgagttcccggggcagttccgcaagaagtgcaacttcgcaaccaccccgatctgcgagtacgacggcaatatcatctccgggtacaagaaggtgctcgccaccatcgacagcttccagtccttcaacaccagcaacatccacttcaccgacgagcggatcgagtggcgcgaccccgacggcatgctgcgggaccacatcaacatcgtcatctccaaggacatcgacttcgagaacctggccgagaacccctgcaaggtggggctccaggcggccaacatcgagggcgcctggggcagcggggtgggcttcacgctgacctgccaggtctccctgaccgagtgccccaccttcctcacgagcatcaaggcctgcgacatggccatctgctacggggcggagtccgtgaccctgagccgcggccagaacaccgtgcggatcaccgggaagggcggccactccgggagcagcttcaagtgctgccacggcaaggagtgcagctccacggggctgcaggccagcgccccacacctcgacaaggtcaacggcatctccgagctggagaacgagaaggtgtacgacgacggcgcccccgagtgtggggtgacctgctggttcaagaagtccggcgagtgggtcatggggatcatcaacggcaactgggtggtgctgatcgtcctctgcgtgctgctcctgttcagcctgatcctgctcagcatcctgtgccccgtgcgcaagcacaagaagtcgtga

SEQ ID NO: 15143 - RNA, 3402 nt, synthetic construct
  misc_feature 1..3402: note = derived and/or modified CDS sequence (opt11) from SEOV(KI-83-262)__D17592.1__GP
  source 1..3402: mol_type = other RNA
atgtggagcctgctcctgctggccgccctcgtgggacaggggttcgccctgaagaacgtcttcgacatgcgcatccagtgcccccactccgtgaacttcggcgagaccagcgtgtccgggtacacggagctgccgcccctcagcctgcaggaagccgagcagctggtccccgagtccagctgcaacatggacaaccaccagtccctcagcaccatcaacaagctgaccaaggtgatctggcggaagaaggccaaccaggagtccgcgaaccagaacagcttcgaggtggtcgagtccgaggtgagcttcaagggcctgtgcatgctcaagcaccgaatggtggaggagtcctaccggaaccgccggagcgtcatctgctacgacctggcctgcaactccaccttctgcaagcccaccgtgtacatgatcgtgccgatccacgcgtgcaacatgatgaagtcctgcctgatcgggctaggcccctaccgcatccaggtcgtgtacgagcggacgtactgcaccaccggcatcctgaccgaggggaagtgctttgtgcccgacaaggccgtcgtgagcgccctgaagcgcggcatgtatgccatcgcgagcatcgagacgatctgcttcttcatccaccagaaggggaacacctacaagatcgtgaccgccatcacctccgccatgggctctaagtgcaacaacacggacaccaaggtccaggggtactacatctgcatcatcggcggcaacagcgcccccgtgtacgccccggcgggggaggacttccgggccatggaggtattctccggaatcatcaccagcccccacggggaggaccatgacctccccggcgaggagatcgccacctaccagatctccggccagatcgaggccaagatcccccacacggtcagctccaagaacctgaagctgaccgccttcgcagggataccgagctactcaagcacctccatcctcgccgccagcgaggacggccgctttatcttctcccccgggctgttccccaacctgaaccagagcgtgtgcgacaacaacgccctccccctgatctggcggggcctgattgacctcaccggctactacgaggccgtccacccgtgcaacgtcttctgcgtgctgtccggccccggcgcgagctgcgaggccttctccgagggcgggatcttcaacatcacgagccccatgtgcctggtctccaagcagaatcgcttccgggccgccgagcagcagatcagcttcgtctgccagcgcgtggacatggacatcatcgtgtactgcaacgggcagaagaagaccatcctcaccaagaccctggtgatcggccaatgcatctacacgatcacctcgctgttcagcctcctgcccggggtggcccacagcatcgcgatcgagctgtgcgtcccgggctttcacggctgggccaccgccgccttgctgatcaccttctgcttcgggtgggtgctgatcccagcgtgcacgctcgccatcctgctggtgctgaagttcttcgccaacatcctgcacacctccaaccaggagaaccggttcaaggccatcctgcgcaagatcaaggaggagttcgagaagaccaagggctcgatggtctgcgagatctgcaaatacgagtgcgagaccctcaaggagctgaaggcccacaacctgtcgtgcgtgcagggggagtgcccctactgcttcacgcactgcgagcccaccgagaccgcgatccaggcccactacaaggtgtgccaggccacccatcggttccgcgaggacctcaagaagacagtcaccccgcagaacatcggccccgggtgctacaggaccctgagcctgttccgctacaagtcccggtgctacatactgaccatgtggaccctcctgctgatcatcgagtccatcctctgggccgcctccgcggccgagatccccctggtgcccctgtggaccgacaacgcccacggcgtgggcagcgtcccgatgcacacagacctcgagctggacttctccctgcccagctcctcgaagtacacctacaagcgccacctcaccaaccccgtgaatgaccagcagtccgtgagcctgcacatcgagatagagtcccaggggatcggcgccgacgtccaccacctgggacactggtacgacgcccgcctcaacctgaaaacgagcttccactgctacggcgcgtgcaccaagtaccagtacccgtggcacaccgccaagtgccacttcgagaaggactacgagtacgagaactcctgggcctgcaacccgcccgactgccccggagtggggaccggctgcacggcctgcgggctgtacctcgaccagctgaagcccgtgggcaccgcgttcaagatcatcagcgtccggtacagccggaaagtgtgcgtgcagttcggggaggagtacctgtgcaagaccatagacatgaacgactgcttcgttacccggcacgccaagatctgtatcatcggcacggtgtcgaagttcagccagggcgacaccctgctgttcctggggcccatggagggtgggggcatcatcttcaagcactggtgcacctccacgtgccacttcggtgaccccggcgacgtgatggggcccaaggacaaaccgttcatctgccccgagttccccgggcagttccgcaagaagtgcaacttcgccaccacccccgtctgcgaatacgacggcaacatcatcagcgggtacaagaaggtgctcgccaccatcgactccttccagagcttcaacacctccaacatccacttcacggacgagcggatcgagtggcgcgacccggatggcatgcttcgggaccacatcaacatcgtgatcagcaaggacatcgacttcgagaacctggccgagaacccctgcaaggtcgggctccaggccgccaatatcgagggcgcgtggggctccggggtgggcttcacgctgacctgccaggtgagcctgaccgagtgccccacgttcctcacctccatcaaggcctgcgacatggccatctgctacggcgcggagagcgtcaccctgtcccgcggccagaacaccgtgaagatcacggggaagggcggccacagcgggtccagcttcaagtgctgccacggcaaggagtgctccagcaccgggctgcaggcctccgcgccccacctcgacaaggtaaacggcatcagcgagctggaaaacgagaaggtctacgacgacggcgccccggagtgcgggatcacgtgctggttcaagaagtccggcgagtgggttatggggatcatcaacggcaactgggtggtcctgatcgtgctctgcgtgctgctactgttcagcctgatcctgctcagcatcctgtgccccgtccggaagcacaagaagtcctga

SEQ ID NO: 15144 - RNA, 3402 nt, synthetic construct
  misc_feature 1..3402: note = derived and/or modified CDS sequence (opt11) from SEOV(KI-85-1)__D17593.1__GP
  source 1..3402: mol_type = other RNA
atgtggagcctgctcctgctggccgctctcgtgggccaggggttcgcactgaagaacgtcttcgacatgcgcatccagtgcccccacagcgtgaacttcggcgaaaccagcgtgtccgggtacactgagctgccgcccctcagcctgcaggaggccgagcagctggtgcccgagtccagctgcaacatggacaaccaccagtccctcagcaccatcaacaagctgaccaaggtgatctggcggaagaaagcaaaccaggagtccgccaaccagaacagcttcgaggtggtcgagtccgaggtgagctttaagggcctgtgcatgctcaagcaccgaatggtagaggaatcctaccggaatcgccggtcagtcatctgctacgacctggcctgcaactccaccttctgtaagcccaccgtgtacatgatcgtcccgatccacgcgtgcaacatgatgaaatcctgcctgatcgggctcggcccctatcgcatccaggtcgtgtacgaacggacgtactgcaccaccggcatcctgaccgagggcaagtgcttcgtgcctgacaaggcagtcgtgagcgccctgaagcgcggcatgtacgccatcgcgagcatcgagacgatatgcttcttcatccaccagaaggggaacacctacaaaatcgttaccgccatcaccagtgccatggggagcaagtgcaacaacactgacaccaaggtccaggggtactacatctgcatcatcggcggcaacagcgcccccgtgtacgccccggcgggggaggacttccgggccatggaggtgttctccggcatcatcaccagccctcacggtgaggaccacgacctccccggcgaggagatcgccacctaccagatcagtggacagatcgaggccaagatcccccacacggtcagcagtaagaacctgaagctgaccgccttcgccgggatcccgagctactccagcacctccatcctcgccgccagcgaggatggcaggtttatcttctcccccggtctgttccccaatctgaaccagagcgtgtgcgacaacaacgccctccccctgatctggcggggcctgatcgacctcaccggatactacgaggcagtgcacccgtgcaacgtcttctgcgtgctgtccggccccggcgcgagctgcgaggccttctccgagggcgggatcttcaacatcacgagccccatgtgcctggtctccaagcaaaaccgtttccgggccgccgagcagcagatctccttcgtgtgccagcgcgttgacatggacatcattgtctactgcaacgggcagaagaagaccatcctcaccaagaccctggtgatcggccagtgcatctacacgatcacctcccttttcagcctcctgcccggggtggcccactctatcgcgatagagctgtgcgttccgggcttccacggctgggccaccgccgccctcttgatcaccttttgcttcggatgggtgctaatccccgcgtgcacgctcgccatcctgctggtactcaagttcttcgccaacatcctgcacacctccaaccaggagaaccggttcaaggccatcctgcgcaagatcaaggaggagttcgagaagaccaagggcagcatggtctgcgagatctgcaagtacgagtgcgagaccctcaaggagctgaaggcccacaacctgtcctgcgtgcagggggagtgcccctactgcttcacgcactgcgagcccaccgagaccgcgatccaggcccactacaaggtatgccaggccacccacagattccgcgaggacctcaagaagacggtcaccccgcagaacataggcccggggtgctaccggaccctgaacttattccgctacaagagccggtgttacattctgaccatgtggaccctcctgttgatcatcgaatccatattatgggccgccagcgcggccgagatacccctggtaccactgtggaccgacaacgcccacggcgttggctccgtcccgatgcataccgaccttgagctggacttcagcctgccctccagctccaagtacacctacaagcgccacctcaccaaccccgttaacgaccagcagagcgtgtccctgcacatcgaaatcgagtctcaggggatcggggccgatgtccaccacctggggcactggtacgacgcccgcctcaacctgaagacgtccttccactgctatggcgcgtgcgccaagtaccagtacccgtggcacaccgccaagtgccacttcgagaaggactacgagtacgagaacagctgggcctgcaacccgcccgactgccccggcgtgggcaccggctgcaccgcgtgtgggctgtacctcgaccagctgaagcccgtgggcacggccttcaaaatcatctccgtccggtacagccgcaaggtgtgcgtgcagttcggggaggagtacctgtgcaaaaccatcgacatgaacgactgcttcgtcacacggcacgccaaaatctgtatcatcggcaccgtgagcaagttctctcagggcgacacgctcctgttcctggggcccatggagggcgggggtatcatcttcaagcactggtgcaccagcacgtgccacttcggggaccccggcgacgtgatgggccccaaggacaagccgttcatctgtcccgagttccccgggcagttccgcaagaagtgcaacttcgccaccacccccgtctgcgaatacgacggcaacatcatttccgggtacaagaaggtgctcgccaccatcgacagcttccagtctttcaacaccagcaacatccacttcaccgacgagcggattgagtggcgcgatccggacggcatgctgcgcgaccacatcaacatcgtgatctccaaggacatcgacttcgagaacctggcggagaacccctgcaaggtcgggctccaggcggccaacatcgagggcgcctggggcagcggtgtgggcttcacgctcacctgtcaggtgagtctgactgagtgccccaccttcctcacgtcgatcaaagcctgcgacatggcgatctgctacggggctgaatcggttaccctgagccgcggccagaacaccgtgaagatcaccgggaagggcggccactccgggagttcctttaagtgctgccacgggaaggagtgcagctcaacggggctgcaggccagcgcgccccacctcgacaaggtgaacggcatctcagagctcgagaacgagaaggtctacgacgacggcgccccggagtgcgggataacgtgctggttcaagaagtccggcgagtgggtgatggggatcatcaacggcaactgggttgtcctgatcgtgctctgtgtgcttctcttattcagcttcatcctgctaagtattctctgccccgtccggaaacacaaaaagtcttga

SEQ ID NO: 15145 - RNA, 3402 nt, synthetic construct
  misc_feature 1..3402: note = derived and/or modified CDS sequence (opt11) from SEOV(KI-88-15)__D17594.1__GP
  source 1..3402: mol_type = other RNA
atgtggagccttctcctgctggccgccctcgtgggacaaggcttcgccctgaagaatgtcttcgacatgcgcattcagtgcccccatagcgtaaacttcggagagacctccgtgtccgggtacaccgagctgccgcccctcagcctgcaggaggcggaacaactggtccccgagtccagctgcaacatggacaaccaccagtccctcagcactatcaataagctcaccaaggtgatctggcggaagaaggccaaccaggagtccgccaaccagaacagcttcgagatcgtggagtccgaggtcagcttcaagggcctgtgtatgctcaagcaccgcatggtggaggaatcctaccggaaccgccggagcgtcatctgctacgacctcgcctgtaactccaccttctgtaagcccaccgtctacatgatcgtgccgatccacgcgtgcaacatgatgaagtcctgcctgatcgggctcggcccctaccgcatacaggtggtctatgagcggacgtactgcaccaccggcatccttaccgaggggaaatgcttcgtgccagacaaggccgtggtcagcgccctcaagcgcggcatgtacgccatcgcgagcatcgagacgatatgcttcttcatccatcagaaggggaatacctacaagatcgtgaccgccatcacctccgccatgggcagcaagtgcaacaacacggacaccaaggtgcaggggtactacatctgcatcataggcggcaacagcgcgcccgtctacgcccctgcgggcgaggacttccgggccatggaggtgttctccggcataatcaccagcccccacggagaggaccacgacctccccggcgaggagatagccacctaccaaatctcaggccagatcgaggccaagatcccccataccgtgagcagtaagaacctgaagctgacggcgtttgcggggatcccgagctactccagcaccagcatcttggccgcaagcgaagatggccgcttcatcttcagtcctggactgttccccaacctcaaccaaagcgtctgtgacaacaacgccctacccctgatctggcggggcctgatcgacctcactgggtactacgaggccgtgcacccgtgcaacgtgttctgcgtcttgtccggccccggcgcgagctgtgaggccttctccgagggcggcatcttcaacataacgagccccatgtgcctggtgtccaagcagaaccgcttccgggccgccgagcagcagatcagcttcgtctgccagcgcgtggatatggacatcatcgtgtattgcaacggacagaaaaagacaatcctcacaaagaccctggtaatcggccagtgcatatatacgattacctccctgttcagcctcttacccggggtggcacactcaatcgcaatcgagctgtgcgtgccgggcttccacggttgggccaccgccgccctcctgatcaccttctgcttcgggtgggtcctgatccccgcgtgcacgctcgccatccttctagtgctcaagttcttcgccaacatcctgcacacgtccaaccaggagaaccggttcaaggccatccttcgcaagatcaaggaggagttcgaaaagaccaagggcagcatggtgtgcgagatttgcaagtacgagtgcgagaccctaaaggagctgaaggcccacaacctgtcctgtgtccaaggtgagtgcccctactgctttacgcactgcgagcccaccgagacagcgatacaggcccattacaaggtgtgccaggccacccaccggttccgcgaggacctcaagaagacggtgacgccccagaatatcggacccgggtgctaccggaccctgaatttgttccgctacaagagccggtgttacatcctgaccatgtggaccctcctgctgatcatagagtccatactctgggccgccagcgcggccgagattcccctggtccctttatggacggacaacgcccacggcgtgggttcagttcccatgcacacagacctcgagctggacttcagccttccctccagctccaagtacacctataagcgccacctcacaaaccccgtcaacgaccagcagtcggtgtccctacacatcgagatcgagagccaagggatcggcgccgacgtccaccacctggggcactggtacgacgcccgcctcaatctaaagacgtcctttcactgctatggcgcgtgcaccaagtaccagtacccgtggcacaccgccaagtgccacttcgagaaggattacgagtacgagaactcatgggcttgcaacccaccggactgccccggagtcgggaccggctgcacggcctgcggcctgtacctcgaccagctgaagcccgtcggcaccgctttcaagattatcagcgtgcggtacagccgcaaggtatgcgtgcagttcggggaggagtatctgtgcaagaccatcgacatgaacgactgcttcgtgacccgacacgccaagatctgcatcatcggcacggtcagcaagttctcccagggggacaccctcctgttcctggggcccatggagggcgggggaatcattttcaagcactggtgcaccagcacatgccacttcggggaccccggtgacgtgatgggtccaaaggacaagccgttcatctgccccgagttccccgggcagttccgcaagaagtgcaacttcgccaccacccctgtgtgcgaatacgacgggaacatcatctccgggtacaagaaggtcctcgccaccatcgattctttccagtccttcaacacgagcaacatccactttacggacgagcggatcgagtggcgcgacccggacggcatgctgcgggaccacatcaacattgtgatctccaaggatatcgacttcgagaacctggcggagaacccctgcaaagtggggctccaggcggccaacatagagggggcctggggtagcggggtcggcttcaccctgacctgccaggtttccctgaccgaatgcccaacgttcctcaccagcataaaggcctgcgacatggccatctgctacggggcggagtctgtgactctgagccgcggccagaataccgtgaagatcacggggaaaggcggccactcagggagctccttcaagtgctgtcacggaaaggagtgcagctccaccggcctgcaggccagcgcgccccacctcgacaaggttaacggcatctccgagctgaagaacgagaaggtgtacgacgacggcgccccggagtgtgggattacgtgctggtttaaaaagtccggcgagtgggtcatggggatcatcaacggcaactgggtggtgctgatcgtcctctgcgtgctgctccttttctccttcattctgctgagcatcctctgtcccgtgcggaagcataagaagtcttga

SEQ ID NO: 15146 - RNA, 3402 nt, synthetic construct
  misc_feature 1..3402: note = derived and/or modified CDS sequence (opt11) from SEOV(LongwanRn581)__GU592930.1__GP
  source 1..3402: mol_type = other RNA
atgtggagcctgctcctgctggccgccctcgtgggccaggggttcgcgctgaagaacgtcttcgacatgcgcatccagtgcccccactccgttaacttcggggagaccagcgtgtccgggtacaccgagctgccgcccctcagcctgcaggaggccgagcagctggtccccgagtccagctgcaacatggacaaccaccagtccctcagcacgatcaacaaactgaccaaggtgatctggcggaagaaggccaaccaggagagcgccaaccagaacagcttcgaggtcgtcgagtccgaggtgagctttaagggcctttgcatgctcaagcaccgcatggtggaggagtcctaccggaaccgccggtcagtcatctgctacgacctggcctgcaactccaccttctgcaagcccaccgtgtacatgatcgtgccaatccacgcgtgcaacatgatgaagtcctgcctgatcgggcttggcccctaccgcatccaggtcgtgtacgagcggacgtactgcaccaccggaatcctgaccgaggggaaatgcttcgtgccagacaaggccgtcgtgagcgccctgaagcgcggcatgtatgccatcgcgagcatcgagacgatctgcttcttcatccaccagaaggggaacacctataagattgtgaccgccatcacctccgccatgggcagcaagtgcaacaacacggacaccaaggtccaggggtactacatctgcatcatcgggggcaacagcgcccccgtgtacgcccccgcgggggaagacttccgggccatggaggtgttctccggcatcatcaccagcccgcacggggaggaccacgacctccccggcgaggagatcgccacctatcagatctccggccagatcgaggccaagatcccccacacggtcagctccaagaacctgaagctgaccgccttcgcggggatcccgtcttactccagcaccagcatcctcgccgccagcgaggacggccgcttcatcttttcccccgggctgttccccaacctcaaccagagcgtgtgcgacaacaacgccctccccttgatctggcggggcctgatcgacctcaccgggtactacgaggccgtgcacccgtgcaacgtcttctgcgtgctgtccggccccggcgctagctgcgaggccttctccgagggcgggatcttcaacatcacgagccccatgtgcctggtctccaagcagaaccgcttccgggccgccgagcaacagatcagcttcgtgtgccagcgcgtggacatggacatcatcgtctattgcaacgggcagaagaagaccatcctcactaagaccctggtgatcggccagtgcatctacacgatcacctccctgttcagcctcctgcccggggtggcccacagcatcgcgatcgagctgtgcgtcccgggcttccacggctgggccaccgccgccctcctgatcaccttctgcttcgggtgggtgctgatccccgcgtgcacgctcgccatcctgctggtgctcaagttcttcgccaacatactgcacacctccaaccaggagaaccggttcaaggccattctgcgcaagatcaaggaggagttcgagaagaccaagggcagcatggtctgcgagatctgcaagtacgagtgcgagaccctcaaggagctgaaagcccacaatctgtcctgcgtgcagggtgagtgtccctactgcttcacgcactgcgagcccaccgagaccgcgatccaggcccactacaaggtgtgccaggccacccaccggttccgcgaggacctcaagaagacggtcaccccgcagaacattggccccgggtgctaccggaccctgaacctgttccgctacaaaagccggtgctacatcctgaccatgtggaccctactgctgatcatcgagagcatcctctgggccgccagcgcggccgagatacccctggtgccgctctggacggacaacgcccacggcgtgggctcagtcccgatgcacaccgacctcgagttagacttcagcctgccctccagctccaagtacacctacaagcgccacctcacaaaccccgtcaacgaccagcagagcgtgtccctgcacatcgagatcgaaagccaggggatcggcgccgacgtccaccacctggggcactggtacgacgcccgcctcaacctgaaaacgtccttccactgctacggcgcgtgcaccaagtatcagtacccgtggcacaccgccaagtgccacttcgagaaggactacgagtacgagaacagctgggcctgcaacccgcccgactgccccggcgtggggactggctgcacggcctgcgggctgtacctcgaccagctgaagcccgtgggcaccgcgttcaagatcatctctgtccggtacagccgcaaggtgtgcgtgcagttcggggaggagtacctctgcaagaccatcgacatgaacgactgcttcgtcacccggcatgccaagatctgcatcatcggcacggtgagcaagttctcccagggcgacaccctcctgttcctggggcccatggagggcgggggcatcatcttcaagcattggtgcaccagcacatgccacttcggggaccccggcgacgtgatgggccccaaggacaagccgttcatctgccccgagttccccgggcagttccgcaagaagtgcaacttcgccaccacccccgtctgcgagtacgacggcaacatcatctccggttacaagaaggtgttagccaccatcgacagcttccagtccttcaacaccagcaacatccacttcacggacgagcggatcgagtggcgcgacccggacggcatgctgcgggaccacatcaacatcgtgatctccaaggacatcgacttcgagaacctggctgagaatccctgcaaggtcgggctccaggcggcgaacatcgagggcgcctggggaagcggggtgggcttcaccctgacctgccaggtgagtctgaccgagtgccccacgttcctcaccagcatcaaggcctgcgacatggccatctgctacggggcggagtccgtcaccctgagccgcggccagaacaccgtgaagatcacggggaagggcggccactccgggagctcctttaagtgctgccacggcaaggagtgcagctcgaccgggctgcaggccaacgcgccccacctcgacaaggtgaacggcatcagcgaactggagaacgagaaggtctacgacgacggcgccccggagtgcggggtgacctgctggttcaagaagtcaggcgagtgggttatggggatcatcaatggcaactgggtcgtgctgatcgtgctctgcgtcctgctcctgttcagcctgatcctgctcagcatcctgtgccccgtgcggaagcacaagaagtcctga

SEQ ID NO: 15147 - RNA, 3402 nt, synthetic construct
  misc_feature 1..3402: note = derived and/or modified CDS sequence (opt11) from SEOV(RuianRn180)__GU592931.1__GP
  source 1..3402: mol_type = other RNA
atgtggagcctgctcatcgtggccgccctggtcggccaggggttcgccctgaagaacgtgttcgacatgcgcatccaatgcccacacagcgtgaatttcggcgagaccagcgtctccgggtacaccgaactgcccccgctcagcctgcaggaggcagagcagctcgtgcccgagtctagctgcaacatggacaaccaccagtccctgtcgacgatcaacaagctgaccaaggtgatttggcgaaagaaggccaaccaggaatccgccaaccaaaacagcttcgaggtcgtggagtccgaggttagcttcaagggcctctgcatgctgaagcaccgcatggtcgaggagtcctaccggaatcgccgatccgtgatctgctacgacctggcatgcaactccaccttctgcaagcccaccgtgtacatgattgtcccgatccacgcgtgcaacatgatgaagtcctgcctcatcgggctggggccctaccgcatccaggtggtgtacgagcggacgtactgcaccaccggcatcttgaccgaggggaagtgcttcgtcccggacaaggccgtcgtgagcgccctcaagcgcggcatgtacgcaatcgcgagcatcgagacgatctgcttcttcatccaccagaaggggaacacctacaagatcgtcaccgccatcacatcagccatgggttccaagtgcaacaacacggacacaaaggtgcagggatactatatctgcatcatcggcggcaacagcgcccccgtgtacgccccggcgggggaggacttccgggccatggaggtcttctccggcatcataacctcgccccacggggaagaccacgatctgcccggcgaggagatcgccacctaccaaatctccggccagatcgaggccaagatcccccacacggtgtcctccaagaatctgaagctcaccgccttcgcggggattccgagctactccagcacgtccatcctggccgccagcgaggacggccgcttcatcttcagccccgggctgtttcccaacctcaaccagagcgtctgcgacaacaatgccctgcccctgatctggcgtggcctcatcgacctgaccggttactacgaggccgtacacccgtgcaacgtgttctgcgttctatccggccccggagcgagctgcgaggccttctcagagggtgggatcttcaacatcacgagcccgatgtgcctcgtctccaagcagaaccgcttccgggccgccgagcagcagatcagcttcatctgccagcgcgtggacatggacatcatagtctactgcaacgggcagaagaagaccatcctgaccaagactctggtaatcggccagtgcatctatactattacatccctcttcagcctgctgcccggggtcgcccacagcatagcgatcgagctctgcgtcccgggcttccatggctgggccaccgccgccctgctgatcaccttctgtttcgggtgggtcctcatccccgcgtgcacgctggccatcttactcgtgctgaagttcttcgccaacatcctgcacacctccaaccaggagaacagattcaaggccatcctccgcaagatcaaggaggagttcgagaagaccaagggcagcatggtctgcgagatctgcaagtacgagtgcgagaccctgaaggagctaaaggcccataacctctcctgcgtgcagggcgagtgcccctactgcttcacgcactgcgagcccacggagaccgcgattcaggcccactataaggtgtgccaggccacccatcggttccgagaggacctgaagaagacggtcaccccgcagaacatcggccccggctgctaccggaccctgaacctcttccgctacaagagccggtgctacatcctgaccatgtggaccctactgctcatcatcgagtccatactgtgggccgccagcgcggcagagatacccctggtgcccctctggacggacaacgcccacggcgtgggctctgtcccgatgcacaccgacctggagctggacttcagcctccccagtagctccaagtacacctacaagcgccacctcaccaaccccgtgaacgaccagcagagcgtgtccctgcacatcgagatcgagagccaggggataggcgcagacgtccaccacctcgggcactggtacgacgcccgcctgaacctgaagacgtccttccactgctacggcgcgtgcaccaagtaccagtacccgtggcacaccgccaagtgtcactttgagaaggattacgagtacgagaacagctgggcctgcaatccgcctgactgccccggcgtggggaccggctgcacggcctgcgggctctatctggaccagctgaagcccgtgggcaccgcgttcaagatcatctccgtccggtacagccgcaaggtgtgtgtgcagtttggcgaggagtacctctgcaagaccatcgacatgaacgactgtttcgtcacccggcacgccaagatctgcatcatcggcactgtgagcaagttctcccagggcgacaccctcctgttcctcgggcccatggagggtgggggcatcatctttaagcattggtgcaccagcacgtgccacttcggagaccccggcgacgtgatgggccccaaggacaagccgttcatctgccccgagttccccgggcagttcagaaagaaatgcaatttcgccaccacacccgtctgcgagtacgacggcaacatcatctccgggtacaagaaggtgttagccaccatcgacagctttcagtccttcaacaccagcaacatccacttcacggacgagcggatcgagtggcgcgacccggacggcatgctgcgggaccacatcaacatcgtgatctccaaggacatcgacttcgagaacctcgccgagaacccttgtaaggtcgggctgcaggcggccaacatcgagggcgcctggggcagcggggtgggcttcaccctgacctgccaggtctccctcactgagtgccccacgttcctgaccagcataaaggcctgcgacatggccatctgctacggggcggagagcgtcaccctgagccgcggccagaataccgtgaagattacagggaagggcggccactccggcagcagcttcaagtgctgccacggtaaggagtgctcgtccaccgggctccaagccagcgcgccccacctcgacaaggtgaacggcatttccgaactggagaacgagaaggtgtacgacgacggcgccccggagtgcggggtgacctgctggttcaagaagtccggcgagtgggtcatggggatcatcaacggcaactgggtcgtgctcatcgtgctgtgcgtcctgctcctgttcagtctgatcctcctgagcatcctgtgccctgtgcggaagcataaaaagagctga

SEQ ID NO: 15148 - RNA, 3402 nt, synthetic construct
  misc_feature 1..3402: note = derived and/or modified CDS sequence (opt11) from SEOV(ShuangyangRn470)__GU592925.1__GP
  source 1..3402: mol_type = other RNA
atgtggagcctcctcttcctggccgccctggtaggacaggggttcgccctcaagaacgtcttcgacatgcgcatccagtgcccccacagcgtgaacttcggcgagaccagcgtgtccgggtacaccgagttaccgcccttgagcctccaggagtccgagcagcttgtccccgagagctcctgcaacatggacaaccaccagagcctcagtacgatcaacaagctcacgaaggtgatttggcggaagaaggccaaccaggagagcgccaatcagaactccttcgaggtggtggagagcgaggtgtccttcaagggcctgtgcatgcttaagcacaggatggtggaggagagctaccggaaccgccggtccgtcatctgctatgacctcgcctgcaacagcaccttctgcaagcccaccgtgtatatgatcgtgccgatccacgcttgcaacatgatgaagtcctgcctgatcgggctgggcccctaccgtatccaggtcgtgtacgagcggacgtactgcaccaccggcattttgaccgaggggaagtgcttcgtgcccgacaaggcggtcgtgagcgccctgaagcgcggcatgtacgccatcgcctccatcgagacgatctgcttcttcatccaccagaagggtaacacctacaagatcgtgaccgcgatcaccagcgccatgggcagcaagtgcaacaacactgacaccaaagtccagggatactacatctgcatcatcggcggcaattccgcccccgtgtacgccccggccggggaggatttccgagcgatggaggtgttcagcggcatcatcaccagcccccacggggaggaccacgacctgcccggtgaggagatcgcaacctaccaaatcagcggccagatcgaggccaagatcccccacacggtctccagcaaaaacttaaagctgaccgccttcgccgggattccttcctacagctccaccagcatcctggcggcctccgaggacggccgcttcatcttcagccccgggctgttccccaacctcaaccagtccgtgtgtaacaacaacgctctgcccctaatctggcggggcctgatcgacctcaccgggtactacgaggccgtgcacccgtgcaacgtcttctgcgtgctcagcggccccggcgcctcctgtgaggcattcagcgagggcgggatcttcaacatcacatcccccatgtgcctggtgagcaagcaaaaccgtttccgggccgcagagcagcagatctccttcgtgtgccagcgcgtggacatggacatcatagtctactgcaacgggcagaagaagaccatcttgaccaagaccctcgtgatcggccagtgcatctacacgatcacctctctgttcagcctgctccccggggtggcccacagcatcgccatcgagctctgcgtcccgggcttccacggctgggcgaccgccgccctgctcatcaccttctgcttcgggtgggttctgatccccgcctgcacgctagcaatcctactggtgctgaagttcttcgccaacatcctgcacacaagcaaccaggagaaccggttcaaggccatcctccgcaagatcaaggaggagtttgaaaagaccaagggctccatggtctgtgagatctgcaagtacgagtgcgagacccttaaggagttgaaggcccacaacctgagctgtgtgcagggggagtgcccctactgcttcacgcactgcgagcccaccgagaccgccatccaggcgcactacaaggtttgccaggcaacccaccggttccgcgaggacctgaagaaaacggtcaccccgcagaatatcggccccgggtgctaccggaccctcaacctgttccgctataaatcccggtgctacatcctgaccatgtggaccctgctcctgatagtcgaaagcatcctgtgggccgcctccgccgcggagatccccctcgtgcccctgtggacggacaacgcccatggcgtcggctcagtgccgatgcacaccgacctggagcttgacttctccctgccaagctccagtaagtacacctacaagcgccacttaaccaaccccgtgaacgaccagcagtccgtcagcctccacatcgagatcgagtcccaggggatcggcgccgacgtgcaccacctggggcactggtacgacgcgcgcttaaacctcaagacgagcttccactgctacggcgcctgcaccaagtatcagtacccgtggcacactgcgaaatgccacttcgagaaggactatgagtacgagaacagctgggcctgcaacccgccagactgccccggcgtgggcacaggctgcacggcctgcgggctgtacctggaccaactcaagcccgttggcacagccttcaagatcatcagcgtgcggtacagccgcaaggtgtgcgtgcagttcggggaggagtacctgtgcaagaccatcgacatgaacgactgcttcgtgacccggcacgccaagatatgcatcatcggcacagtgtccaaattcagccagggcgacaccctcctcttcctggggcctatggagggcgggggcatcattttcaagcactggtgcacctccacgtgccacttcggcgaccccggcgacgtcatgggcccgaaagacaagccgttcatctgccccgagttccccgggcagttccgtaagacctgcaacttcgctaccacccccgtgtgcgagtacgacggcaacatcatcagcgggtacaagaaggtgctggccaccatcgactcctttcagagcttcaacacgtccaacatccacttcaccgacgagcggatcgagtggcgcgacccggacggcatgctccgggaccacataaacatcgtcatcagcaaggacatcgacttcgagaacctggccgagaacccctgcaaagtgggcctgcaggccgcgaacatcgagggcgcctggggctctggggtgggcttcaccctaacctgccaggtcagcctgacggagtgccccaccttcctgaccagcatcaaggcctgcgacatggccatctgctacggggccgagagcgtgaccctctcccggggccagaacacggtgaagatcaccgggaagggcggccacagcggttcgagcttcaagtgctgccatggcaaggaatgttccagcaccggactgcaggcgtccgcaccccacctcgataaagtcaacggcatcagcgagctcgaaaacgagaaggtgtacgacgacggcgccccggagtgcggggtaacctgctggttcaagaagtccggcgagtgggtcatggggatcataaacggcaactgggtggtgctgatcgtcctgtgtgtgctcctgctgttttccctcatcctgctgtctatcctctgccccgtgcggaagcacaagaagtcctga

SEQ ID NO: 15149 - RNA, 3402 nt, synthetic construct
  misc_feature 1..3402: note = derived and/or modified CDS sequence (opt11) from SEOV(WuhanMm13)__JQ665886.1__GP
  source 1..3402: mol_type = other RNA
atgtggtcgcttcttcttttagccgccctcgtaggacagggctttgcacttaaaaacgtattcgacatgcgcattcagtgcccgcattccgtcaacttcggcgaaacctctgtatccggctacactgagttacctcccctcagcctccaagaggcagagcaactcgtcccagagtccagttgtaacatggataaccatcaatcactatccaccataaacaaactaaccaaagtcatatggcgcaagaaagcaaaccaggagtccgccaaccaaaacagcttcgaagtcatcgaatcagaagtcagcttcaaagggctctgtatgctcaaacaccggatggtcgaagaatcatatcgcaaccggcggagcgtaatctgttacgacctagcatgtaattcgaccttttgcaaacccaccgtatacatgatcgtccccatccacgcctgcaatatgatgaaaagctgcctcataggattaggaccataccgcatccaagtcgtttacgagcgcacatactgtactaccggaatactcacagagggcaaatgctttgtccccgacaaagccgtagtgtcggctctaaagcggggcatgtacgcagtagcatccatagaaactatatgcttcttcatacaccaaaagggaaacacctacaaaatagtaaccgcgatcacctccgccatgggatccaagtgcaacaacaccgacaccaaagttcagggctactacatctgcataatcggcgggaactcagcccctgtgtacgcccctgcgggagaggactttagggccatggaagtcttctcgggcatcataacctccccacacggcgaggaccacgacctaccaggcgaagaaatcgccacctaccagatttcaggacaaatcgaagccaaaataccacatacagtctcctccaaaaacctgaaactcacagccttcgccgggatcccatcatactccagcacatccatcctagctgcttcagaagacgggcgatttattttcagcccagggctgttccccaacctcaaccaatccgtctgcgacaacaacgccctcccactcatatggcgtggactgatagacctcacaggctactatgaggccgtccacccatgcaacgtcttctgcgtcctctcgggaccaggagcatcctgcgaagcattttccgaaggcgggattttcaacatcacaagtcccatgtgcctcgtaagtaagcaaaacagattccgcgccgccgagcaacaaatatcatttgtctgccaacgcgtcgacatggatattatcgtttactgcaacgggcaaaagaaaacaatacttaccaaaacgctagtcatcggtcaatgtatttacaccattacctccctctttagcctcctaccaggcgtcgcccactccatcgccatcgagctgtgcgtacccggattccacggatgggcgaccgccgccctcttaacaaccttctgcttcggctgggtactaatccccgcatgcaccctcgcgatcctcctagttctcaaattcttcgccaacatccttcacacctccaaccaggaaaaccgcttcaaagccatcctccggaagataaaagaagagttcgagaaaaccaaagggtccatggtatgcgaaatttgtaaatacgaatgcgaaacactgaaggaactgaaagcacacaatctcagctgcgtccaaggcgaatgcccctactgcttcacccactgcgaacccacagaaaccgcgatacaagcgcactacaaagtatgtcaagcgactcacagattccgtgaagatctaaagaaaaccgtaaccccacaaaacataggcccaggatgctatcgcaccctaaacttattccgctacaaatcacgctgctacatactaacgatgtggaccatcttgctcattatcgaatccatcctctgggccgcttcagcagccgaaatacccctagtccccctctggaccgataacgcacatggcgtcggatccgtccccatgcacaccgaccttgaactcgacttcagcctcccatcatcctccaaatatacgtacaaaaggcacctaactaaccccgtaaacgaccaacaaagcgtttcactacacatcgaaattgaatcacaagggatcggcgcggacgttcatcacctcgggcactggtacgatgctcgccttaatttaaagaccagcttccactgctacggcgcctgcaccaagtaccagtatccctggcacaccgccaaatgccacttcgagaaagactacgagtacgagaactcctgggcctgtaacccgcccgactgccccggggtaggcaccggctgtacagcctgtggcctctatctcgaccaactaaaaccagtcggaaccgccttcaaaatcatctccgtccgttactcacgcaaagtatgcgtacaattcggcgaggaatacctctgcaagacaattgacatgaacgactgcttcgtcacgcggcacgcgaagatttgcatcataggaacagtctccaaattcagccaaggtgacacactcctattccttggaccaatggaaggaggcggtataatctttaaacactggtgtacatccacttgccacttcggggacccaggggacgtcatgggtcctaaggacaagccattcatatgccccgagttccccggccaattcagaaagaaatgcaacttcgccacaacacccgtatgcgaatacgacggtaacataatctcaggatacaagaaagtcctcgccaccattgactcatttcagagcttcaacacctcaaatatccatttcactgacgaaagaatcgaatggagagacccagacggaatgctcagagatcacatcaacattgtaatatccaaagacatcgacttcgaaaacttagccgaaaacccctgcaaagtcggcttgcaagctgcaaatatagaaggcgcttggggctccggagtcggattcaccctcacatgccaagtctccctcaccgaatgccccaccttcctcacctcgataaaagcgtgcgacatggcgatctgctacggcgccgaaagcgtcaccctatcccgtggccagaacacagtgaaaataaccggcaagggtggccactccggatcatccttcaaatgctgccacggcaaggaatgctcaagcacgggcctccaagcctccgctccccacctcgacaaagtaaacggaatatcagaactagaaaacgaaaaagtctacgacgacggagcccccgaatgcggaattacatgctggttcaagaaatcgggtgaatgggtgatgggcatcatcaacggcaactgggtggtacttatcgccctctgtgtactcctcctcttctccctcatcctactctcgatcctctgccccgtacgcaaacacaagaaatcataa

SEQ ID NO: 15150 - RNA, 3402 nt, synthetic construct
  misc_feature 1..3402: note = derived and/or modified CDS sequence (opt11) from SEOV(WuhanMm24)__JQ665887.1__GP
  source 1..3402: mol_type = other RNA
atgtggagcttgctcctgctcgccgccctcgtgggccaggggtttgctttaaagaacgtcttcgacatgcgcatccagtgtccccacagcgtcaatttcggcgagactagcgtttccgggtacaccgagctgccgccccttagcctgcaggaggccgagcagctggtccccgagtcctcatgcaacatggacaaccaccaatccctctcaaccatcaacaagctcaccaaggtgatctggcgcaagaaggccaaccaggagtcagccaaccagaacagcttcgaggttatggaatccgaggtctcattcaagggcctgtgcatgctcaagcacagaatggtggaggagtcctatcggaaccgccggagcgtgatttgctacgacctagcctgcaactccaccttctgcaagccgaccgtctacatgatcgtgccgatccacgcgtgcaacatgatgaagtcctgcctcatcgggctcggcccctaccgcatccaggtggtctatgagaggacgtactgcaccaccggcatcctgaccgaaggcaagtgcttcgtgcccgacaaggccgtggtcagcgccttgaagcgcggcatgtacgccatcgcgtcaatcgagacaatctgcttcttcatccaccagaaggggaacacatacaagatagtgaccgccatcacctccgccatgggcagcaagtgcaacaacacggacaccaaggtgcaggggtactacatatgcatcatcggcggcaacagcgccccagtctacgccccggctggggaggacttccgggccatggaggtattctccggcatcatcaccagcccacacggggaggaccacgacctccccggcgaggagatcgccacataccagatctccggccagatcgaagctaagatcccgcacacggtgagctccaagaatctgaaattgaccgccttcgcggggatcccgagctactccagcacctccatcttagccgccagcgaggacggccgcttcatcttctcccccgggctgttccccaacctgaatcagagcgtctgcgacaacaacgccctacccctgatctggcggggcctgatcgacctcaccggctactacgaggccgtgcacccgtgcaacgtgttctgcgtcctgtccggccccggggcgtcctgcgaggccttctccgagggcgggatcttcaacatcacgagccccatgtgcctggtgtccaagcagaacaggttccgggccgccgagcagcagatcagcttcgtctgccagcgcgtggacatggacatcatcgtgtactgcaacgggcagaagaagaccatcctcaccaagaccctggtcattgggcaatgcatctacactatcacctccctgttcagcctcctgcccggggtggcccacagcatcgctatcgaactgtgcgtgccgggattccacggctgggccacagccgccttgctgatcaccttctgctttgggtgggtccttatccccgcgtgcacgctcgccattctgctggtgctcaagttcttcgcaaacatcttgcacacctccaaccaggaaaaccggttcaaggccatcctgcgcaagatcaaggaggagttcgagaagaccaagggcagcatggtctgcgagatctgcaagtacgagtgcgagaccctcaaggaactgaaggcccacaacctgtcctgcgtccagggggagtgcccctactgcttcactcactgcgagcccaccgagaccgcgatccaggcccactacaaggtatgccaggccacccacagattccgcgaggacctcaagaagacggtgacgccccagaacatcggccccggttgctaccggaccctgaacttattccgctacaagagccggtgctatatcctgaccatgtggaccctcctgctgattatcgagtctatcctctgggctgccagcgcggccgagatccccctcgtccccctgtggaccgacaacgcccacggcgtgggctccgtaccgatgcacaccgacctcgaacttgacttcagcctgccctccagctcccgctatacctacaagcgccatctcaccaaccccgtcaacgaccagcagagcgtgtccctgcacatcgagatcgagagccaggggatcggcgccgacgtgcaccacctggggcactggtacgacgcccgcctcaacctgaagacgtccttccactgctacggcgcctgcaccaagtaccagtacccgtggcacaccgcgaaatgccacttcgagaaggattacgagtatgagaacagctgggcatgcaacccgcccgactgtcccggcgtcgggacgggctgcacggcctgcgggttatacctcgaccagcttaagcccgtgggcaccgcgtttaagatcatcagtgtgcgctacagccggaaggtgtgcgtgcaattcggggaggagtacctgtgcaagaccatcgacatgaacgactgcttcgtgacccgccacgccaagatttgcatcatcggcacggtcagcaaattctcccagggcgacaccctcctgttcctggggcccatggagggcggcgggatcatcttcaaacactggtgcacctcgacgtgccacttcggggaccccggggacgtgatgggccccaaggacaagccgttcatctgccccgagttccccggacagttccggaaaaagtgcaacttcgcaacttcccccgtgtgcgagtacgacggcaacatcatcagcgggtacaagaaggtactagccaccatcgattccttccagagcttcaacacctccaacatccacttcaccgacgaacgcatcgagtggcgagatccggacggcatgttacgcgatcacatcaatatcgtgatcagcaaggacatcgacttcgagaacctggccgagaacccctgcaaggtcgggctccaagcggccaacatcgagggcgcctggggctccggggtcggctttacgctgacctgccaggtgagcctgaccgagtgccccacctttctcacgtccattaaggcctgcgacatggccatctgctacggggcggagagcgtgacgctgtcccggggccagaacaccgtcaagatcacggggaaaggcggccacagcgggtccagcttcaagtgctgccacggtaaggagtgctccctgacgggactacaggccagcgcgccccacctggacaaggtgaacggcatctccgagctcgagaatgagaaggtgtacgacgacggcgccccggagtgtgggatcacgtgctggttcaagaaatccggcgagtgggtcatgggtatcatcaacgggaactgggtcgtgctcatcgccctgtgcgtcctgctcctgttcagcctgatcctcctgagcatcctgtgccccgtgcgcaagcacaagaagtcctga

SEQ ID NO: 15151 - RNA, 3402 nt, synthetic construct
  misc_feature 1..3402: note = derived and/or modified CDS sequence (opt11) from SEOV(WuhanRf02)__JQ665888.1__GP
  source 1..3402: mol_type = other RNA
atgtggagcctgcttctcctcgccgctctggttggtcagggattcgccctcaaaaacgtattcgatatgaggatccagtgccctcattccgttaacttcggcgaaacatccgtctccgggtacaccgaactaccacccctatcactacaagaagccgagcagctcgtgccggaatcttcctgcaatatggacaaccatcaatcactctccaccatcaacaaactcaccaaagtcatctggcgaaagaaagccaatcaagaatccgccaaccaaaattccttcgaagttatcgaatcagaagtatccttcaaaggattatgcatgctcaagcaccgcatggtagaagaatcctacaggaaccgccgatccgtcatatgctatgacctagcatgcaactctactttctgcaaaccaaccgtgtacatgatagtcccaatccacgcctgtaacatgatgaaatcgtgcctcatcggccttggcccctaccgaatccaagtcgtatacgaacgtacctattgcaccacaggaatactgaccgaaggaaagtgcttcgtaccggacaaagccgtagtatcggccctaaaacgcggaatgtacgccgtcgcctcaattgaaaccatatgcttcttcatacaccaaaaaggaaacacctacaaaatagtcacggcaatcacatcagccatgggctccaaatgcaacaacaccgacaccaaggtacagggctactacatttgcatcataggaggcaacagcgcccccgtctatgcgcccgcgggtgaagacttccgcgcaatggaagtcttctccggaataataacaagtccccacggagaagaccatgacctgcccggtgaagaaattgccacctaccaaatctccggacagatagaggcaaaaatcccccacactgtcagctccaaaaaccttaaactcaccgcctttgccggaataccaagctacagcagcacaagcatcctcgccgcctccgaggacggacgcttcatattcagtccaggactcttccccaacttaaaccaatcagtctgcgacaacaacgccctcccactcatctggcgagggctgatcgacctcacaggatactacgaagctgtccatccttgcaacgtcttctgcgtcctatccggccccggtgctagctgcgaggccttcagtgaagggggcatattcaacataacctcacccatgtgcctagtttctaaacaaaacagattccgggctgcagaacaacgcatttcattcgtgtgccaacgagttgacatggacatcatcgtatactgcaacggccagaagaaaaccatactcaccaaaacactcgtaatcggtcaatgcatctacacgataacatctctgttttccctcctacctggcgtggcccactccatcgcaattgaactctgcgttccgggtttccacggatgggctaccgcggctctcttaacgactttttgtttcggctgggtactaattcccgcatgtactctagcaatactccttgtgctcaaattcttcgccaacatcttgcacacatccaaccaagaaaaccgcttcaaagctatactacgcaaaataaaagaagaatttgaaaagaccaaaggcagcgtcgtatgcgagatctgcaaatacgagtgcgagacgctcaaagaactcaaagcccacaatctgagctgcgtccaaggagaatgcccctactgcttcacccactgcgaacccactgaaaccgccatccaggcacactacaaggtctgtcaagccacacaccgattccgtgaagacctcaagaaaacagtcacaccccaaaacatcggcccaggttgctatcggaccctaaatctattcagatataacagccggcctgatggccttaccatgtggactctactactaataatcgaatccatcctctgggccgccagcgccgcggaaatccccctggtcccactttgggctgacaatgcacacggagttggctcagtcccgatgcacaccgacctagaactcgacttctctcttccaagcagctcaaaatacacttacaagcgacacctcacgaaccccgtcaacgaccaacagagcgtgtccctccatatcgagattgaatcccaaggaatcggcgccgatgtccaccaccttggtcactggtacgacgcccgactgaacctcaaaacctcattccactgctacggcgcctgtacaaaataccaatacccatggcacacagcaaagtgccacttcgaaaaagactacgaatacgaaaactcatgggcatgtaacccaccagactgccccggagtcggcaccggctgcaccgcctgtgggctctatctagaccaactgaaacccgtgggcactgccttcaagatcatctcagtccgatactccaggaaagtctgcgttcagttcggggaagaatacctgtgtaaaacaatcgatatgaacgattgctttgtaacgcgccacgcgaaaatatgcattatcggcacggtccccaaattctcccaaggcgacaccctcttattcctcggacctatggaaggtggcggtattattttcaaacactggtgcacatccacgtgccacttcggagacccaggcgatgtaatggggccgaaggacaagcccttcatccgcccggagttcccggggcaattccggaagaaatgcaacttcgcgaccaccccagtctgcggctatgacggcaacattatctcaggctacaagaaagtactcgcgaccatagatagcttccagtcttttaacacttcaaacatccatttcacagacgaaaggatagaatggcgtgacccggacggcatgcttcgcgaccacatcaacatcgtcatcagcaaagacatcgacttcgaaaacctcgcggaaaacccctgcaaagtaggcctccaggcggccaatatcgaaggcgcctggggctccggcgtaggcttcacgctcacgtgccaggtctccctcacagaatgtcctaccttcctgacatccataaaggcttgcgacatggcaatctgttacggggccgaatctgtcaccctctctagaggccaaaacacggtcaaaattacaggcaaaggaggacactcaggaagctccttcaaatgctgtcacggtaaagaatgctcaagcaccggcctgcaggcctccgctccccacctcgacaaagtgaacggcataagcgaactcgaaaacgaaaaagtctacgacgatggcgctccggagtgcggaatcacatgctggttcaagaaaagcggtgaatgggtgatgggcatcattaacggaaactgggttgtactgatcgccctctgcgtactcctcctctttagcctgatcctgctctcaatcctttgcccggtccggaaacacaagaaatcctga

SEQ ID NO: 15152 - RNA, 3402 nt, synthetic construct
  misc_feature 1..3402: note = derived and/or modified CDS sequence (opt11) from SEOV(WuhanRf07)__JQ665889.1__GP
  source 1..3402: mol_type = other RNA
atgtggagcctgctcctgctggccgccctcgtgggccaggggttcgcgctgaagaacgtcttcgacatgcgcatccaatgtccccacagcgtgaacttcggcgagaccagcgtgtccgggtataccgagctgccgcccctctctttgcaggaggccgagcagctggtccccgagtcctcctgcaacatggataaccatcaatccctcagcaccatcaacaagctgactaaggtgatctggcggaagaaggcaaaccaggaatctgcaaaccagaacagcttcgaggtgatcgagtccgaggtcagcttcaagggcctatgcatgctcaagcatcgtatggtggaggaatcctacaggaaccgccggagcgtgatatgttacgacctggcctgcaactccaccttctgcaaacccaccgtctacatgatcgtgccgattcacgcgtgcaacatgatgaagtcctgcctgatcgggctcggcccctatcgcatccaggtcgtatacgagcggacgtactgcaccaccggtatccttacagaggggaagtgcttcgtgcccgacaaggccgtggtcagcgctctcaagcgcggcatgtacgccgtggcgagcatcgagacgatctgcttcttcatccaccagaaggggaacacctacaagatcgtgaccgccatcacctccgccatgggcagcaagtgcaacaacacagacaccaaggtccaggggtactacatatgcataatcggcggcaacagcgcccccgtctacgcaccggcgggggaggacttccgggccatggaggtgttttccggcatcatcacctcaccccacggggaggaccacgacctcccaggcgaggagatcgccacttaccagatctccggccagatcgaggccaagatcccccacacggtctcctccaaaaacctgaagctgaccgccttcgcggggatcccgagctactccagcacctccatcctcgccgccagcgaggacggccgcttcatcttttcccccgggctgtttcccaacttgaaccagagcgtgtgcgacaacaacgccctccccctgatctggcggggcctgattgacctgacggggtactacgaggccgtgcacccgtgcaacgtcttctgcgtgctgtccggccccggcgcgagctgcgaagccttctccgagggcgggatcttcaacatcacgagccccatgtgcctggtctccaaacagaaccgcttccgggccgccgagcagcagatcagcttcgtatgccagcgcgtagacatggacatcatcgtctactgcaacggccagaagaagacaattctgaccaagaccctggtgatcggccagtgcatctacacgatcacctccctgttcagcctcctgcccggggtggctcacagcatagcgatcgagctgtgcgtcccaggcttccacggatgggccaccgccgccctcctgaccacgttctgctttgggtgggtgctgatccccgcgtgcaccctcgccatcctgctggtgctcaagttctttgccaacatcctgcacacctccaaccaggagaaccggttcaaggccattctgcgcaagatcaaggaggagttcgaaaagacaaagggcagcatggtctgcgagatctgcaagtatgagtgcgagacactcaaggagctgaaggcccacaacctgtcctgcgtgcagggcgagtgcccctactgcttcacccactgcgaacccaccgagaccgcgatccaggcccactacaaagtttgccaggccacgcaccggttccgcgaagaccttaagaagaccgtcaccccgcagaacatcggccccgggtgttaccggaccctgaacctgttccgctacaagagccggccgtacatactgaccatgtggacgatcctcctgatcatcgaatccattctgtgggccgccagcgcggccgagatccccctagtgccgctctggaccgacaacgcccacggcgtgggttccgtccccatgcacaccgacctggagctagacttcagcctgccctccagctccaagtacacctacaaacgccacctgacgaacccggtgaacgaccagcagtccgtgtccctccatatcgagattgagtcgcagggcatcggcgccgacgtccaccacctggggcactggtacgacgcccgtctgaacctcaagacctccttccactgctacggggcgtgtaccaagtaccagtacccctggcacaccgccaagtgccacttcgagaaggactatgagtacgagaacagctgggcctgcaacccgcccgactgccccggggtggggacgggctgcaccgcctgcgggctatatctggaccagctcaagcccgtgggtactgcgttcaagatcatcagcgtccggtacagccgcaaggtctgcgtgcagttcggggaggagtacctttgcaagacgatcgacatgaacgactgcttcgtcacgcggcacgccaagatctgcatcatcggcaccgtaagcaagttttcccagggcgacaccctcctcttcctagggccgatggagggcgggggcatcatcttcaaacactggtgtaccagcacgtgccacttcggggaccccggcgacgtgatgggcccgaaggacaagcccttcatctgccccgagttcccggggcagttccgtaagaagtgcaatttcgcgacgaccccggtctgcgaatacgacggcaacatcatctccgggtacaagaaggtgttagccaccatcgacagcttccagtccttcaacacgagcaacatccacttcaccgacgagcggatcgagtggcgcgatcccgacggcatgctccgggaccacatcaatatcgtgatctccaaggacatcgacttcgagaacctggccgagaacccctgcaaggtcgggctgcaggcggccaacattgaaggcgcctggggcagcggggtgggcttcaccctgacctgccaggtgtccctgacggagtgccctaccttcctgaccagcatcaaggcctgcgacatggccatctgctatggcgcggagtccgtcacccttagccgcggccagaacacggtgaagatcaccgggaagggcggtcactccggcagctccttcaagtgctgccacggtaaggagtgctcatccaccgggctgcaggccagcgccccgcacctggacaaggtgaacggcatctccgagctagagaacgagaaggtctacgacgacggcgcccccgagtgcgggataacgtgctggttcaagaagtccggcgagtgggttatggggatcatcaacggcaactgggtggtcctgatcgccctgtgcgtgctcctcctgttcagcctcattctgctgagcatcctctgccctgtgcggaagcacaagaaatcctaa

SEQ ID NO: 15153 - RNA, 3402 nt, synthetic construct
  misc_feature 1..3402: note = derived and/or modified CDS sequence (opt11) from SEOV(WuhanRf18)__JQ665893.1__GP
  source 1..3402: mol_type = other RNA
atgtggagcctgctcctgctggccgccctcgtgggccagggtttcgccctaaagaacgtcttcgatatgcgcatccagtgcccccactcagtgaacttcggagagacctccgtgtcagggtacaccgagctgccgcccctctccctacaagaggccgaacagctggtccccgagtcctcctgtaacatggacaaccaccagtccctcagtaccatcaacaagctgactaaagtgatctggcggaagaaggccaaccaggaatccgcgaaccagaacagcttcgaggtgatagagtccgaggtcagtttcaagggcctgtgcatgctaaagcatcgcatggtggaggagtcctatcggaaccgccggagcgtcatctgctacgacctggcctgcaactccacgttctgcaagcccaccgtctacatgatcgtcccgatccacgcgtgcaacatgatgaagtcctgcctgatcgggctcgggccctaccgcatacaggtggtttacgagagaacgtactgcaccacgggcatcctgacagaggggaagtgcttcgtgcccgacaaagccgtggtctccgccctgaagcgcggcatgtatgccgtggcgagcatcgagacgatctgcttcttcatccaccaaaagggaaacacctacaagattgtaaccgcgatcacctccgccatgggcagcaagtgtaataacacagacaccaaggtccaggggtactacatctgcatcatcggtggcaacagtgccccagtgtacgcacccgcgggggaagacttccgggccatggaagtcttctccggcatcatcaccagcccccacggtgaggaccacgacctccccggcgaggaaatcgccacgtaccagatctccggccagatcgaggccaagatcccccacacggtcagctccaagaatctaaagttgaccgccttcgcggggatcccgagctactccagcaccagcatactcgccgccagtgaggatggacgcttcattttctcccccgggctgttccccaacctgaatcagagcgtgtgcgacaacaacgcgctccccctgatttggcggggtcttatcgacctcaccgggtactacgaggccgtgcacccgtgcaacgtcttttgcgtcctctccggccccggcgcgagctgcgaggcattctccgagggcgggattttcaatatcacgagcccgatgtgcctggtctccaagcagaaccgcttccgggccgccgagcagcgcatcagcttcgtgtgccagcgcgtggacatggacataatcgtctactgcaacgggcaaaagaagaccatcctcaccaaaaccctggtgataggccagtgcatctacacgatcacttccctgttctcactcctgccaggggtggctcacagcatcgcgatcgagctgtgcgtcccgggcttccacggatgggccaccgccgccctcctgaccacgttctgttttgggtgggtcctcatccccgcgtgcaccctcgccatcctgctggtgctcaagttcttcgcgaacatcctgcatacctccaaccaggagaaccgattcaaggccatcctgcggaagataaaggaggaatttgagaaaacaaagggcagcatggtctgcgagatctgcaagtacgagtgcgaaaccctcaaggagctaaaggcccataacctgtcctgcgtgcagggagagtgcccctactgtttcacccactgtgagcccaccgagaccgcgatccaggcccactacaaggtgtgccaggccacgcaccgcttccgagaggacctcaagaagaccgttaccccgcaaaacatcggccccgggtgctatcgcaccctgaaccttttccggtacaaaagccgctgctacatcctaaccatgtggacgatccttctcatcatcgagagcatcctgtgggccgccagcgcggccgagatcccgctcgtgcccctgtggaccgataacgcccacggcgtgggctccgtcccgatgcacaccgacctggagctcgatttctccctaccctccagctcgaagtacacctacaagcgccacctcacgaaccccgtaaacgaccagcagagcgtgtcccttcacatcgaaatcgagagccaggggataggcgccgacgtccaccatctgggacactggtacgacgcccggctaaaccttaaaacgtccttccactgctacggcgcgtgcaccaagtatcagtacccgtggcacaccgccaagtgccacttcgagaaagactatgagtacgaaaacagctgggcctgcaacccgcccgactgccccggcgtggggacgggctgcaccgcctgcgggctgtacctggaccagctcaagcccgtgggcaccgcgttcaagatcatctccgtccggtatagccggaaggtatgcgtgcagttcggggaggagtacctttgcaagactatcgacatgaacgactgcttcgtcacgcgccacgccaaaatttgcatcatcggcaccgtgagcaagttctcccagggcgacacgctcctcttcctgggccccatggagggcggcgggatcatcttcaagcactggtgcactagcacgtgccacttcggggacccaggggacgtgatggggcccaaggacaagccgttcatctgcccggagttccccgggcaattccggaagaagtgcaacttcgccactacccccgtttgcgagtacgacggaaacatcatctccgggtacaagaaggtgctggcaaccatcgactccttccagtccttcaacacgagcaacatccatttcacagacgagcgcatcgagtggcgggacccggacggcatgctccgcgaccacatcaacatcgtgatctccaaggacatcgacttcgagaacctggccgagaacccctgcaaggtcgggctgcaggcggccaacatcgagggcgcctggggtagcggggttggcttcaccctgacctgtcaggtgtccctgactgagtgccctacgttccttacctcgatcaaggcctgcgatatggccatctgctacggtgcggagtccgtcaccctcagccggggccagaacacggtgaaaatcaccggcaaagggggccacagcgggagctcctttaagtgctgtcacggcaaggaatgcagctccaccgggctacaggccagcgcgccccacctggacaaggtgaacggcatctccgagctcgagaacgagaaagtctacgacgacggggccccggagtgcgggatcacgtgctggttcaagaagtccggcgagtgggtgatggggatcataaacggcaactgggtggtcctaattgccctttgcgtgctcctgctgttcagcctcatcttgctgagcatcctctgccccgtccgcaagcacaagaagagttga

SEQ ID NO: 15154 - RNA, 3402 nt, synthetic construct
  misc_feature 1..3402: note = derived and/or modified CDS sequence (opt11) from SEOV(WuhanRn10)__JQ665896.1__GP
  source 1..3402: mol_type = other RNA
atgtggagcctgctcctgctggccgccctcgtggggcaggggttcgccctgaagaacgtcttcgacatgcgcatccaatgcccccactccgtgaacttcggcgagaccagcgtgtccgggtacaccgagctgccgcccctcagcctgcaggaggccgagcaactggtccccgaatccagctgcaacatggacaaccaccagtccctcagcaccattaacaagctgaccaaggtgatctggcgaaagaaggccaaccaggagtccgccaaccagaacagcttcgaggtgatcgagtccgaggtcagcttcaagggcctgtgcatgctcaagcaccgcatggtcgaagagtcctaccggaaccgccggtccgtgatctgttacgatttggcctgcaattccaccttctgcaagcccaccgtctacatgatcgtgccgatccacgcgtgcaacatgatgaagtcctgcctgatagggttgggcccctaccgcatacaggtggtctacgagcggacgtactgcaccaccggcatcctgaccgaggggaagtgtttcgtgcccgacaaggccgtggtcagcgccctgaagcgcggcatgtacgcggtggcgagcatcgagacgatctgcttcttcatccaccagaaggggaacacctacaagatcgtgacggccatcacctccgccatgggcagcaagtgcaacaacacggacaccaaagtccagggatactacatctgcataatcggcggaaatagcgcccccgtgtacgctccggcgggggaggacttccgggccatggaggtgttctccggcatcatcaccagcccccacggggaggaccacgacctccccggcgaggagatcgccacctaccagatctccggacagatcgaggccaagatcccccacacggtcagctccaaaaacctgaagctgaccgctttcgcggggataccgagctactccagcacctcgatcctcgccgccagcgaggatggccgcttcatcttctcccccggtctgttccccaacttaaaccagagcgtgtgcgacaataacgccctgccgctgatctggcggggcctgatcgacctcaccgggtactatgaggccgtccacccgtgcaacgtcttctgcgtgctgtcggggcccggcgcgagctgcgaggccttctccgagggcgggatcttcaacatcaccagccccatgtgcctggtctccaagcagaatcgcttccgggccgccgagcagcagatcagcttcgtgtgccagcgcgtagacatggacataatcgtctactgcaacgggcagaagaagaccatcctcaccaagaccctcgtaatcggccagtgcatctacacgatcacctccctgttcagcctgctccccggggtggcccactccatcgcgatcgagctgtgcgtcccgggctttcacggctgggccaccgccgccctgctgaccacgttctgcttcgggtgggtgctgatccccgcgtgcacactcgccattctgctggtgttaaagttcttcgccaacatccttcatacctcaaaccaggagaaccggttcaaggccatccttcgcaagatcaaagaggagttcgagaaaaacaaaggaagcgtcgtgtgcgagatatgcaagtacgagtgcgagaccctcaaggagctgaaggcccataacctgtcctgcgtgcagggggagtgcccctactgcttcacgcactgcgagcccactgagacggcgatccaggcccactacaaggtctgccaggccacccaccggttccgcgaggacctcaagaaaaccgtgaccccgcagaacatcggccccggatgctaccgcaccctgaacctgttccgctacaagagccggtgctacatcctgaccatgtggaccattctcctgatcatcgagagcatcctgtgggccgctagcgcggccgagatccccctcgtccccctgtggacggacaacgcccacggcgtcggctcagtgcctatgcacactgacctggagctcgacttcagcctgccctccagctccaagtacacctacaagcgccacctgaccaaccccgtgaacgaccagcagagcgtctccctccacatcgaaatcgaaagccaggggatcggcgccgacgtgcaccacctgggacactggtacgacgcccgcctgaacctcaagacgtccttccactgctacggcgcgtgcaccaagtaccagtacccgtggcacaccgccaagtgccactttgagaaggactacgagtacgagaacagctgggcctgtaacccgcccgactgccccggggtggggaccggctgcacggcctgcgggctgtacctggaccagctcaaaccagtcgggaccgcgttcaagatcatctccgtgcggtacagccgcaaggtgtgcgtacagttcggggaggagtacctgtgcaagaccatcgacatgaacgactgcttcgtgacccggcacgccaagatctgcatcatcggcacggtgagcaagttctcccagggcgacactctcttattcctggggcccatggagggtgggggcatcatcttcaagcactggtgtaccagcacgtgccatttcggggaccccggagacgtcatgggacccaaggacaagccgttcatctgccccgagttccccggccagttccgaaagaagtgtaacttcgcaaccacccccgtctgcgagtacgacggcaacatcatcagcgggtacaagaaggtgctggccaccatcgacagcttccagtccttcaacaccagcaacatccacttcacagacgagcggatcgagtggcgtgacccggacggcatgctacgggaccatatcaacatcgttatatccaaggacatcgacttcgagaatctggccgagaacccctgcaaggtggggctgcaggcggcgaacatagagggcgcctggggcagcggggtcggctttacccttacctgccaggtctcgctaaccgagtgccccacgttcctgaccagcatcaaggcctgcgacatggctatatgctacggggcggagtccgtgaccctcagccgcggccagaacaccgtgaagatcacggggaagggcggccactccgggagctccttcaagtgctgccacggcaaggagtgcagctccacaggactgcaggccagcgcgccccacctagacaaggtcaacggcatcagcgagctcgagaacgagaaggtgtacgatgacggtgcaccggagtgcgggatcacgtgctggttcaagaagtccggcgagtgggtgatggggatcatcaacggcaactgggtcgtgttgatcgccctgtgcgtgctcctcctgttcagcctcatcctgctgagcattctctgccccgtccggaaacataagaagtcctga

SEQ ID NO: 15155 - RNA, 3402 nt, synthetic construct
  misc_feature 1..3402: note = derived and/or modified CDS sequence (opt11) from SEOV(WuhanRn25)__JQ665897.1__GP
  source 1..3402: mol_type = other RNA
atgtggagcctactcctgctggccgcactcgtaggccaggggttcgccttaaagaacgtcttcgacatgcgcatccaatgcccccacagcgtgaacttcggcgagaccagcgtctccgggtacaccgagctgccgcccctctcgctgcaggaggccgagcaactggtccccgagtccagctgtaacatggacaatcaccaatccctcagcaccattaacaagctgaccaaggtgatctggcggaagaaggccaatcaggaatcggccaaccagaacagcttcgaggtgatcgagtccgaggtcagcttcaagggcctgtgcatgctcaagcaccgcatggtggaagagtcataccggaaccgccggagcgtaatctgctacgacctggcctgcaactccaccttctgcaaacccaccgtctacatgatagtgccgatccatgcgtgtaacatgatgaaatcctgcctgatcgggctcggcccctaccgtatccaggtggtatacgagcggacgtactgcaccaccggcatcctaaccgagggcaagtgcttcgtgccggacaaggccgtggtcagcgcgctgaagcggggcatgtatgccgtcgcgagcatcgagacgatctgcttcttcatccaccaaaaggggaacacctacaagatcgtgaccgccatcaccagtgccatgggcagcaaatgcaacaacactgacaccaaggtccaagggtactatatctgcatcatcggcggcaacagcgcccccgtctatgccccggcgggggaggatttccgagccatggaggtattctccggcatcatcaccagcccccacggcgaggaccacgacctccccggcgaggagatcgccacctaccagatctccggccagatcgaggccaagatcccccacacggtcagctccaagaacctgaagctgaccgccttcgcggggatcccgtcttactcctcgaccagcatcctcgccgccagcgaggacggccgctttatcttctcccccgggctgttcccgaacttaaaccagagcgtgtgcgacaacaacgcactccccctgatctggcggggcctgatcgaccttaccgggtactacgaggccgtgcacccgtgcaacgtcttctgcgtgctgtccggccccggcgcgagctgcgaggccttttcggagggcgggatctttaacataacgagccccatgtgcctggtctccaagcaaaaccggtttagggccgcggaacaacagatcagcttcgtttgccagcgcgtggacatggacatcatcgtctactgcaacggccagaagaagaccatcctcaccaagaccctggtgatcggccagtgcatctacacaatcacctccctgttctcattattacccggggtggcccatagcattgcgatcgagctgtgcgtcccgggcttccacggctgggctaccgccgccctcttaaccactttctgtttcgggtgggtgctgatccccgcgtgcaccctcgccatcctcttagtgctcaaattcttcgccaacatcctacacacctccaaccaggagaacaggtttaaggccatcctacgcaagatcaaggaagagttcgagaagaacaagggcagtatggtctgcgagatttgcaagtacgagtgtgagaccttgaaggagctgaaggcccacaacctgtcctgcgtgcagggggaatgcccctactgctttacgcactgcgagcccaccgagaccgcgatccaggcccactacaaagtctgccaggccacccaccggttccgcgaggacctgaaaaagactgtcacaccccagaacatcggtccagggtgctatcggaccctaaacctgtttcgctacaagagccggtgctatattctgaccatgtggaccatcctactgatcattgagagtatcctgtgggccgccagcgcggcagagatccccctcgtgcccctgtggaccgacaacgcccacggggtgggctccgtccctatgcacaccgacctggaactcgacttcagccttccctccagctccaagtacacctacaagcgacatctgaccaaccccgtgaatgaccagcagagcgtgtccctccacatcgaaattgagagccaggggatcggtgcggacgtccaccacttggggcactggtacgacgcccggttgaacctcaagacgtccttccactgctacggcgcgtgcaccaaataccagtacccgtggcataccgccaagtgccacttcgagaaggactacgagtacgagaactcatgggcctgcaacccgcccgattgccccggcgtggggaccggctgcactgcctgtgggttgtacctggaccagctcaagcccgttgggaccgcgtttaagatcatctccgtccggtactcacgcaaggtatgcgtgcagttcggcgaggagtacctgtgcaagaccatcgacatgaacgactgcttcgtcacccggcacgccaagatctgcataattggcacagtgagcaagttttcccagggcgacaccttactcttcctggggcccatggaagggggcggcataatcttcaagcactggtgcacctctacttgtcactttggggaccccggcgacgtgatgggacccaaggacaagccgttcatctgcccggagttccccgggcagttccgcaagaagtgtaacttcgccaccacccccgtctgcgagtacgatggcaacatcatatccgggtacaagaaggtgttagccacgatcgatagctttcagagtttcaacactagcaatatccatttcacggacgagcggatcgagtggcgcgatcctgacggcatgcttcgggaccacatcaacatcgtgatctccaaggacatcgatttcgagaacctggccgaaaacccctgcaaggtcgggctgcaagcggccaacatcgagggcgcctggggcagcggggtgggctttaccctgacctgccaggtgtccctgaccgaatgtccgacgttcctgacaagcatcaaggcctgcgacatggccatttgttacggggcggagtccgtcaccctcagccgcggccagaacacagtcaagatcacggggaagggcggccattcagggtcatcctttaagtgctgccacggcaaggagtgcagctccaccgggctgcaggcctctgcaccccacctggataaggtgaacggcatctccgagctcgaaaacgagaaagtctacgacgacggcgccccggagtgcgggatcacgtgttggttcaagaaatccggcgagtgggtgatggggatcatcaacggcaattgggtggtcctgatcgccctgtgcgtgctcctgctgttcagcttaatcctcctgtcgatcctttgccccgtgcggaagcacaaaaagtcctga

SEQ ID NO: 15156 - RNA, 3402 nt, synthetic construct
  misc_feature 1..3402: note = derived and/or modified CDS sequence (opt11) from SEOV(XiaotangshanRn7)__GU592929.1__GP
  source 1..3402: mol_type = other RNA
atgtggagcctcctcttcctggccgcattggtgggccaggggtttgccctcaagaacgtcttcgacatgcgcatccagtgcccgcacagcgtgaacttcggcgagacaagcgtgtccgggtacaccgagctgccgcccctgagcctacaggaggccgagcagctggtgcccgagtccagctgcaacatggacaaccaccagtccctgagcacgatcaacaagctcaccaaggtgatctggcggcgcaaggccaaccaggagtcggccaaccagaacagcttcgaggtcgtcgagtccgaggtgagcttcaagggcctgtgcatgctcaagcaccggatggttgaggagtcctaccgcaaccggcgcagcgtcatctgctacgacctcgcctgcaactcgaccttctgcaagcccacggtgtacatgatcgtgccgattcacgcgtgcaacatgatgaagtcctgcttgatcgggctgggaccctaccggatccaggtcgtgtacgaacgcacgtactgcaccacaggaattttgaccgaagggaagtgctttgtgcccgacaaggccgtcgtgagcgccctgaagcggggcatgtacgcaatcgcgagcatcgagacgatatgcttctttatccaccagaaggggaacacctacaagattgtaaccgccataacctccgccatgggcagcaagtgcaacaacacggacaccaaggtccagggttactacatctgcatcatcggcggcaacagcgcccccgtgtatgccccggcgggggaggactttcgcgctatggaggtgttctccggcatcatcaccagcccgcacggggaagaccacgacctgcccggcgaggagatcgccacctaccagatctccggccagatcgaggccaagatcccccacacagtcagctccaagaacctcaagctaaccgccttcgcggggatcccgagctactccagcacctccatcctggccgccagcgaggacggccggttcatattttccccggggctgttccccaacctgaaccagagcgtgtgcgacaacaacgccctgcccctcatctggcgcggcctgatagacctgaccgggtactacgaggccgtgcacccgtgcaacgtcttctgcgtactctccggccccggcgcgagctgcgaggccttctccgagggcgggattttcaacatcacgagcccgatgtgcctggtctccaagcaaaaccggttccgcgccgccgagcagcagatcagcttcgtctgccagcgggtggacatggacatcatcgtctactgcaacgggcagaagaagaccatcctgaccaaaaccctcgtgatcggccagtgcatctacacaatcacctccctgttcagcctgcttcccggggtggcccacagcatcgcgattgagctgtgcgtcccgggcttccacggctgggccaccgccgccctgctcatcaccttctgcttcggatgggtgctgatccccgcatgcactctggccatcctcctggtgctgaagttcttcgccaacatcctccacacctccaatcaggagaaccgcttcaaggcgatcctgcggaagatcaaggaggagtttgagaagaccaagggcagcatggtctgtgagatctgcaagtacgaatgcgagaccttgaaggagctcaaagcccacaacctgtcctgcgttcagggggagtgcccctactgctttacgcactgcgagcccaccgaaaccgcgatccaggcccactacaaggtatgccaggccacccacagattccgggaggacctgaagaagacggtcacaccgcagaacatcggccccggatgctaccgcaccctcaacctgttccggtacaagagccgctgttacatcctgaccatgtggaccctgctcctaatcatcgagtccatcctgtgggccgccagcgcggcagagatccccctcgtgcccttatggacggacaacgcccacggcgtgggctccgttccgatgcacaccgacctggagctcgacttcagcctgccctccagctccaagtatacctacaagcgccacctgaccaaccccgtgaacgaccagcagagcgtgtccctccacatcgagattgagtcacaggggatcggcgccgacgtccaccaccttgggcactggtacgacgccagattaaacctcaagacatccttccactgctacggcgcgtgcaccaagtaccagtacccgtggcacactgccaagtgccatttcgagaaggactacgagtacgagaacagctgggcctgcaacccgcccgactgcccaggagtggggacaggctgcacggcctgcgggctgtacctggaccagctaaagcccgtgggcaccgccttcaagatcatctccgtccgctactctcggaaggtgtgcgtccagttcggtgaggagtacctgtgcaagaccatcgacatgaacgactgcttcgtcactcgccacgccaagatctgcatcatcggcacggtgagcaagttctcccagggcgacaccctcctcttcctggggcccatggagggcgggggcatcatcttcaagcactggtgcaccagcacgtgccacttcggggaccccggcgacgtgatgggccccaaggacaaaccgttcatctgccccgagtttcccgggcagttccggaagaagtgcaacttcgccaccactcccgtatgcgagtacgacggcaacatcatctccgggtataagaaggtgctggcgaccatcgacagcttccaatccttcaacaccagcaacatccactttacggacgagcgcatcgagtggcgggacccggacggcatgctacgcgaccacataaacatcgtgatctccaaggacatcgacttcgagaacctggccgaaaatccctgcaaggtcgggttacaggcggccaacatcgagggtgcgtggggcagcggtgtgggcttcaccctgacatgccaggtgtccctgaccgagtgccccacgttcctgaccagcatcaaggcctgcgacatggccatttgctacggggcggagtccgtcaccctcagccggggccagaacactgtcaagataacggggaagggcggccactccggtagctccttcaagtgctgccacggcaaggagtgcagctcgaccggtctgcaggcctccgcgccccatctggacaaggtgaatggcatctccgagctcgaaaacgagaaggtttacgacgacggcgccccggaatgcggggtgacctgctggttcaagaagtccggtgagtgggtgatggggatcatcaatggcaactgggtcgtgctgatcgtcctgtgcgtcctcctgctgttcagcctcatcctgctgagcatcctatgccccgtgcgcaagcacaagaaatcctga

SEQ ID NO: 15157 - RNA, 3402 nt, synthetic construct; identical to SEQ ID NO: 11871
  misc_feature 1..3402: note = derived and/or modified CDS sequence (opt11) from SEOV(YongjiaRf45)__GU592926.1__GP
  source 1..3402: mol_type = other RNA

SEQ ID NO: 15158 - RNA, 3402 nt, synthetic construct
  misc_feature 1..3402: note = derived and/or modified CDS sequence (opt11) from SEOV(YongjiaRn14)__GU592927.1__GP
  source 1..3402: mol_type = other RNA
atgtggggcctgctcctgctggccgccatggtggggcagggcagcgcgctcaagaacgtctttgacatgaagatccagtgtccccacagcgtgaacttcggggaaaccagcgtgtccggctacaccgagctgccgcccttacccctccaagaggccgagcagctggtccccgagagctcttgcaacatggacaaccaccagagcctgtccacgatcaacaagctcaccaaggtaatttggcggaagaaggccaaccaggaaagcgccagtcagaactcattcgaggtggtcgagtccgaggtgagcttcaaggggctgtgcatgctgaagcaccggatggtagaggagtcctaccggaaccgccgcagcgtcatctgctacgacctcgcctgcaacaccaccttctgcaagccgaccgtgtacatgatcgtgcccatccacgcgtgcaacatgatgaagtcctgcctgatcggcttgggcccctaccggatccaggtcatctacgagcgcacctactgcaccaccgggatcctcacggagggcaaatgcttcgttcccgacaaggccgtggtcagcgcgctgaagcgggggatgtacgccatcgcgtccatcgagaccgtatgcttcttcgtgcaccaaaagggcaacacctacaagattgtcaccgccatcacgagcgccatgggttcgaagtgcaacaacaccgacagtaaggtgcaaggctactacatctgcatcatcggcgggaacagcgccccggtgtatgcccccgcgggcgaggacttccgcgccatggaggtcttctccggtatcatcaccagcccccacggcgaggatcacgacctgcccggcgaggaggtggccacctaccagatctccgggcagatcgaggctaagatcccacacactgtgagctccaagaacctcaagctgaccgcgttcgcgggcatccccagctactccagcacatccctgctcgccgccagcgaagacgggcggttcattttctcccctggcctgttccccaacctgaaccagagcgtctgcgataacaacgccctcccgctgatctggcgcgggctgatcgacctcaccggctactacgaggccgtgcacccgtgcaacgtcttctgcgtgctgtccggccccggggcgagctgcgaggccttttccgaaggcgggatcttcaacatcacgagccccatgtgcctggtgtccaagcagaaccggttccgtgccgcggagcagcagatcagcttcatttgccagcgggtcgacatggacatcatcgtgtactgcaatggccagaagaagaccatcctcaccaagaccctggtgatcgggcagtgtatctacacgatcacctctctgttcagccttctcccgggcgtcgcccatagcatcgcgatcgaactgtgcgtgcccggcttccacgggtgggccaccgcagctctcctgatcacattttgctttggctgggtgctgatccccgcgtgcacgctcgcggtcttactgttcctcaagtttttcgccaatatcctgcacacctccaaccaggagaaccgcttcaaggccatcctccggaagatcaaggaggagttcgaaaagaccaaggggagcatggtgtgcgaaatctgcaagtacgagtgcgagaccctcaaggagctgaaagcccacaacctgtcctgcgtgcaaggcgagtgcccctactgctttacgcactgcgagccgaccgagaccgcgatccaggcccactacaaggtgtgccaggccacccaccgcttccgggaggacctcaagaagacggtgacgccccagaacatagggcccggctgctaccgcaccctgaacctgttccggtacaagagccgatgctacatcctgaccatgtggatcctcctgctggtcatcgagagcatcctctgggccgccagcgcggccgagatccccctagtcccgctgtggacggacaacgcccacggcgtgggctcagtgcccatgcacaccgacctcgagctggacttcagcctgccctccagctccaagtacacctacaagcggcacctcaccaacccggtcaacgaccagcagagcgtgtcactgcacatcgagatcgaaagccagggcatcggggcggacgtgcaccacttaggccactggtacgacgcccgcctcaacctgaagacctccttccactgctacggcgcgtgcacgaagtaccagtacccctggcacaccgccaagtgccacttcgagaaggactacgagtacgagaacagctgggcctgcaacccacccgactgccccggggtcggcaccgggtgcaccgcgtgcggcctgtatctcgaccagctgaagccagtggggacagcgttcaagatcatctccgtccgctacagccggaaggtctgcgtgcaattcggcgaggagtacctttgcaagaccatcgatatgaacgactgcttcgtgacccgccatgccaagatctgcatcatcggcaccgtcagcaagttctcccagggggacacgctcctgttcctgggccccatggaaggcggcgggatcatctttaagcactggtgcaccagcacttgccattttggggaccccggcgacgtgatggggccgaaggataagcccttcatctgccccgagttccccggacagttccggaagaagtgcaacttcgctaccaccccggtgtgcgagtacgacgggaacgtcatctccggctaccggaaggtgctcgccaccatcgacagcttccagtccttcaacaccagcaatgtgcacttcaccgacgagaggatcgaatggcgcgatcccgacgggatgctgcgggaccacatcaatatcgtcatctccaaggacatcgacttcgagaacctggccgagaacccctgcaaggtgggcctccaagcggccaacatcgagggcgcctgggggagcggggtggggttcacgctgacctgccaggtctccctgaccgagtgccccaccttcctcacgtcaatcaaggcctgcgacatggccatctgctacggcgcagagtccgtgaccctgagtcgcgggcagaacaccgtgaagatcaccggcaagggcggccattccggcagctccttcaagtgctgccacgggaaggagtgctccagtaacggcctgcaggcctcagccccgcacttggacaaggtcaacggcatttccgaactggagaacgaaaaggtgtacgacgacggggcccccgagtgcggcatcacgtgctggttcaaaaagagcggggagtgggtgatgggcatcatcaacggcaactggatagtcctcatcgtgctatgcgtgctgctcctgttctcgctgatcctgcttagcatcctctgtcccgtacggaagcacaagaagtcctga

SEQ ID NO: 15159 - RNA, 3402 nt, synthetic construct
  misc_feature 1..3402: note = derived and/or modified CDS sequence (opt11) from SEOV(ZT10)__DQ159911.1__GP
  source 1..3402: mol_type = other RNA
atgtggagcctgctactgctggccgccctcgtgggccaggggttcgccctgaagaacgtcttcgatatgcgcatccagtgcccccactcagtgaacttcggcgagaccagcgtgtccgggtacaccgaactgccgcccctcagcctgcaggaggccgaacagctggtccccgagtccagctgcaacatggacaaccaccagtccctcagcaccatcaacaagctgaccaaggtgatttggcggaagaaggccaaccaggagtccgccaaccagaacagcttcgaggtggtcgagtccgaagttagcttcaagggcctgtgcatgctcaagcaccgcatggtggaggagtcctaccggaaccgccggagcgtcatctgctacgacctggcctgcaactccaccttctgcaaacccaccgtgtacatgatcgtgccgatccacgcgtgcaacatgatgaagtcctgccttatcgggctcggcccctaccgcatccaggtcgtgtacgagcggacgtactgcaccaccggcatcctgaccgaggggaaatgcttcgtgcccgacaaggccgtcgtgagcgccctgaagcgcggcatgtacgccatcgcgagcatcgagacgatctgcttcttcatccaccagaaggggaacaagtacaagatcgtgaccgccatcacctccgccatgggcagcaagtgcaacaacaccgacacgaaggtccaggggtactacatctgcatcatcggcggcaacagcgcccccgtgtacgccccggcgggggaggactttcgggccatggaggtgttctccggcatcatcaccagccctcacggggaggaccacgacctccccggcgaggagatcgccacctaccagatctccggccagattgaggccaagatcccccacacggtcagctccaaaaacctgaagctgacggccttcgcggggatcccgagctactccagcacctccatcctcgcggccagcgaggacggccgcttcatcttctcccccgggctgttccccaacctgaaccagagcgtgtgcgacaacaacgccttacccctgatctggcgcggcctgatcgacctcaccgggtactacgaggccgtgcacccgtgcaacgtgttctgcgtgctgtccggccccggcgcgagctgcgaggccttctccgagggcggaatcttcaacatcaccagccccatgtgcctagtctccaagcagatccgcttccgggccgccgagcagcagatcagcttcatctgccagcgcgtggacatggacatcatcgtgtactgcaacgggcagaagaagacgatcctcacgaagaccctggtcatcggccagtgcatctacactatcacgtccctgttcagcctcctccccggggtggcccacagcatcgcgatcgagctatgcgtgccgggcttccacggctgggccaccgccgccctcctcatcaccttctgcttcgggtgggtcctgatccccgcatgcacgctcgccatcctgctggtgctcaagttcttcgccaacatcctgcacacgtccaaccaggagaaccggttcaaggccatcctgcgcaagatcaaggaggagttcgagaagaccaagggcagcatggtgtgcgagatctgcaagtacgagtgtgagaccctaaaggagctgaaggcccacaacctgtcctgcgtccagggggagtgcccctactgcttcacccactgcgagcccacggagaccgcgatccaggcccactacaaggtgtgccaggccacccaccggttccgagaggacctcaagaagaccgtgacgccgcagaacatcggccccgggtgctatcggacactgaacctgttccggtacaagtcccggtgctacatcctgacaatgtggaccctcctgctgatcatcgagtccatcctctgggctgccagcgcggccgagatccccctggtccccctgtggaccgacaacgcccacggcgtgggctccgtgccgatgcacacggacctcgagctggacttcagcctgccctccagctccaagtacacctacaaacgccacctcactaaccccgtcaacgaccagcagagcgtgtccctgcacatcgagatcgagagccaagggatcggcgccgacgtccaccacctggggcactgctacgacgcccgcctcaacctgaagacctccttccactgttacggcgcgtgcacgaagtaccagtacccgtggcacaccgccaagtgccacttcgagaaggactacgagtacgagaacagctgggcctgcaacccgcccgactgccccggtgtcgggaccggctgcaccgcctgcgggctgtacctcgaccagctgaagcccgtgggcacggcgttcaagatcatctccgtgcggtacagccgcaaggtctgtgtgcagttcggagaggagtacctgtgcaagacaatcgacatgaacgactgcttcgttacccggcacgccaagatctgcatcatcggcaccgtcagcaagttttcccagggcgacacgctcctgttcctggggccgatggagggcgggggaatcatcttcaagcactggtgcacctccacgtgccacttcggggaccccggcgacgtgatgggtcccaaggacaagccgttcatctgccccgagttccccgggcagttccgcaagaagtgcaacttcgccaccaccccggtgtgcgagtacgacggaaacatcatctccggatacaagaaggtactcgccaccatagacagctttcagtccttcaacaccagcaacatccacttcaccgacgaacggatcgagtggcgcgacccggacggcatgctgcgggaccatatcaacatcgtgatctccaaggacatcgacttcgagaatctggccgagaacccctgcaaggtggggctccaggcggccaacatcgagggcgcctggggcctgggggtcggcttcacgctgacctgccaggtgagcctcaccgagtgccccaccttcttgacgtccatcaaggcctgcgacatggccatctgctatggggcggagagcgtgaccctgtcccgcggccagaacaccgtcaaaatcaccgggaagggtgggcacagcgggtccagcttcaagtgctgccacggcaaggagtgctccagcacggggctccaggcctccgcgccccacctggacaaggtgaacggcatcagcgagctggagaacgagaaggtgtacgacgacggcgccccggagtgcgggatcacgtgctggttcaagaagtccggcgaatgggtcatggggatcatcaacggcaactgggtggtgctcatcgtcctgtgcgtactgctcctgttcagcctgatcctcttgagcatcttatgccccgttcgaaagcacaagaagtcctga

SEQ ID NO: 15160 - RNA, 3402 nt, synthetic construct; identical to SEQ ID NO: 11874
  misc_feature 1..3402: note = derived and/or modified CDS sequence (opt11) from SEOV(ZT71)__EF117248.1__GP
  source 1..3402: mol_type = other RNA

SEQ ID NO: 15161 - RNA, 3402 nt, synthetic construct; identical to SEQ ID NO: 11875
  misc_feature 1..3402: note = derived and/or modified CDS sequence (opt11) from SEOV(DN2)__KX289953.1__GP
  source 1..3402: mol_type = other RNA

SEQ ID NO: 15162 - RNA, 3402 nt, synthetic construct
  misc_feature 1..3402: note = derived and/or modified CDS sequence (opt11) from SEOV(IR162)__KX079475.1__GP
  source 1..3402: mol_type = other RNA
atgtggagcctgctcctgctggccgccctcgtcggccgcgggttcacgctgaagaacgtcttcgacatgcggatccagtgcccccacagcgtgaacttcggcgagactagcgtgtccgggtacacggaactgccgcccctcagcctgcaggaggcggagcagctggtccccgagtcttcatgcaacatggacaaccaccaatccctcagcaccatcaacaagctgaccaaggtgatctggcgcaagaaggccaaccaggagtccgccaaccaaaatagcttcgaggtggtcgagtccgaggtgagcttcaagggcctgtgcatgctcaaacaccggatggtggaagagtcctaccgcaaccggcgcagcgtcatctgctacgacttagcctgcaactccaccttctgcaagcccacggtctacatgatcgtgccgatccacgcctgcaacatgatgaagtcctgcctgatcggtctcggcccctaccggatccaggtcgtgtacgagcgcacctactgcaccacgggcatcctgacggaggggaagtgcttcgtgcccgacaaggcggtagtaagcgccctgaagcggggcatgtacgccatagccagcatcgagaccatctgcttcttcatccaccagaaggggaacacctacaagatcgtcaccgcgatcacttccgccatgggcagcaagtgcaacaataccgacaccaaggtccaggggtactacatctgtatcatcggcggcaacagcgcccctgtgtatgcaccggcgggggaggatttccgtgcgatggaggtgttctccggcatcatcaccagcccccacggggaggaccacgacctcccaggcgaggagatcgccacgtaccagatatctggccaaatcgaggccaagatcccccacaccgtctcctctaagaacctgaagctgaccgcgttcgcggggatcccgagctactccagcacctccgtgctcatcgcgagcgaggacggacggttcatcttctcccccgggctgttccccaatctgaaccagagcgtgtgcgacaacaacgccctccccctgatttggcgcggcctgattgacctcacggggtactacgaagccgtccacccgtgcaacgtcttctgcgtcctgtccggccccggcgccagctgcgaggccttcagcgagggcgggatcttcaacatcaccagccccatgtgcctggtgtccaagcagaaccgcttccgcgcggccgagcagcagatcagcttcgtatgccagcgggtcgacatggacatcatcgtgtactgcaacggtcagaagaagaccatcctcaccaagacgctggtgatcggccagtgtatctacaccatcacctccctgttcagcctcctgcccggagtggcccacagcatcgccatcgagctgtgcgtgccgggcttccacggctgggccaccgcggccctactgatcacgttctgcttcgggtgggtgcttatccccgcctgcaccctagccatcctcctggtcctcaagttcttcgcgaatatactgcacacgtccaaccaggagaacagattcaaggccatcctgcggaagatcaaggaagagttcgagaagaccaagggcagcatggtgtgtgagatctgcaagtacgagtgcgagacgctcaaggagctgaaggcccacaacctgtcctgcgtgcagggtgagtgcccctactgcttcacccattgcgagcccaccgagaccgccatccaggcacactacaaggtctgccaggcgacgcaccgcttccgggaggacctcaagaagaccgtgacaccgcagaacatcggccccgggtgctacaggacactgaacctgttccggtacaagagccgctgctacatactgaccatgtggacgctccttctgatcatcgagtccatcctatgggccgccagcgcaaccgagatccccctggtgcccctgtggaccgacaacgcccacggcgtaggctccgtgccgatgcacaccgacctcgagctggacttcagcctgccctccagctccaagtacacctataagcgccacctcaccaaccccgtgaacgaccagcagagcgtctccctgcacatcgagatcgagagccaggggatcggcgcggatgtacaccacctggggcactggtacgacgcccgcctcaacctgaagacctccttccactgctacggcgcctgcaccaagtaccagtacccgtggcacacagccaagtgccacttcgagaaggactacgagtacgagaacagctgggcctgtaacccgccagactgccccggcatcgggaccggctgcaccgcgtgcgggctgtacttggatcagttaaagcccgtgggaacggccttcaaaatcatctccgtcagatacagccggaaggtgtgcgtgcagttcggggaggagtacctatgcaagacgattgacatgaacgactgcttcgtcacccgccacgccaagatctgcatcatcggcaccgtgagcaagttcagccagggcgacactctcctattcctggggcccatggagggcgggggcatcatcttcaagcactggtgcacttctacgtgccacttcggggaccccggcgacgtgatgggccccaaggacaaaccgttcatctgccccgagttccccggacagttccggaagaagtgcaacttcgccactacccccgtctgcgagtacgacggcaacatcatctccgggtacaagaaggtactcgctaccatcgacagcttccagtcctttaacaccagcaacatccacttcaccgacgagcgcatcgagtggcgggaccccgacggcatgctgcgcgaccacatcaacatcgtgatctccaaggacatcgacttcgagaacctggccgagaacccctgcaaagtcggcctccaggccgccaacatcgagggcgcatggggctcgggggtgggcttcaccctgacgtgccaggtgtccctgacagagtgccccaccttccttaccagcatcaaggcgtgtgacatggccatctgctacggggccgaatccgtcacgctgagccggggtcagaacaccgtgaaaatcaccgggaagggcggtcactccgggagctccttcaagtgttgccacggcaaggagtgcagctccaccggtctgcaggcctccgcgccccacctcgacaaggttaatggcatctccgacctggagaacgagaaggtttacgacgacggcgccccggagtgtgggatcacatgttggttcaagaaatccggcgagtgggtgatggggatcatcaacggcaactgggtggtcctgatcgtgctctgcgtgctgctcctgttcagcctgatactactcagtatcctgtgccccgtccggaagcacaaaaagtcctag

SEQ ID NO: 15163 - RNA, 3402 nt, synthetic construct
  misc_feature 1..3402: note = derived and/or modified CDS sequence (opt11) from SEOV(Gou3)__AF145977.2__GP
  source 1..3402: mol_type = other RNA
atgtggggcctgctcctgctggccgccctcgtggggcagggcctagcgctgaagaacgtctttgacatgaagatccagtgcccgcacagcgtgaacttcggggagaccagcgtgagcggctacaccgagcttccgcccctgcccctgcaggaggccgagcagctcgtccccgagtccagctgcaacatggacaaccaccagtccctgagcaccatcaacaagctgaccaaggtgatctggcgcaagaaggccaaccaggagtccgcctcacagaactccttcgaggttgtcgagaatgaggtgagcttcaagggactctgtatgctgaagcaccggatggtggaggagtcctaccgtaatcggcgcagcgtcatctgctacgacctggcctgcaacaccaccttctgcaagccgacggtgtacatgatcgtgcccatccacgcgtgcaacatgatgaagtcctgcctcatcggcctgggcccctaccggatccaggtcatctacgagcgcacctactgcaccaccgggatcctgactgagggcaagtgcttcgtgcccgacaaggccgtggtcagcgccctcaagcggggtatgtacgccatcgcgtccatcgagaccatctgcttcttcgtgcacaagaagggcaacacttacaagatcgtgagcgccatcaccctggccatggggtccaagtgcaacaacacggacagcaaggtacagggatactacatctgcatcatcggcgggaactccgccccggtgtacgcccccgcgggcgaggattttcgcgccatggaggtgttcagcgggatcatcacctcaccccacggcgaggaccacgacctgcccggcgaggaaatcgccacctaccagatctccgggcaaatcgaggccaagatcccgcacaccgtcagctccaagaacctcaagttaactgccttcgcgggcatccccagctactccagcacttccatcctggccgccagcgaggacgggcggttcatcttctcccccggcctcttccccaacctgaaccagagcgtgtgcgacaacaacgccctgccgctcatctggcgcgggctgatcgatctgaccggctactacgaggccatccacccctgcaacgtgttctgcgtactctccggtcccggggcgagctgtgaggccttctccgagggcgggatcttcaacatcacaagccccatgtgcctggtgtccaagcaaaaccggttccgcgccgccgagcagcagatctcattcatatgccagcgggtcgacatggacatcgtggtttattgcaacggccagaagaagacgatcctgaccaagaccctcgtcatcgggcagtgcatctacaccattacgtccctgttcagcctgctcccgggcgtggcccactccatcgcgatcgagctgtgcgtgcccggcttccacgggtgggccaccgccgccctgctcgtcaccttctgcttcggctgggtgttgatccccgcgtgcaccctggccgtgctcctgttcctgaagttcttcgccaacatcctccacacgagcaaccaggagaaccgcttcaaggccatcctgcggaaaatcaaggaggagttcgagaagaccaaggggagcatggtctgcgagatctgtaagtacgagtgcgagaccctgaaggagctcaaggcccacaacctgtcctgcgtgcagggcgagtgcccctattgcttcactcactgcgagccgacggagaccgcgatccaggcccactacaaggtgtgccaggccacccaccgcttccgggaggacctgaagaagaccgtcacgccccagaacatcggccccggctgctaccgcaccctgaacctcttccggtacaagagccgctgctacatcctgaccatgtggatcctgctcctggtgatcgagtccatcctgtgggccgccagcgcggccgagatccctctcgtgcctctgtggaccgataacgcccacggcgtcgggtccgtgcccatgcacaccgacctggagttagacttcagcctgccgtccagctccaagtacacgtacaagcggcacctgaccaacccggtgaacgaccagcagagcgtctcgctccacatcgagatcgagagccagggcatcggggccgacgtgcaccacctgggccactggtacgacgcccgcctgaacctcaagacctccttccactgctacggcgcgtgcaccaagtaccagtacccctggcacacggccaagtgccacttcgagaaggactacgagtacgagaacagctgggcctgcaacccgcccgactgccccggggtaggcgccgggtgcaccgcgtgcggcctgtacctggaccagctcaagcccgtcggtaccgccttcaagatcatctccgtgcgatacagccggaaggtgtgcgtccagttcggcgaggagtacctgtgcaaaaccatcgacatgaacgactgcttcgtgacgcgccacgccaagatctgcatcatcggaaccgtgtccaagttcagccagggggacaccctcctcttcctgggccccatggagggcggcgggatcatcttcaagcactggtgcaccagcacgtgccacttcggggaccccggcgacgtcatggggccgaaggacaagcccttcatctgccccgagttccccggccaattccggaagaagtgcaacttcgccaccaccccagtgtgcgagtacgacgggaacgtgatctccggctaccgcaaggtactggccaccatcgacagctttcagtccttcaacaccagcaacgtgcacttcaccgacgagcggatcgaatggaaggaccccgacgggatgctccgcgaccacatcaacatcgtgatctccaaggacatcgacttcgagaacctggcggagaacccctgcaaggtcggcctgcaggccgccaacatcgagggcgcctgggggagcggcgtgggcttcaccctgacctgccaggtgtccctgacggagtgccccaccttcctgaccagcatcgaggcctgcgacatggcgatctgctacggcgccgagtccgtcaccctcagccgggggcagaacacgatcaagatcaccggcaagggcgggcactccggcagctccttcaaatgctgccacgggaaggagtgcagcgccaacggcctgcaggcctccgccccgcacctggacaaggtgaacggcatcagcgagctcgagaatgagaaggtgtacgacgacggggcgcccgaatgcggcatcacgtgctggttcaagaagtccggggaatgggtcatgggcattatcaacgggaactgggtggtgctgatcgtcctgtgcgtgctcctgctgtttagcctcatcctgctttccatactctgccccgtgcgtaagcacaagaagtcctga

SEQ ID NO: 15164 - RNA, 3402 nt, synthetic construct
  misc_feature 1..3402: note = derived and/or modified CDS sequence (opt11) from SEOV(HB55)__AF035832.1__GP
  source 1..3402: mol_type = other RNA
atgtggagcctgctcctgctggccgccctcgtgggccaggggttcgccctgaagaacgttttcgatatgcgcatccagtgccctcactccgtgaacttcggcgagaccagcgtgtccgggtacaccgagctgccgcccctcagcctgcaggaggccgagcagctggtccccgaatccagctgcaacatggacaaccaccagtccctcagcacgatcaacaagctgaccaaagtggtgtggcgcaagaaggccaaccaggagtccgccaaccagaacagcttcgaggtcgtggagtccgaggtgagcttcaagggcctgtgcatgctcaagcaccgcatggtcgaggagtcctaccggaaccgccggagcgtgatctgctacgacctggcctgcaactccaccttctgcaagcccaccgtgtacatgatcgtcccgatccacgcgtgcaacatgatgaagtcctgcctgatcgggcttggcccctaccgcatccaggtggtgtacgagcggacgtactgcaccaccggcatcctgaccgaggggaagtgcttcgtccccgacaaggccgtggtgggcgccctgaagcgcgggatgtacgccatcgcgtccatcgaaacgatctgctttttcatccaccagaagggcaacaagtacaagatcgtcaccgccattaccagcgctatggggtccaagtgcaacaacaccgacacgaaggtgcagggctactacatctgcatcatcggcgggaacagcgcccccgtttacgccccggcgggcgaggacttccgggccatggaggtcttcagcgggatcatcaccagcccccacggcgaggaccacgacctccccggcgaggagatcgccacgtatcagatcagcgggcagatcgaggccaagataccccacaccgtgtccagcaagaacctgaaactgatcgccttcgcgggcatcccgtcctacagctccacgagcatcttagccgcctccgaggacgggcgcttcatcttcagccccggcctcttccccaacctgaaccagtccgtgtgcgacaacaacgccctcccactgatatggcgggggctgatcgacctcactggctactacgaggccgtccacccctgcaacgtgttttgcgtcctgagcggccccggggcctcctgcgaggccttctctgagggcgggatcttcaacatcacctcccccatgtgcctggtgagcaagcagaaccgctttcgggccgccgagcagcagatctcctttatctgccagcgcgtggacatggacatcatcgtctactgcaacggccagaagaagaccatcctcacgaagaccctggtgatcggccagtgcatttacactatcaccagcctgttctccctcctgcccggcgtggcccacagcatcgcgatcgagctgtgcgtcccgggcttccacgggtgggccaccgccgccctcctgatcaccttctgcttcggctgggtgctgatccccgcgtgcaccctcgccatcctgctggtgctcaagttcttcgccaacatcctgcacaccagcaaccaggagaaccggttcaaggccatcctgcgcaagataaaggaggagttcgagaagacgaaggggtccatggtctgcgagatctgcaagtacgagtgcgagaccctcaaggaactgaaagcccacaacctgagctgcgtgcagggcgagtgcccctattgcttcacccactgcgagcccaccgagacggcgatccaggcccactacaaggtgtgccaggccacccaccggttccgcgaggacctcaagaaaaccgtcaccccgcagaacattgggcccggctgctaccgcacgctgaacctgttccgctacaagtcccggtgctacatcctgaccatgtggaccctcctgctgatcatcgagagcatattatgggccgcctccgcggccgagatccccctggtgcccctgtggaccgacaacgcccacggcgtggggagcgtcccgatgcataccgacctcgagctggacttctcactgcccagctccagcaagtacacgtacaagaggcacctcaccaaccccgtgaacgaccagcagtccgtgagcctgcacatcgagatcgagtcccagggcatcggggccgacgtccaccacctgggccattggtacgacgcccgactcaacctgaagaccagcttccactgctacggcgcgtgcactaagtaccagtacccgtggcacacggccaagtgccacttcgagaaggactacgagtacgagaactcctgggcctgcaacccgcccgactgccccggggtgggcaccgggtgcaccgcctgcggcctgtacctcgaccagctgaagcccgtggggaccgcgttcaagatcatcagcgtccggtactcccgcaaggcctgcgtgcagttcggcgaagagtacctgtgcaagacgatcgatatgaatgactgcttcgtgaccggccacgccaagatctgcatcatcgggaccgtcagcaagttcagccagggcgacaccctcctgttcctggggcccatggagggcgggggcatcatcttcaagcactggtgcacgtccacgtgccacttcggcgaccccggtgacgtgatgggccccaaggacaagccgttcatctgccctgagttccccgggcagttccggaagaaatgcaacttcgccaccacccccatctgcgagtacgacggcaacatcatctccgggtacaagaaggtgctcgccaccatcgactccttccagagcttcaacacctccaacatccacttcaccgacgagcgcatcgagtggcgggacccggacggcatgctgcgcgaccacattaatatcgtcatcagcaaggacattgacttcgagaacctggcggagaacccctgcaaggtggggctccaggccgccaacatcgagggggcctggggctccggggtgggcttcaccctgacgtgccaggtcagcctgaccgagtgtcccaccttcttaacctccatcaaggcctgcgacatggcgatctgctacggggccgagagcgtgacgctgtcccggggtcagaacaccgtgcgcatcacaggcaagggcgggcacagcgggtctagcttcaaatgctgccatggcaaggagtgctccagcaccggcctgcaggcctccgcgccccacctcgacaaggtcaatgggatcagcgagctggagaacgagaaggtgtacgacgacggcgccccggagtgcggggtgacgtgctggttcaagaagtccggcgagtgggtcatggggatcatcaatggcaactgggtggtgctgatcgtcctctgcgtgctgctcctattcagcctgatcctgctcagcatcctgtgccccgtgcggaagcacaagaagtcctga

SEQ ID NO: 15165 - RNA, 3402 nt, synthetic construct
  misc_feature 1..3402: note = derived and/or modified CDS sequence (opt11) from SEOV(L99)__AF035833.1__GP
  source 1..3402: mol_type = other RNA
atgtggagcctcctgctactcgccgccctcgtaggtcaagggttcgcactcaaaaacgtcttcgacatgagaatacaatgcccccactccgtaaatttcggcgagacatccgtatccggctacacagaacttccgcccctcagcctgcaagaggcagaacaactcgtacctgaatcaagctgcaacatggacaaccaccaaagcctctcgaccattaacaaactaacaaaagtagtatggcggaagaaagccaaccaagaactcgccaaccaaaactcgttcgaagtcgtcgaatcagaagtcagcttcaaaggactatgtatgctaaaacaccgcatggttgaagagtcttaccgaaaccggcgatccgttatctgctacgatctcgcctgcaacagcaccttctgcaaaccgaccgtctacatgatcgtccctattcacgcctgcaacatgatgaaatcctgcttaataggactcggcccttatcgaatccaagtagtctatgaaagaacctactgcaccactggcattctcaccgaaggcaaatgcttcgtaccagacaaggcagtggtgagcgccttaaaacgaggcatgtacgccatcgcatcgatcgaaaccatctgctttttcatacaccagaaaggcaacacatacaaaatcgtaacagccatcacgtctgcaatgggcagcaaatgtaacaacactgatacgaaagtccaaggctactacatctgcatcatcggaggcaactccgccccagtgtacgcccctgcgggcgaagacttccgcgcaatggaggtcttctccggcatcatcacctcaccccatggcgaagaccatgatctaccaggcgaagaaattgccacataccagatatccggccaaatcgaagccaagatcccacacacagtctccagtaaaaatctaaaattaatagccttcgccggcatccccagttactcctcaacctccatcctagccgcaagcgaagatggacgcttcatcttctcccccggcctcttcccaaacctcaaccagtctgtctgtgacaacaacgcccttcccctcatctggagaggcttgatcgacttgacaggatactacgaggccgtacacccctgcaacgtattctgtgtcctctctggacctggtgccagttgcgaggcattctccgaaggcgggatattcaacatcacctcccctatgtgcctggttagtaagcagaacagatttcgagccgcagaacaacagatctccttcatatgccagcgcgtcgatatggatataatcgtctattgcaacggccagaaaaagacaatccttacgaagaccctagtcatcggccaatgcatatacaccatcacaagcctcttcagccttctaccgggagtagcccatagcatcgcaattgagctctgcgtgcccggcttccacggatgggccaccgccgccctcctcatcacattctgcttcggttgggtccttattcccgcctgcacactcgcaatccttctagtactcaagttcttcgccaatatcctccacacatccaaccaagaaaatcgcttcaaagccatcctccgcaaaatcaaagaggagttcgaaaagacaaaggggtcgatggtctgtgagatatgcaaatacgaatgcgaaaccctcaaggagctcaaggcgcacaacctttcctgcgtccaaggtgaatgtccctactgcttcacccactgcgaaccgaccgaaacagccatacaggcccactacaaagtgtgccaagccacccaccgcttccgggaagacctcaagaaaaccgttacccctaaaaacatcggtcccggatgctaccgaaccctcaacctttttcgctacaagtcccgatgttacatcctcaccatgtggactcttctgctgattatagaatcaatactctgggccgcctcagccgcagaaatccctctcgtcccactctggacagataacgcccatggagtcggatcagtaccgatgcacacagacctagaactcgacttcagcctgcccagctcctcaaaatacacttacaagcggcacctcacaaaccctgtaaacgaccaacaatccgtaagcctccacatagaaatagaatcccaaggaattggcgcagacgttcaccacctgggacactggtacgacgcacgcctcaacctaaaaacgtccttccattgctacggtgcctgcacaaaataccagtacccctggcatacggcaaaatgccacttcgagaaggactacgagtacgagaacagctgggcctgcaaccctcccgactgccccggcgtaggcaccggctgcaccgcctgcggcctctacctcgaccaactgaaacccgtcggcaccgccttcaaaatcatatccgtccgctactccaggaaggtctgcgtgcaattcggggaagaatacctatgcaaaaccatcgatatgaacgactgcttcgtaacccgccatgccaagatttgcatcatcggcacagtctccaaattctcccaaggcgacacacttctctttctcgggccaatggaaggaggcgggatcatcttcaaacactggtgcacttcaacttgccacttcggggacccaggcgacgtaatggggccaaaggacaagcctttttcatgccccgagttccccggtcaatttcgcaagaaatgcaactttgccactaccccaatctgcgaatacgatggtaacataatatccggctacaagaaagttctcgccaccatcgattctttccagtcatttaacaccagcaacattcacttcaccgacgaacgcatagaatggcgggatccagacggcatgctgagggaccacataaacatcgttatatcaaaagacatcgacttcgaaaaccttgccgaaaacccctgcaaagtcggactacaggccgccaacatagaaggtgcctggggaagcggcgttggatttacactgacatgccaagttagcctcaccgaatgcccaaccttcctcacaagcatcaaagcatgcgacatggcaatctgctacggcgctgagtccgtaacactgtcgcgtggccaaaacaccgtcagaatcaccggcaaaggcggccactccggatcctcctttaaatgctgccacggtaaagagtgctcctccaccggtctccaggcaagcgctccacacctcgacaaagtcaacgggatcagcgaactcgaaaacgaaaaagtctatgacgacggtgccccagagtgcggcgtaacatgctggttcaagaaatcaggcgagtgggtcatgggtatcatcaacggcaactgggttgtcctaatagtactgtgcgtactcctattattctcgcttatcctgctatccatcctgtgccccgttcgcaaacacaagaaaagctaa

SEQ ID NO: 15166 - RNA, 3402 nt, synthetic construct
  misc_feature 1..3402: note = derived and/or modified CDS sequence (opt11) from SEOV(Z37)__AF187081.1__GP
  source 1..3402: mol_type = other RNA
atgtggagcctgctcctgctggccgccctcgtgggccaggggttcgcattaaagaacgtcttcgacatgcgcatccagtgcccccacagcgtgaactttggcgagactagcgtgtccgggtacaccgagctgccgcccctcagcctgcaggaggccgagcagctggtcccagagtccagctgcaacatggacaaccaccagtccctcagcaccataaacaagctgacaaaagtgatctggcgaaagaaggccaaccaggagtccgccaaccagaacagcttcgaggtggtcgaatccgaggtgagcttcaagggcctgtgcatgctcaaacaccgcatggtggaggagtcctaccggaaccgccggagcgtcatctgctacgacttagcctgcaacagcaccttctgcaagcccaccgtgtacatgatcgtgccgatccacgcgtgcaacatgatgaagtcctgcctgatcgggctcggcccctaccgcatccaggtcgtgtacgagcggacctactgcaccaccggcatcctgaccgaggggaagtgcttcgtgcccgacaaggccgtcgtgagcgccctgaagcggggcatgtacgccatcgcgagcatcgagacgatctgcttcttcatccaccagaagggtaacaagtacaagatagtgaccgccatcacctccgccatgggcagcaaatgcaacaataccgacacgaaggtccaggggtactacatctgtatcatcggcggcaacagcgcccccgtgtacgcaccggcgggggaggacttccgggccatggaggtgttctccggcattatcactagcccccacggggaggaccacgacctccccggcgaggagatcgccacctatcagatctccggccagatcgaggccaagatcccccacaccgtcagctccaagaacctgaagctgacggccttcgcggggatcccgagctactccagcacctccatcctcgccgccagcgaggacggccgcttcatcttctcccccgggctgttccctaacctgaaccagagcgtgtgcgacaacaacgccctccccctgatctggcggggcctgatcgacctcaccgggtactacgaggccgtgcacccgtgcaacgtcttctgcgtgctgtccggccccggcgcgagctgcgaggccttctccgagggcgggatcttcaacatcaccagccccatgtgcctggtctccaaacagatccgcttccgggccgccgagcagcagatcagcttcatctgccagcgcgtggacatggacatcatcgtgtactgcaacgggcagaagaagacgatcttaaccaagaccctggttatcggccagtgcatctatacaatcacgtccctgttcagcctcttacccggggtggcccacagcatcgcgatagagctgtgcgtgccgggcttccacggctgggccaccgccgccctcctgatcaccttctgcttcgggtgggtcctgatccccgcgtgcaccctcgccatcctgctggtgctcaagttcttcgccaacatcctgcacacgtccaaccaagagaaccggttcaaggctatcctgcgcaagatcaaggaggagttcgagaagaccaagggcagcatggtgtgcgagatctgcaagtacgagtgcgagaccctcaaggagctgaaggcccacaacctgtcctgcgtccagggggagtgcccctactgcttcacccactgcgagcccacggagaccgcgatccaggcccactacaaggtgtgccaggccacccaccggttccgcgaggacctcaagaaaactgtgacgccccagaacatcggcccggggtgctaccggaccctgaacctcttccgctacaagagccggtgctacatcctgaccatgtggaccctcctgctgatcatcgagtccatcctctgggccgccagcgcggccgaaatccccctggtccccctgtggaccgacaacgcccacggcgtgggctccgtgccgatgcacacggacctcgagctggacttcagcctgccctccagctccaagtatacctacaagcgccacctcacgaaccccgtcaacgaccagcagagcgtgtccctgcacatcgagatcgagagccaggggatcggcgccgacgtgcaccacctggggcactggtacgacgcccgcctcaacctcaagacctccttccactgctacggcgcgtgcacgaaataccagtatccatggcacaccgccaagtgccacttcgagaaggactacgagtacgagaacagctgggcctgcaacccgcccgactgccccggcgtcgggaccggctgcaccgcctgcgggctgtacctcgaccagctgaagcccgtgggcacggcgttcaagatcatctccgtgcggtacagccgcaaggtctgcgtgcagttcggggaggaatacctgtgcaagaccatcgacatgaacgactgcttcgtgacccggcacgccaagatctgcatcatcggcacggtcagcaaattcagtcagggggacacgctcctgttcctagggcccatggagggcgggggcatcatcttcaagcactggtgcaccagcacgtgccacttcggggaccccggcgacgtgatgggccccaaagacaagccgttcatctgcccggagttccccggacagttccgcaaaaagtgcaacttcgccaccacccccgtgtgcgagtacgacggcaacatcatctccgggtacaagaaggtcctcgccacaatcgacagcttccagtccttcaacaccagcaacatccacttcaccgacgagcggatcgagtggcgcgacccggacggcatgctgcgggaccatatcaacatcgtgatctccaaggacatcgacttcgagaacctggccgagaacccctgcaaggtggggttgcaggctgccaacatcgagggcgcctggggcagcggtgtcggcttcacgctgacctgccaggtgtcgctgaccgagtgccccaccttcctcacgagcatcaaggcctgcgacatggccatttgctacggggcggagtccgtgaccctgagccgcggccagaacaccgtcaagatcaccgggaagggcgggcactccgggagctccttcaagtgctgccacggcaaggagtgcagctccacggggttgcaggcgagcacgccccacctcgacaaggtgaacggcatctccgagctcgagaacgagaaggtgtacgacgacggcgccccggaatgcgggatcacgtgctggttcaagaagtccggcgagtgggtcatggggatcatcaacggcaactgggtggtgctgatcgtcctctgcgtgctgctgctgttcagcttgatcctgctcagcatcctgtgccccgtgcggaagcacaagaagtcctga

SEQ ID NO: 15167 - RNA, 3402 nt, synthetic construct; identical to SEQ ID NO: 11881
  misc_feature 1..3402: note = derived and/or modified CDS sequence (opt11) from SEOV(Z37)__AF190119.1__GP
  source 1..3402: mol_type = other RNA

SEQ ID NO: 15168 - RNA, 3402 nt, synthetic construct
  misc_feature 1..3402: note = derived and/or modified CDS sequence (opt11) from SEOV__M34882.1__GP
  source 1..3402: mol_type = other RNA
atgtggagcctgctcctgctggccgccctcgtgggccaggggttcgccctgaagaacgtcttcgacatgcgcatccagctgccccacagcgtgaacttcggcgagaccagtgtgtccgggtacaccgagttcccgcccctcagcctgcaggaggccgagcagctggtccccgagtccagctgcaacatggacaaccaccagagcctcagcaccattaacaagctgaccaaggtgatctggcgaaagaaggccaaccaggagtccgccaaccagaacagcttcgaggtggtcgagtccgaggtgagcttcaagggcctgtgcatgctcaagcaccgcatggtggaggagtcctaccggaaccgccggagcgtcatctgctacgacctcgcctgcaactccaccttctgcaagcccaccgtgtacatgatcgtgccgatccacgcgtgcaacatgatgaagtcctgtctgatcggactcggcccctatcgcatccaggtcgtgtacgagcggacgtactgcaccaccggcatcctgaccgaggggaagtgcttcgtgcccgacaaggccgtcgtgagcgccctgaagcgcggcatgtacgccatcgccagcatcgagacgatctgcttcttcatccaccagaaggggaacacctacaaaatcgtgaccgccatcacctccgccatgggcagcaagtgcaacaacacggacaccaaggtccagggctactacatctgcatcatcggcggcaacagcgcccccgtgtacgccccggcgggggaggacttccgggccatggaggtgttctccggcatcatcaccagcccccacggggaggaccacgacctccccggcgaggaaatcgccacctaccagatctccggccagatcgaggccaagatccctcacacggtcagctccaagaacctgaagctgaccgccttcgcggggatcccgagctactccagcacctccatcctcgccgccagcgaggacggccgcttcatcttctcccccgggctgttccccaacctgaaccagagcgtgtgcgacaacaacgccttacccctgatctggcggggcctgatagacctcaccgggtactacgaggccgtgcacccgtgcaacgtcttctgcgtgctgtccggccccggcgcgagctgcgaggctttcagtgagggtgggatcttcaacatcacgagccccatgtgcctggtatccaagcagaaccgcttccgggccgccgaacagcagatcagcttcgtgtgccagcgcgtggacatggacatcatcgtctactgcaacgggcagaagaagaccattctcaccaagaccctggtgatcggccagtgcatatacacgatcacctccctgttcagcctcctgcccggggtggcccacagcatcgcgatcgagctgtgcgtgccgggcttccacggctgggccaccgccgccctcctgatcaccttctgcttcgggtgggtgctgatccccgcgtgcacgctcgccatcctgctggtgctcaagttcttcgccaacatcctgcacacctccaaccaggagaaccggttcaaggccatcctgcgcaagatcaaggaggagttcgagaagaccaagggcagcatggtctgcgagatctgcaagtacgagtgcgagaccctcaaggagctgaaggcccacaacctgtcctgcgtgcagggggagtgcccctactgcttcacgcactgcgagcccaccgagaccgccatccaggcacactacaaggtgtgccaggccacccaccggttccgcgaggacctcaagaagacggtcaccccgcagaacatcggccccgggtgctaccggaccctgaacctgttccgctacaagagccggtgctacatcctgaccatgtggaccctcctactgatcatcgagtccatcctctgggccgccagcgcggccgagatccccctcgtgcccctgtggacggacaacgcccacggcgtgggctccgtcccgatgcacaccgacctcgagctggacttcagcctgccctccagctccaagtacacctacaagcgccacttaaccaacccggtgaacgaccagcagagcgtgtccctgcacatcgagatcgagagccaggggatcggcgccgccgtccaccacctggggcactggtacgacgcgcgcctcaatctgaagacgtccttccactgctacggcgcctgcaccaagtaccagtacccatggcacaccgccaagtgccacttcgagaaggactacgagtacgagaacagctgggcctgcaatccgcccgactgccccggcgtgggaaccggctgcacggcgtgcgggctgtacctcgaccagctgaagcccgtgggcaccgccttcaagattatctcagtccggtatagccgcaaggtgtgcgtgcagttcggggaggagcacctgtgcaagaccatcgacatgaacgactgcttcgtcacccggcacgccaaaatctgtatcatcggcacggtgagcaagttctcccagggcgacaccctcctgttcctggggcccatggagggcggcgggatcatctttaagcattggtgcaccagcacgtgccacttcggggaccccggggacgtgatggggccgaaggacaagccgttcatctgccccgagttccctgggcagttccgcaagaagtgcaacttcgccaccacccccgtatgcgagtacgacggcaacatcatctccgggtacaagaaggtgctcgccactatcgacagcttccagtccttcaacaccagcaacatccacttcacggacgagcggatcgagtggcgcgacccggacggaatgctgcgggaccacatcaacatcgtgatatccaaggacatcgatttcgagaacctggcggagaacccctgcaaggtagggctccaggccgccaacatcgagggcgcctggggcagcggggtgggcttcaccctgacctgcaaggtgtccctgaccgagtgccccacgttcctcaccagcatcaaggcatgcgacatggcgatctgctacggcgcggagtccgtaaccctgagccgcggccagaacaccgtgaagatcacggggaagggcggccactccgggtcttccttcaagtgctgccacggcaaggagtgcagcagtaccgggctgcaggccagcgcgccccacctcgacaaggtgaacggcatctcagagctagagaacgagaaggtctacgacgacggcgccccagagtgcgggatcacgtgctggttcaagaagtccggcgagtgggtgatggggatcatcaatggcaactgggtggtcctgatcgtgctctgcgtgctgctcctgttcagcctgatcctgctcagcatcctgtgccccgtccggaagcacaagaagtcctga

SEQ ID NO: 15169 - RNA, 3423 nt, synthetic construct
  misc_feature 1..3423: note = derived and/or modified CDS sequence (opt11) from SNV(NM H10)__NC_005215.1__GP
  source 1..3423: mol_type = other RNA
atggtgggctgggtctgtatcttcctggtggtgctcaccaccgccacggccgggctgacccgcaacctgtacgagctcaagattgaatgccctcatactgtcggactggggcaagggtatgtcaccgggtcagtggagatcacgcctatcctgctcacccaggtggcggacctcaagatcgagtccagctgtaatttcgaccttcacgtgccggccaccaccacgcagaagtacaaccaggtggactggaccaaaaagtctagcaccaccgagtccaccaacgccggcgccaccaccttcgaggcaaagactaaggagatcaacctcaaaggcacgtgcaacatcccgcccaccacctttgaggcggcctataagagcaggaagaccgtcatctgctacgacttggcctgcaatcagacgcattgcctgcccaccgtgcacctcatcgcccctgtacagacatgcatgtccgtacgcagctgcatgatcgggctactgtccagcagaatccaggtgatctacgagaagacatactgcgtaaccggccagctaatcgagggcctgtgcttcatccccacccacactatagctctgacccagcctggccacacgtacgacacaatgacactccccgtgacatgcttcctggtggcaaagaagctggggacgcagctcaagctggccgtcgagctagagaagctcatcaccggtgtctcttgcaccgagaacagcttccagggctactacatatgtttcatcggcaagcattccgagccccttttcgtgccgaccatggaggactaccgtagcgccgagctgttcacgaggatggtgctcaacccccgcggcgaggaccacgacccggaccagaatgggcagggcctgatgcggattgccggacccgtcacagcgaaagttccatccactgagaccaccgagactatgcaggggatcgccttcgccggagctcccatgtactcttccttcagcacactggtgcggaaggcggaccccgagtacgtcttctccccaggaatcatcgcagagagcaaccatagcgtgtgcgacaagaagaccgtccccctcacctggacgggcttcttagccgtgagtggagaaatcgagaagatcacgggctgcaccgtattctgcaccctggccggcccaggggccagctgtgaggcctactccgaaacgggtatctttaacatcagctcgcctacgtgcctcgtcaacaaagtgcagaagttccgagggtctgagcaaagaatcaacttcatgtgccagcgggtagatcaggacgtcgtggtctactgcaacggacagaagaaggttatcttaaccaaaaccttagtcattggtcagtgtatctacacgttcacatccctattcagcctgattcccggcgtggcgcactccctggccgtcgagctctgcgtgcccggccttcacgggtgggccaccaccgcactgctcatcacgttctgtttcggctggctgctgatccccgccgtgaccttaatcatcctgaagatcctcaggctcctgacattcagctgctcccattatagcaccgaatctaagttcaaggtcatcctggagcgggtgaaggtggagtaccaaaagacgatggggagcatggtgtgcgacatctgccatcacgaatgcgaaaccgcgaaagagcttgaaacccacaagaagtcctgcccggaaggccaatgcccgtactgcatgaccataacagagagcaccgagtccgccctccaggcccacttcgccatttgcaaattgaccaaccgcttccaagagaatctgaagaagtccctgaagcgccccgaggtgcgcaaggggtgctaccggaccctgggcgtgttccggtacaaaagccggtgctacgtcggcctggtttgggggatcctcctgacgaccgagcttatcatctgggcggccagcgccgatactcctctcatggagtctggctggtccgacacggcccacggggtgggcatcatcccgatgaagaccgacctggagctggactttgccctcgcgagctccagctcctacagctaccgccggaagctcgtcaaccccgccaaccaggaggaaaccttgcccttccacttccaactcgacaagcaggtcgtgcacgccgagatccagaacttgggccattggatggacgggaccttcaacatcaagacagcattccactgctacggcgagtgcaagaagtacgcctacccgtggcaaacggctaagtgcttcttcgaaaaggactaccagtacgagacctcctgggggtgcaacccgcccgactgccccggcgtcgggaccggctgcaccgcctgcggcgtgtacctggacaaactgcgtagcgtggggaaggcctacaagattgtctccctaaagtacacccgcaaggtgtgcatccagttaggcactgagcaaacctgcaagcacatcgatgtgaatgactgtctagtcaccccctctgtgaaggtttgcatgatcgggaccatctccaagttacagcccggcgacacgctcctattcctgggtcccctggagcagggcggcatcatcctcaagcaatggtgcaccaccagctgtgtcttcggggaccccggcgacattatgtccaccacgagcgggatgcggtgcccggagcacaccggctccttccgcaaaatctgcgggtttgccaccacacccacgtgcgagtaccaaggcaacactgtgtcgggcttccagcggatgatggccacccgcgactccttccaaagttttaacgtgacagagccccacatcacgagcaaccgcctggagtggatcgatcccgactccagcatcaaggaccacatcaatatggtcctcaacagggacgtgtccttccaggacctcagcgacaatccgtgcaaggtggacctacacacccagtccatcgatggagcctggggcagcggagtcggctttaccctggtttgcaccgtggggctcacggagtgcgctaatttcatcacatcaatcaaggcttgcgacagcgcgatgtgctacggcgcgaccgtcaccaacctgctgcgaggctctaacacggtgaaggtagtcgggaaaggcgggcacagtggatccctgttcaaatgctgccacgacaccgattgcacagaggagggccttgctgcgagcccgccccacctggaccgggtgaccggttacaaccagatcgactcagacaaggtgtacgacgacggtgcccctccctgcacgatcaaatgctggttcaccaagagcggggagtggttgctgggcatcctgaacggtaattgggtcgtggtcgccgtgctcatagtgatcctgatcctgtctatcctcttgttcagcttcttctgccccgtccggagccgcaagaacaaagcgaactga

SEQ ID NO: 15170 - RNA, 3423 nt, synthetic construct
  misc_feature 1..3423: note = derived and/or modified CDS sequence (opt11) from SNV(1)__JQ690283.1__GP
  source 1..3423: mol_type = other RNA
atggtcggctgggtctgcattttccttgttgtcttaaccaccgccaccgccgggctcacccgcaacctttatgagttgaagattgaatgcccccacaccgtaggcctaggccaaggctacgtcactggctccgtcgaaaccacccccatacttctcacccaagtagcggaccttaaaattgagagctcctgcaacttcgaccttcacgtacccgcaactaccacacaaaaatacaatcaagtcgattggaccaagaaatcttcaactaccgaatccacaaacgcaggcgccgccacattcgaagcaaaaacaaaagaggtcaacctaaagggcacgtgtaacataccaccaaccacattcgaagcagcatacaaatcccgtaaaactgtcatctgctacgacctagcgtgcaaccaaactcattgcctccccaccgtccacctaatagcccccgtccaaacatgcatgtccgtacgaagctgcatgatcggcctcctcagtagccgtatacaagtaatctacgagaaaacctactgcgtaaccggacaactcatagaaggactctgtttcatccccacccacacgatagcccttacccaaccaggccacacctacgacactatgaccctcccagtaacctgcttccttgtagctaaaaagctgggcacacaactcaaactggcagtcgaactggaaaaattgatcaccggcgtctcctgcacggaaaactcatttcagggatactacatctgcttcatcggcaaacattctgagccactgtttgttcccaccatggaggactacagaagcgcagaattgtttacacgaatggtcctcaacccacgtggcgaagaccacgacccggaccagaacggacagggtctaatgcgcatcgcgggccccgtcaccgctaaagttccctctacggagaccaccgaaacgatgcaaggcatcgcattcgcgggcgcccccatgtattcctcctttagtaccctcgtcaggaaagcagatccagagtatgtcttctcgcccggcatcatcgcagagagcaaccacagcgtttgcgacaagaaaaccgtgccactcacatggaccggtttcctagccgtctccggagagatcgagcgcataacaggatgcacagtattctgtaccctggcgggacccggcgcaagctgcgaagcgtactccgaaactggcatatttaacatatccagcccgacgtgcctagtcaacaaagttcaaaaattccgcggctccgaacaacgcatcaacttcatgtgccaacgcgtggaccaagacgtcgttgtctactgcaatggacaaaagaaagtcatcctcaccaaaacccttgtcatcggacaatgcatctacacgttcaccagccttttcagcctgatcccgggagtcgcgcactccctagccgttgagctctgcgtccccggtctacacggctgggccacaaccgccctcctcatcaccttttgcttcggctggctactcatccccaccgttacactaatcatcctaaaagtgctccgacttctcaccttctcctgctcccactactcaacggagtcaaaattcaaagtaatcctcgagagagtcaaggtagaatatcagaaaacaatgggctccatggtatgcgacatatgccaccacgaatgcgaaacagcaaaagaactggaaacacacaaaaagagctgccccgaaggccaatgcccctactgcatgacgatcaccgaatccaccgaatcagcactacaagcccacttttccatctgcaagctcaccaatagattccaagaaaatctaaagaaatctctcaagcgcccagaggtgcgaaagggatgctacaggaccttaggcgtttttcgctacaaatcccgctgctatgttggactggtctggggcatcctcttaacaacagaactgataatttgggcagcctctgccgacacgccgctcatggaaagcggctggtcagacaccgcccacggcgtaggcatcattcctatgaaaactgaccttgagctcgacttcgcccttgcgtcctctagcagctactcctaccgcagaaagctggtcaacccagccaaccaagaagagactctccccttccacttccaactggacaaacaagtggttcacgcggaaatacaaaacctcggacactggatggacggaacctttaatattaaaaccgccttccattgctacggcgagtgtaagaaatacgcatacccatggcaaacagccaaatgcttcttcgaaaaagattaccaatacgaaacctcatggggatgcaatcccccagactgccccggtgttggcacaggctgcaccgcctgcggagtttacctcgacaaactaagatcagtgggaaaagcctacaagatcgtctcacttaaatacacacgaaaggtatgcatccaactcggaacggagcaaacttgcaagcacatcgacgtcaacgactgcctagtcacgccatcagtaaaagtctgcatgatcgggactatctccaaactccaacccggagacacccttctcttcctcggacctctcgagcaagggggcatcatactcaaacagtggtgcactacaagttgcgtcttcggagaccccggcgacatcatgtcgaccacaagcggcatgcgctgcccagaacataccggctccttccgcaaaatctgcggatttgcaactacaccgacctgcgagtatcaaggaaatacagtatccggcttccaacgcatgatggcaactcgcgactcattccaatctttcaacgtaacagaaccccacataacctccaaccggctcgagtggatcgaccctgactcgtccatcaaagaccacataaacatggtcctcaacagagatgttagcttccaagacctttccgataatccatgcaaagtcgatctccacacccagtcaatagatggagcctggggctccggtgtcggattcaccctcgtatgtaccgtcggcctcaccgaatgcgccaactttatcacctctatcaaagcctgcgactcggccatgtgctacggcgccaccgtcacgaacctcctgcgcggctccaacaccgtcaaggtggtaggaaaaggcggacacagcggcagcctattcaaatgctgccacgacaccgactgcaccgaagagggcctagctgcgtcaccaccccacctagaccgcgtcaccggctacaaccaaattgactcagacaaggtctacgatgacggcgccccaccctgcaccataaaatgctggttcacaaaatcaggcgaatggctactcggcatcctcaacggcaactgggtagtcgtcgccgtcctaatagtcatactcatcttatccatattacttttctcattcttctgccccgttcgaaaccgcaagaataaagccaactaa

SEQ ID NO: 15171 - RNA, 3423 nt, synthetic construct
  misc_feature 1..3423: note = derived and/or modified CDS sequence (opt11) from SNV(1)__JQ690279.1__GP
  source 1..3423: mol_type = other RNA
atggtgggctgggtctgcatcttcctagtggtgctaaccaccgccacggctgggctgacccgcaacctgtacgagctcaaaattgagtgcccacacaccgtgggcctcgggcaaggctacgtgaccgggtctgtggagacgacacccattctgctcacccaggtcgcagacctgaaaatcgagtccagctgcaacttcgacctgcacgttcccgccaccacgacccagaagtacaaccaggtggattggaccaagaagtccagcaccacggagtccaccaacgccggcgccaatacctttgaggccaagaccaaggagatcaacttaaagggcacgtgcaacataccacccacgaccttcgaggcagcctacaagagccggaagaccgtcatctgctacgacctggcttgcaaccagacgcactgcctgcccaccgtgcacctcatcgcccccgtccagacctgcatgtcagtccgcagctgcatgatcgggctactgtccagccggatccaggtcatctacgagaagacctactgcgtgacaggccagcttatcgaggggctgtgcttcatccccacccacacaatagcgctgacccagcccggccacacgtacgacaccatgacactcccggtgacctgcttcctggtggccaaaaagctggggacgcagctcaagctagccgtggagctggagaaactcatcaccggcgtttcctgcaccgagaacagcttccagggctactacatctgcttcatcgggaagcactccgagcccctgttcgtgcctaccatggaggactaccgctcggccgagcttttcacgcggatggtgctcaatccccgcggcgaagaccacgacccggatcagaatgggcagggcctgatgcggatcgccggccccgtgaccgcgaaggtgccctccaccgagaccaccgagacgatgcaggggatcgcctttgccggcgcccccatgtatagctccttcagcaccctggtgcgcaaggccgaccccgagtacgtcttctcccctgggatcatcgcagagagcaaccacagcgtgtgcgacaagaaaaccgtccccctcacctggacgggcttcctggccgtgtccggggagatcgagcggatcaccggctgcaccgtgttctgcacgctggccggccccggagctagctgcgaggcctactccgagacgggcatcttcaacatcagctctccgacctgtctcgtcaataaagtgcaaaagttccgcggtagcgagcagcggatcaacttcatgtgtcagcgcgtggaccaggacgtcgtggtctactgcaacggccagaagaaggtcatcctgaccaaaacactggtgatcggtcagtgcatctacacgttcacctccctcttcagcctgatccccggcgtggcgcactccctggccgtcgagctctgcgtgcccggccttcacggatgggccaccaccgctctgctcatcacattctgcttcggctggctgctgatccccaccgtgaccctcctcatattaaagatactccggctgctgaccttcagctgctcccactatagcacggagtccaagttcaaggtcatcctggagcgcgtgaaggtagagtaccagaagaccatggggagcatggtctgcgacatctgtcatcacgagtgcgagactgccaaggagctggaaactcacaagaagtcttgcccggagggccagtgcccctactgcatgacgatcaccgagagcaccgagtccgcgctgcaggcccactttagcatctgcaagctgaccaaccggttccaagagaacctcaagaagtccctgaaacgacccgaagtgaagaagggttgctaccggacgctgggcgtgttccgctacaagagccgttgctacgtcggcctcgtgtgggggatcctgctgaccaccgaactcatcatctgggccgcctctgcggacacgcccctgatggagtccggctggagcgacaccgcccacggggtgggcatcataccgatgaagtccgacctggagctcgacttcgccctggccagctcgtcctcctacagctaccgccggaagttggtcaaccccgccaaccaggaggagaccctccccttccacttccagctggacaagcaggtcgtgcacgcggagatccagaacctgggccactggatggatgggaccttcaacatcaagaccgccttccactgctacggggagtgcaaaaagtacgcttacccgtggcagaccgccaaatgcttcttcgagaaggactaccagtacgagacctcctgggggtgcaacccgcccgactgccccggcgtcgggaccggctgtaccgcctgcggcgtgtacctcgacaagctgcgcagcgtggggaaggcgtacaagatcgtctccctgaagtacactcgcaaggtttgtatccagcttggcacggagcagacctgcaagcacatcgacgtgaacgactgcctggtcacccccagcgtgaaggtttgcatgatagggaccatctccaagctgcagcccggcgacacgctcctgttcctgggtcccctcgaacagggcggcatcattctgaagcagtggtgcaccaccagctgcgtcttcggggaccccggcgacatcatgtccaccactagcgggatgcggtgcccggagcacaccggctccttccgcaagatctgcgggttcgccaccacccctacgtgcgagtaccagggcaacaccgtgagcggcttccaacggatgatggccacccgcgacagcttccagtccttcaacgtgaccgagccccacatcacgagcaaccggctggaatggatagaccccgactcctcaatcaaggaccacatcaacatgatcctcaaccgcgacgtctccttccaggacctgagcgacaacccgtgcaaggtggacctgcacacccagtccatcgacggggcctggggcagcggggtgggcttcaccctcgtctgcaccgtggggttgacggagtgcgccaacttcatcacctccatcaaggcgtgcgacagcgccatgtgctacggcgccaccgtgaccaatctgctccggggctcgaacacggtcaaggtggtggggaaaggcgggcacagcggctccctgttcaagtgctgccacgacaccgactgcaccgaggagggcctggccgctagcccgccccacctcgaccgcgtcaccgggtacaaccagatcgactccgacaaagtgtacgacgacggcgccccaccctgcacgataaagtgctggttcaccaagagcggggagtggctgctgggcatcctcaacggcaactgggttgtcgttgccgtcctgatcgtgatcctgatcctcagtattctgttgttcagcttcttctgccccgtgcggtcccgcaagaacaaggccaactga

SEQ ID NO: 15172 - RNA, 3423 nt, synthetic construct
  misc_feature 1..3423: note = derived and/or modified CDS sequence (opt11) from SNV(2)__JQ690284.1__GP
  source 1..3423: mol_type = other RNA
atggtgggctgggtctgcatattcctcgtggtccttaccacggccactgccggcctcacacgcaacctctacgaacttaaaatagagtgcccccataccgtcggcctagggcaaggctacgtcaccggctccgtcgaaaccacacccattctactcacccaagtcgctgacctgaagatagagtcatcatgcaacttcgacctccacgtacccgccacaacaacccagaaatacaaccaggtagactggacaaagaaaggatccacgacagagtccaccaatgccggcgcgaataccttcgaagccaaaacaaaagaagtcaacctcaaaggtacctgcaacattcccccaaccacatttgaggcagcctacaaatcacgaaaaaccgtcatctgctatgaccttgcctgcaatcaaacgcactgcttacccacggtccacctgatcgcccccgtccaaacctgcatgtccgtacgatcatgcatgatcggcttgctctcaagtcgaatccaagtaatatatgagaaaacgtactgtgtcaccggacaacttattgaaggactatgcttcatacccacccacactatagcgctcacccagcccggccacacatacgacaccatgaccctaccagtaacctgcttcctcgtcgccaaaaagctaggaacccaactcaaactagcagtcgaactcgaaaaactcataacaggcgtctcctgcacagaaaactccttccaaggctactacatctgcttcataggcaaacactcagaacccctattcgtccccaccatggaagactacagatccgctgaagtcttcacccgaatggtactcaacccccgaggtgaggaccatgacccagaccaaaacggccaaggactcatgcgtatcgcaggaccagtaacagccaaagtacccagcacagaaacgaccgaaaccatgcagggcatcgccttcgcaggcgcccccatgtactcatccttctcaaccctagtgcggaaggctgacccagagtacgtattcagtccaggcatcatcgccgaaagcaaccattccgtctgcgacaagaaaacggtacccctaacctggaccggcttcctcgccgtctccggcgaaattgaacgcatcacagggtgcacggttttctgcacacttgccggtccaggcgcgtcctgcgaagcatattccgaaacaggcatatttaatatctcatcaccaacctgcctagtcaacaaagtccaaaaattccgagggtccgaacaacgcataaacttcatgtgtcagcgcgtcgaccaggacgtagtcgtctactgcaatggccaaaagaaagttatcctcaccaaaaccctcgtaattggtcaatgcatatacaccttcacctccctgttctccctcatccccggggtagctcactccctcgccgttgaactctgcgtccccggcttgcacgggtgggcaacgaccgccctgctaatcaccttctgcttcggatggctactcatccctaccgtaactctcatcatactaaaaatcctgcgtctccttacattctcatgctcccactactcgacagagtccaaattcaaagtaatccttgaacgcgtcaaagtcgaataccagaaaactatgggtagcatggtatgcgacatctgccaccacgaatgcgaaaccgctaaagaactagagacccataagaaaagctgccccgaaggccaatgcccttactgcatgaccatcacagaaagcaccgaatctgcactccaagcccatttctcaatctgcaaacttaccaaccgattccaagagaacttgaagaaaagcctaaaacgccccgaagtcaagaaaggatgttatagaacactaggcgtctttcgctacaaatcacgctgttacgttggcctcgtatggggaatcctcctgaccacagagctaatcatttgggccgcgagcgcggacactcccctcatggagagcggctggtccgacaccgcccacggggtaggaatcatcccaatgaaaaccgacctcgaactagactttgccctggcgtccagctccagctactcataccgacgcaaactggtgaacccagctaaccaagaggaaacgctaccgttccatttccaactagacaaacaagtagtacatgctgaaatccaaaatctaggtcactggatggatgggacatttaatatcaagacagccttccactgctacggcgaatgtaagaaatacgcatacccctggcagacggctaaatgcttcttcgaaaaagactaccaatacgagacctcctggggatgcaacccacccgattgccccggagtcggaacaggatgcactgcgtgtggagtgtaccttgataaactccgaagcgtaggcaaagcctataaaatagtaagcctcaaatatacacgcaaagtatgcatccaacttggaacagagcaaacatgcaaacacatcgacgtcaacgattgcttagtaaccccctccgtcaaagtttgcatgatcggaactattagcaagttgcaacccggagacacgctactcttcctaggcccccttgaacaaggcggcatcatcctcaaacaatggtgcaccaccagctgcgtcttcggcgaccccggagacatcatgagtacaacctccggcatgaggtgtccagaacacacaggttccttccgcaagatttgcggattcgcaacaacaccaacctgcgaataccaagggaacacagtctctggcttccagcgcatgatggcgacccgagactccttccaatcattcaacgtcacggaaccccacataacctccaacagactcgaatggatagacccggactcgtccatcaaagaccacataaacatggtactaaaccgtgacgtctccttccaggacctatccgataacccgtgcaaagtagacctccacacacaaagcatcgacggtgcatggggttccggcgtcggcttcacgctagtctgcacagttggtcttactgagtgcgccaatttcatcacctccataaaagcgtgcgactccgccatgtgctacggcgccacagtcaccaacctcctacgtggatccaacactgtcaaagtcgtcggaaaaggcggccactcaggttccctattcaaatgctgccacgacactgactgtacagaggaaggactagcagcaagcccaccccacctagaccgtgtgacaggctacaaccaaatagattccgacaaagtatacgatgacggggccccaccctgtaccatcaagtgctggttcactaaatccggggaatggcttctgggtatcttaaacgggaactgggtcgtagtagccgtcctcatcgtaatcctaatactctcaattctcctatttagtttcttttgcccagtccgatcaagaaagaacaaagccaactaa

SEQ ID NO: 15173 - RNA, 3423 nt, synthetic construct
  misc_feature 1..3423: note = derived and/or modified CDS sequence (opt11) from SNV(2)__JQ690280.1__GP
  source 1..3423: mol_type = other RNA
atggtcggctgggtctgcatattcctagtcgtactgacaaccgcaacagcaggcctcacccgtaacctctatgaactgaagatagaatgcccacacaccgtgggactaggccaaggatacgtaaccggctccgtcgaaaccacgcccattttactcacacaagtagcggacctaaaaatcgaatcttcgtgtaattttgaccttcacgtgccggccacgacaacccaaaaatacaaccaggtagactggaccaagaaatcaagcaccaccgaatccacgaacgctggagccaacactttcgaggccaaaaccaaagaagtcaacctaaagggcacgtgcaacatacccccaactaccttcgaagccgcatacaaatcacggaagacagtcatctgttatgacctagcttgcaatcaaacccactgcctacccacagtccacctgatcgccccagtccaaacttgtatgtccgtccgctcctgcatgattggattactctcctccagaatacaagtcatctacgagaaaacctactgcgttaccggacagctcattgaaggcctctgcttcatcccaacacatacaatagcgctcacacagccaggacacacctacgacaccatgaccctgcccgtaacctgcttccttgtagccaagaagctgggcacacaactcaagctagcagtagaactagaaaaactcatcaccggcgtctcttgcaccgaaaactccttccaaggctactacatctgctttataggaaagcactccgaaccactgttcgtcccaaccatggaagactaccgatccgccgaactatttacccgcatggtcttgaacccccgtggcgaagaccacgaccccgaccaaaacggccaaggcctaatgcgcatagcgggcccggtaaccgccaaggtaccctcaacggaaaccacagaaaccatgcagggcatcgcatttgccggagcccccatgtactcgagcttctccacacttgtccgcaaagccgacccagaatacgtgttctcacctgggattatagccgaatcaaatcactcggtatgcgataagaaaactgttcccctcacatggacaggcttcctcgcggtcagcggcgaaatcgagcgaataaccggatgcaccgtattctgcacacttgccggccccggggcctcttgcgaggcatattcggagactggtatcttcaacatcagcagcccgacctgcctggtaaacaaagtccaaaaattccgcgggtccgagcagcgaataaatttcatgtgtcaacgagttgaccaggacgtagtcgtctactgcaacggccaaaagaaagttatactcacgaaaacactggtcatcggacaatgcatatataccttcacatcactcttttcgctaatccctggcgtcgcacactccctagccgtagaactttgcgtgccaggactacatggctgggcgacaactgccctactcattaccttctgcttcggctggctactaatacccaccgtaaccctaataatcttaaaaatcctgcgcctgctaacattctcctgcagtcattactccacagaatccaaattcaaagtcatcctggaacgcgtaaaagttgagtaccagaaaacgatgggcagcatggtctgcgacatatgccaccacgagtgcgaaacagccaaagaactagaaacccacaagaaatcatgccccgaaggccagtgcccctactgcatgacgatcaccgaatctacagagagtgccctccaagctcatttctcgatctgcaaactcaccaaccgtttccaagagaaccttaagaaatcccttaaaagacccgaagtgaagaaaggctgctaccgcaccctcggcgtattccgctacaaatcgcggtgctacgtgggcttagtatggggcatcctcctaaccaccgaactcatcatatgggccgcctccgcagacactcccctcatggaatccggatggtcagacaccgcacatggggtcgggataatccccatgaagaccgaccttgaactagatttcgctcttgcgtcctcctcctcatacagctaccgacgcaaattggtcaatcccgccaaccaagaagaaaccctaccctttcacttccaactagacaagcaagtagtacacgccgaaatacaaaacctgggccactggatggacggaaccttcaacataaaaaccgcattccattgctacggcgaatgcaagaaatacgcatacccatggcagaccgcaaaatgcttcttcgaaaaagactaccaatacgaaacctcctggggatgtaatccacccgactgtcccggcgtcggaacaggatgcaccgcgtgtggcgtatacctggacaaactcagatccgtaggcaaagcatacaaaatagtatccttgaaatacacacggaaagtctgcatccaactaggcacagaacaaacatgcaaacacatcgacgtcaacgactgcctcgttaccccatctgtgaaagtatgcatgatcggaaccatcagcaaactacagcccggtgacaccctcctattcctgggccccctagagcaaggcggaataatactcaaacaatggtgcactacatcttgcgtattcggagatcccggcgacatcatgtcgaccacctccggtatgcgatgccccgaacacacaggctccttcagaaaaatatgcggcttcgctaccacccccacatgcgaataccaaggaaatacggtcagcggcttccaaagaatgatggcaacacgcgacagcttccaatcattcaacgtaactgaaccccacatcacctccaaccgattagaatggatcgatcccgactcctctataaaagaccacataaacatggtactaaatcgagacgtctccttccaagacctctccgacaacccatgtaaggtcgatctccacacccaatcaattgacggggcatggggtagcggagtcggcttcaccctcgtctgtacagtcggcttaaccgaatgcgccaactttataacctcgatcaaagcctgcgactcggccatgtgctacggcgcaaccgttactaacctgctacgcggctcaaacacagtgaaagtagtagggaaaggcggccacagcggatccctttttaaatgctgtcatgacaccgactgcacggaggagggcctggcagcctctccccctcacctcgaccgcgtcaccggctacaaccaaatagactccgacaaagtatacgatgacggcgcgcccccttgcacaatcaagtgctggtttacaaaatccggggaatggctactaggaatcctgaatggcaactgggtcgtggtcgccgtcctaattgtcatccttatcctaagcatactactattcagcttcttctgccccgtacgctccagaaagaacaaagccaactaa

SEQ ID NO: 15174 - RNA, 3423 nt, synthetic construct
  misc_feature 1..3423: note = derived and/or modified CDS sequence (opt11) from SNV(CC107/POR)__KT885045.1__GP
  source 1..3423: mol_type = other RNA
atggtgggctgggtctgtatcttcctggtggtgctcaccaccgccacggccggtctgacccgcaacctgtacgagctcaagatcgagtgcccccacaccgtcggcctgggacagggctacgtgaccggctcggtagagacgacccccatcctgctcacccaggtcgcggacctgaagatcgagtccagctgcaacttcgacctgcacgtgcccgccaccacgacccagaagtacaaccaggtggactggaccaagaagtccagcaccacggagtccaccaacgccggcgccaccaccttcgaggcaaagacgaaggaggtcaacctcaaggggacctgcaacattccgcccaccaccttcgaggcggcttacaagagccggaagacggtgatctgctacgacctggcctgcaaccagacccactgcctgccaaccgtgcacctcatcgcccccgtccagacctgcatgtccgtgcgcagctgcatgatcggcctgctgtccagccggatccaggtcatctacgagaagacgtactgcgtcaccggccaactcatcgaggggctgtgcttcatccccacccacaccatcgcgctgacgcagcccggccacacctacgacaccatgaccctcccggtgacgtgcttcctggtggccaagaagctggggacccagctcaagctggccgtcgagctggagaagctcatcaccggcgtgtcctgtaccgaaaactcattccagggctactacatctgcttcatcgggaagcactccgagcccctgttcgtgcccacgatggaggactaccgcagcgctgagctgttcacccggatggtcctcaacccccgcggcgaggaccacgacccggaccagaacggccagggcctgatgcggatcgccggccccgtgaccgcgaaggtgccctccaccgagaccacggagaccatgcaggggatcgccttcgccggcgcccccatgtacagctcgttcagcaccctggtccgcaaggccgacccggagtatgtgttctcccccggtatcatcgcggagagcaaccacagcgtctgcgacaagaagaccgtgcccctcacgtggacggggttcctggccgtgtccggggagatcgaacgcatcaccggctgcaccgtgttctgcacgctggccggccccggggcctcctgcgaggcctactccgagaccggcatcttcaacatcagctccccgacctgcctcgtgaacaaggtgcagaagttccgcgggagcgagcagcggatcaacttcatgtgccagcgcgtggaccaggacgtggtcgtctactgcaacggccagaagaaggtgattctgaccaagacgctggtcatcggtcagtgtatctacaccttcacctccctcttcagcttaatacccggcgtcgcgcactccctggccgtggagctctgcgtgcccggccttcacgggtgggccaccacggccctgttgatcaccttctgcttcggctggctgctgatccccaccgtcaccctcatcatcctgaagatcctacggctcctgacgttcagctgctcccactacagcaccgagtccaagttcaaggtgatcctggagcgcgtgaaggtcgagtaccagaagaccatggggagcatggtgtgcgacatctgccatcacgagtgcgagaccgccaaggagctggagacgcacaagaagtcctgcccggagggccagtgcccctactgcatgaccatcaccgagagcaccgagtccgcgctccaagcccacttcagcatctgcaaacttacgaaccggtttcaggagaacctgaagaagtccctcaagcgccccgaggtgcggaaggggtgctaccgcaccctcggtgtctttcggtacaagagccgctgttacgtgggcctggtgtgggggatcctcctgaccaccgagctgatcatctgggctgccagcgcggatacgcccctcatggagtccggctggtcggacaccgcccacggggtcggcatcgtgccgatgaagaccgacctggagctggacttcgccctcgcctccagctccagctactcctaccggcgcaagctggtgaaccccgccaaccaggaggagacccttcccttccacttccagctcgacaagcaggtagtgcacgcggagatccagaacctaggccactggatggacgggacgttcaacatcaagaccgccttccactgctacggcgagtgcaagaagtacgcctatccgtggcagaccgccaagtgcttcttcgagaaggactaccagtacgagaccagctgggggtgcaacccgcccgactgccccggcgtggggaccggctgcacggcctgcggcgtctacctggacaagctccgctccgtggggaaggcgtacaagatcgtgagcctgaagtacacccggaaggtctgcatccagctgggcaccgagcagacctgcaagcacatcgacgtgaacgactgcctcgtgacgccaagcgtcaaggtgtgcatgatcgggaccatcagcaagctgcagcctggcgacaccctcctgttcctggggcccctggagcagggcggcatcatcctcaagcagtggtgcaccacgtcctgcgtgttcggggaccccggcgacatcatgagcaccacctccgggatgcgctgcccggagcacaccggcagctttcggaagatctgcgggttcgccacgacaccgacctgcgagtaccagggcaacaccgtctccggcttccagcgcatgatggccacacgggacagcttccagagctttaacgtgaccgagccccacatcacctccaaccgcctggagtggatcgaccccgacagctccatcaaggaccacatcaacatggtgctgaaccgagacgtcagcttccaggacctctccgacaacccctgcaaggtggacctgcacacccagagcatcgacggggcctggggcagtggggtgggcttcacgctggtctgcaccgtggggctcaccgagtgcgccaacttcatcaccagcatcaaagcctgcgactcggccatgtgctacggcgccacggtgaccaacctgctgcgcggcagcaacaccgtcaaggtggtggggaagggcgggcactccggcagcctctttaagtgctgccacgacaccgactgcacggaggagggcttggccgcctccccgccccacctggaccgggtcaccgggtacaaccagatcgacagcgacaaggtgtacgacgacggcgccccgccctgcaccatcaagtgctggttcaccaagtccggggagtggctcctgggcatcctgaacgggaactgggtcgtggtggccgtcctcatcgtgatcctgatcctgagcatcctcctgttctccttcttctgccccgtgcgcaaccggaagaacaaggccaactga

SEQ ID NO: 15175 - RNA, 3423 nt, synthetic construct
  misc_feature 1..3423: note = derived and/or modified CDS sequence (opt11) from HPS(Convict Creek 107)__L33474.1__GP
  source 1..3423: mol_type = other RNA
atggtcggctgggtctgcatatttctcgtcgtcctcaccaccgccacagcaggactcacccgaaacctctatgagctcaaaatcgaatgcccacacaccgtagggctcggacaaggctatgtcacagggtccgtcgaaaccacccccatactactcacccaagtcgcagacctcaaaattgaaagctcctgcaacttcgacttacacgtcccagcaacaaccacccagaaatacaaccaagtcgactggaccaaaaagagctccacaaccgaatccacaaacgccggcgcgacgaccttcgaagccaaaacaaaagaagtcaacctcaaagggacctgcaacataccccctacaaccttcgaagcggcctacaagtcccggaaaacagtcatctgttacgacttagcctgcaaccaaacacactgtctcccaactgtacacctcatcgcgcccgtccaaacctgcatgtctgtgcgctcctgcatgataggcctgctctccagccgcatacaggtaatctacgagaaaacctactgcgtaacgggccaactcatcgaaggactgtgctttataccaacccacaccatcgccctcacccagccaggccacacctatgacacaatgaccctccccgttacctgctttctagtcgccaagaaactaggcacccaactaaagctagccgtcgaactggagaaactcatcaccggcgtaagctgcaccgaaaactccttccagggatactacatatgctttatcggaaaacactccgagcccctcttcgtacccaccatggaggactatcgatccgcagaactcttcaccaggatggtcctcaatcctcgaggagaagaccacgaccccgaccaaaacggtcaaggcctcatgcggatcgccggcccggtaactgcaaaagtaccaagcaccgagactacagaaacaatgcaaggcatagcatttgcaggggcacccatgtacagctcattcagcacactcgtccgcaaagcagaccccgaatatgtgttctcacccggcataatagccgaatccaaccactccgtctgcgacaagaaaaccgtccccctcacatggacgggcttccttgcagtgtccggcgaaatcgagaggatcacaggctgcaccgtgttctgtacacttgcaggccccggcgcgtcatgcgaagcctactccgaaaccggcatcttcaatatttctagtccaacctgcttagtaaacaaagttcaaaagtttagaggctcagaacaacgcatcaacttcatgtgccaacgagtggaccaggacgtcgtcgtatactgcaacggccagaagaaagtcatactcacgaaaactctcgtcatcggccaatgcatttacaccttcacatcactcttctcgctaatacccggagtagcccactccctagccgtagaactatgcgtccccggactccacggctgggccacaaccgccctgcttataaccttctgcttcggctggctactcatacccaccgtcaccctaataattttaaagatcctccgcctcctcactttcagctgcagccactatagcacagaaagtaaattcaaagtaattctagaacgggtcaaggtcgaatatcagaaaactatgggctcaatggtttgcgatatctgccaccatgaatgcgagaccgcgaaggaactcgaaacccacaagaaatcgtgcccagaaggtcaatgcccatactgcatgaccatcaccgagtctaccgagtcggcccttcaagcacacttctcaatctgcaaactgacgaatcgtttccaagaaattcttaagaaatcactcaaacgcccagaagtacgcaaaggatgctaccgcaccctcggggtcttccgctacaaatctcgttgctacgttggcctagtatggggcattctattaactaccgagcttatcatttgggcagcctccgcagacacacctctcatggaatccggatggagcgacaccgcccacggagtcggtatagtccccatgaaaacagacctcgaacttgactttgcattagcaagctcctcaagctactcctaccgccgcaaacttgtcaaccccgccaaccaggaagaaaccctacccttccacttccaactcgacaaacaagttgtgcacgcagagattcaaaacctaggacactggatggacggcacctttaacataaaaacggccttccactgttacggagaatgcaagaaatacgcctacccctggcaaacagccaaatgcttcttcgaaaaggactaccaatatgaaacttcatggggatgcaacccgcccgactgcccaggggtaggcacaggttgcacagcctgcggtgtatacctcgacaagctacgctcggtcggaaaggcctataaaatcgtctccctaaagtacacacgcaaagtctgcatccaactaggcacggaacaaacgtgtaaacacatcgacgtcaacgactgcctggtaaccccatccgtcaaagtatgcatgatcggcaccatctcaaaattacagcccggcgacactctccttttcttaggacccctggaacagggaggaatcatcctaaagcaatggtgcacaacttcttgcgtcttcggcgacccgggagacataatgagcacaacaagcggcatgcgatgcccggaacacacaggctcgttccgaaaaatctgcggattcgccaccacacctacctgtgaataccaaggcaacacggtatcaggcttccagaggatgatggcaacccgcgactcattccaatcctttaatgttacagagccgcacatcacctcgaaccgcctcgagtggatcgaccctgactcgtcaatcaaagatcacatcaacatggttctcaaccgagacgtatccttccaagacctttccgacaacccctgtaaagtagacctccacacccagtccatcgacggcgcctggggctcgggggttggcttcaccctcgtctgcaccgtaggcctcaccgaatgtgcaaactttatcacatcaattaaagcctgtgactctgccatgtgctatggcgccacagtcaccaacctcttacgaggctcaaacacagtcaaagtcgtcggcaaaggcggacacagcggatcattgttcaaatgttgccacgacactgactgtaccgaagaagggctggcagcctcacctccccacctggaccgggtaaccggatataaccaaatcgattcagacaaggtctacgatgatggcgcacccccatgcacaattaaatgctggttcacgcggtccggcgaatggctactcggcatactcaacggaaattgggttgtcgtagccgtactcatagtcatcctaatactctccatacttctattctccttcttctgccctgtccgcaaccgtaaaaacaaggcgaactaa

SEQ ID NO: 15176 - RNA, 3423 nt, synthetic construct
  misc_feature 1..3423: note = derived and/or modified CDS sequence (opt11) from HPS(Convict Creek 74)__L33684.1__GP
  source 1..3423: mol_type = other RNA
atggtcggctgggtatgcatattcttggtagtgctaacaactgccacagccggcttgacaagaaacctatacgaactgaagatcgaatgcccgcacaccgtcggactgggccaaggctacgtaacaggatcagtagaaacaacaccaatcctattaactcaagtagccgacctaaaaatcgaaagctcctgtaacttcgatctgcacgtacccgcgacgaccacccaaaagtataatcaagtcgactggaccaagaaatccagcaccaccgaaagcacgaacgccggcgccaccacctttgaagccaaaacaaaagaggttaacctcaaaggaacctgcaatatacctcccaccacattcgaagctgcattcaagtcccgaaaaaccgtcatatgctatgacctggcatgcaatcagacccactgcctcccgaccgttcacctaattgctccggtacaaacatgcatgtccgtccgctcgtgcatgatcggcctcctcagctctagaatacaagtcatctacgagaaaacgtactgtgtcacaggccaactcatagaaggactgtgcttcatacccacacacacaatcgcactcacgcagcccggtcacacctacgacaccatgacgttacccgtaacttgcttcctcgtcgccaaaaagctgggaactcagctcaaattagccgtcgaactagaaaaactcataacgggcgtctcttgcactgaaaactcattccaaggctactacatctgtttcataggtaagcactccgaaccactcttcgtgcctaccatggaagactacagatcggccgaattattcacgcggatggtcctcaacccccgtggtgaagaccacgaccctgaccagaacggccaaggcctaatgaggatcgcaggcccagtaaccgctaaagtacccagcaccgagaccaccgaaaccatgcagggcattgcattcgccggagcccccatgtactcatctttcagcaccctcgtccgcaaagcagaccccgagtacgtattctcgcccggaattatcgccgaaagcaaccactccgtctgcgataagaaaaccgtaccgctcacatggaccggcttccttgcggtctccggagaaatagaacgaatcacaggctgcacagtcttctgtaccctcgcaggcccgggcgccagctgcgaagcgtacagcgagaccggcatcttcaacatttcatctccaacctgccttgtgaacaaagtccaaaaattccgcggctcagagcaaagaatcaacttcatgtgccaacgagtcgaccaggacgtcgtagtatactgcaacggacaaaagaaagtcatcctgaccaaaaccctagtaataggccaatgcatttacacattcacatctttgttcagcctcatccctggcgtagctcactcgcttgcggttgagctttgcgtcccaggcctacacggctgggccacaactgcactactcataaccttctgctttgggtggttgctgatacccaccgtcactctcatcattcttaaaatcctacgcctactcactttcagctgctcacactactccaccgaatccaaattcaaagtaattctggaacgcgttaaagtagaataccagaaaacgatgggaagcatggtttgcgacatctgccaccacgaatgcgagaccgccaaggaactcgaaactcacaaaaagagctgcccggagggccaatgcccctactgtatgacaataaccgaaagcacggaatcagcccttcaggctcacttctcaatatgcaagctcaccaaccgatttcaagagatactcaagaaaagcctaaaacgtcccgaagtacgcaaaggctgctatcgtactctcggcgtattccggtacaaatcgcgctgctatgttggcctagtatggggcatcctcctcacaacagaactaatcatctgggccgcttccgcggacacgccccttatggaatccgggtggtcagataccgcccacggagtgggaatcgtccccatgaaaacagacctcgagctagatttcgctctagcgtcctcctcctcatactcgtacagaaggaagctagtcaaccccgcaaaccaagaagagacactcccgttccactttcaactcgacaaacaagtagtgcacgccgagatacaaaacctaggccactggatggacggcaccttcaacatcaagaccgcattccactgctacggggagtgcaagaaatacgcctacccatggcagacagcaaaatgcttcttcgaaaaagactaccaatacgaaaccagctggggctgcaacccaccagactgccccggcgtcggcacaggatgcacagcatgcggagtctacttagacaaactccgaagcgtgggcaaagcatacaaaatcgtctcactcaaatacacccgtaaagtctgcatacaactcggcacagaacagacgtgcaaacacatcgacgtcaacgactgcctggtcaccccctccgtaaaagtgtgcatgataggaaccatctcaaaattacaacccggtgacaccctcctcttccttggtccactcgaacaaggtggcattatcctaaaacaatggtgtaccacctcctgcgtatttggcgacccgggagatatcatgagcaccacttcaggcatgcgctgccccgaacacactggcagcttccgcaaaatctgtggattcgccaccacaccgacctgcgaataccaaggaaacacagtctcaggattccagcgaatgatggccaccagagactccttccaatccttcaacgtcacggaaccacacatcacgtcaaacaggctagagtggatcgacccagacagctcaatcaaagaccacattaacatggtactcaatcgtgacgtcagcttccaagatctctcagataacccgtgcaaagtagatctacacactcaaagcatagatggagcttggggtagcggcgtaggatttacccttgtatgtaccgtcggcttaacagaatgcgcgaacttcatcacctccataaaggcgtgcgactccgcaatgtgctacggggcgaccgtgacaaacctcctccgcggtagtaataccgtgaaggtcgtcggcaagggcggccattctggcagtcttttcaaatgctgccacgacaccgactgtacagaggaaggcctcgcagcctcccctccccatttagaccgggtaacaggctacaaccagatcgactccgacaaagtctacgacgacggcgcccctccctgtacaatcaaatgctggtttaccaaatcaggcgagtggctactaggtatattaaacggcaactgggtagtcgtcgcagtcctcatcgtaatactgatcctctcaatcctccttttctcattcttctgccccgtcaggaaccgcaaaaacaaagcaaactag

SEQ ID NO: 15177 - RNA, 3423 nt, synthetic construct
  misc_feature 1..3423: note = derived and/or modified CDS sequence (opt11) from BRV(Indiana)__AF030551.1__GP
  source 1..3423: mol_type = other RNA
atggtgggctgggtatgcatcttcctggtggtcctaaccaccgccacggccgggctgacccgcaacctgtacgagctcaagattgagtgcccccacaccgtcggcttggggcagggctacgttactgggagcgtggagaccacccccgtccccctgggacaggtgaccgatctcaagatcgagtccagctgcaacttcgacctgcacgtgccctccaccacgatccagaagtataaccaggtcgagtgggcgaagaaaacctccacaaccgagtccacgaacgccggagccagcacgttcgaggcaaagaccaaggaggtgaacctaaaagggacctgcaacatccccgtcactaccttcgaggccgcgtacaagtcccggaaaaccgtcatctgctacgacctggcctgcaaccagacccactgcctgccgacggtgcatctgatcgcccccgtgcagacatgcatgagcgttcgctcctgcatgatcggcctcctgagctcgcggatccacgtgatctacgagaagacctactgcgtgaccgggcaagtggtagagggcctgtgctttatccccacgcataccatagcactcacccagccggggcacacctacgacacgatgaccctaccgattacctgctttctagtagccaagaagctcggcactcagctgaagatcgcggtagaactggagaagctcatcacggccagtggctgcaccgagaactccttccaggggtactacatctgtttcttgggcaagcatagcgagcccctgtacgtccccaccatggacgactaccgctcagctgaactgttcacccggatggtgctcaaccccaagggggaggaccacgatccggaccaagacggccagggcctgatgcgcatcacggggcccatcaccgccaaggtccccagcaccgagaccaccgagacgatgcagggcgtggcattcgctgggacccccatgtacagctccttctccaccctcctccggaaggccgacccggagtacgtcttctctcccggcatcatcccagagagcaaccactccgtgtgcgacaagaagaccatgcccatcacgtggactgggttcctggccgtgagcggcgagatcgagaagatcaccggctgtaccgtcttctgcaccctcgccggcccgggcgcttcctgcgaagcctacagtgaaaccgggatcttcaacatctccagcccgacctgcctggtgaataaggtgcagaagttccgaggctccgagcagcgggtcaacttcatgtgccagagggtggaccaggacgttgtcgtatactgcaacgggcagaagaaggtgatccttacaaaaacactcgtaatcggccagtgcatctacaccttcaccagcctgttctccctgctccccggcgtggcccacagcctggccgtggaactgtgcgtccccgggctccacggatgggctaccacggcactgctgatcaccttctgcttcgggtggctgctgatcccctccgtgacactgattatcctccggatcctgcgcctgctcaccttttcctgctcccactacagcacggagtctaagttcaagatcctgctggagaaggtgaaggtcgagtatcagaaaaccatgggcagcatggtgtgcgacatctgccatcacgagtgtgagaccgccaaggagctggatacccaccggaagtcctgccccgaggggcagtgtccctactgcatgacgatgaccgagtccaccgagtccgccttacaagcccactttagtgtatgcaagctgaccaaccgcttccaggagaacttaaagaagagtctcaagcaccccgaggtcaagcaaggctgctaccggacgttgggcgtgttccgctacaagtccaggtgttacgtggggctggtatggggcatcctcctgaccgccgaactcatcatctgggcggccagcgccgagaccccgctcatggagagcgggtggagcgacaccgcccacggtgtgggaatcgtgcccatgaagacggacctggagctggacttcgcgctcgcctctagctccagctattcctatcgccggaagctcgtcaacccagccaactccgaagagaccttaccgtttcatctccagttggagaagcaggtcgtgcacgccgagatccacaatctggggcactggatggacggcacattcaacatcaagaccgccttccactgttatggggaatgcaagaagtacgcgtatccctggcagactgcgaagtgcttcttcgagaaggactatcagtacgagacctcgtggggctgcaacccgcccgactgccccggagtaggcaccggctggaccgcctgcggcgtctacctcgacaaactgcgcagcgtgggcaaggcctacaagatcgtctccctgaagtacacccgcaaggtatgtattcagctcgggacggagcagacttgcaagcacatcgacgtgaatgattgcctggtcacccccagcgtgaaagtttgcatgatcggcaccgtctccaagctgcagccaggggacacgctcctgttcttgggccccctcgaacagggtggaatcatcctgaaacagtggtgcaccaccagctgcgtgttcggcgatccgggggacataatgtccaccaccagcggaatgaagtgccccgagcacaccgggagcttccgcaagatctgcggctttgcgaccacccccacgtgcgagtaccagggcaacaccgtgtccggtttcaagcgcatgatggcgacccgagacagcttccagtcctttaatgtcaccgagccccacatcacgtcaaaccgcctggagtggatcgacccggactccagcatcaaggatcacataaacgtggtgttaaaccgggacgtctccttccaggacttaagcgacaacccctgtaaggtggacctgcacacccagtcaatcgacggcgcctggggaagcggcgtggggttcaccctcgtctgcaccgtcggcctgacggagtgcgccaacttcatcacctccattaaagcctgcgacctggccatgtgctacggcgcaaccgtgaccaatctcctgcgggggagcaacacggtcaaggttgtcggcaaaggcgggcactccggcagcctgttcaagtgctgccatgacaccgactgtaccgacgaagggttggccgcctccccgccccacctggaccgggtgaccggcttcaaccagatcgacagtgacaaggtgtacgacgacggggccccgccctgtagcgtcaagtgttggttcacaaagagcggcgaatggctgctccgcatcctgaacgggaactggatggtggtggcggtcctgatcgtcatcctcatcctctccatcctccttttcagcttcttctgccccatccgatcccgcaagtcaaagccaaactaa

SEQ ID NO: 15178 - RNA, 3423 nt, synthetic construct
  misc_feature 1..3423: note = derived and/or modified CDS sequence (opt11) from BRV(Oklahoma)__AF030552.1__GP
  source 1..3423: mol_type = other RNA
atggtcggatgggtatgtatattcctcgtagtcctaacaacctcaactgccggcctcacccgaaacctgtatgaactaaagatcgaatgtccacacaccgtcgggctcggccaaggctacgttactggatccgtcgaaatcaccccagtaccccttggacaagttaccgacctaaagatcgaatcatcctgcaatttcgacctccacgtcccctcaacaaccatacaaaagtacacacaggtagagtgggccaagaaatcgtccacaaccgaaagcacaaacgctgccgccaccacattcgaagccaaaaccaaagaagttagcctaaaaggcacttgcaacatccccgttaccacgttcgaagccgcctacaaatcacggaaaaccgtcatctgctatgacctcgcctgcaaccaaactcactgcttaccaacagtacacctcatagcgcctgttcagacttgtatgtcagttcgatcatgtatggtcgggctcctctcatcccgaatacaagttatctacgagaaaacctactgcgtcacaggtcaactcgtagaaggcctctgctttatccccacccacacgatagccctcacccaaccgggccacacctacgacacaatgaccttacccatcacgtgctttctagtcgcaaagaaactcggcacgcagctgaaaatcgccgtcgaactcgaaaaactcataacagcgtccggctgcactgaaaacagcttccaaggatactacatctgcttcctaggcaaacacagcgagcccatgtacgtaccgactatggacgactatcgatccgcagaactcttcaccagaatggttctaaatcccaaaggcgaagaccatgacccagaccagaacggccagggacttatgcgtatagccggacccatcaccgcaaaagtccccagcacagaaacaacagaaacaatgcaaggcatcgccttcgccggtgcgcccatgtactccacattcgccactcttgtccgcaaagccgaccctgaatacgtattttcacctggaataataccggaaagcaaccactcggtgtgtgataagaaaaccatgccaatcacctggaccggcttcctagcactctccggtgaaatcgaaagaataactgggtgtaccgtattctgcaccctcgcaggccccggtgcctcctgcgaagcctactccgagacaggcattttcaacatatcctcgccgacatgcctagtcaacaaagtccagaaattccgcggctcagaacaacgcatcaacttcatgtgccagcgagttgaccaggatgtcgtcgtgtactgcaacggccagaagaaagttattctcaccaaaactcttgtcatcggacaatgcatctacaccttcacgtcactgttttcccttctcccaggcgtcgcacactcgctcgccgtagagctatgcgtaccaggtttacacggctgggctaccaccgccctgcttattacattctgctttggatggctcctgatcccagcaatcaccctgatagtactcaaaatactacgcctcctaaccttctcctgctcgcactactccaaagaatcgcggttcaaaatacttctcgaaaaagtaaaagtagaataccagaaaacaatgggatccatggtgtgcgacatctgccaccacgattgcgagacggccaaagaactcgacacccacaaaaagagctgccccgagggacaatgcccgtactgtatgacgatgaccgaatcaactgaatctgccctccaagcccacttctccgtatgcaaactcaccaaccggtttcaggaaaaccttaagaagtccctcaaacaccccgaagtaaagcaaggctgctacaggacactcggcgtcttccgatacaaatccagatgctacgtagggctagtatggggtcttttactcaccaccgagcttataatctgggcagcctcagccgaaaccccgctaatggaaagcggctggtctgacaccgcccacggcgttgggatcgtacctatgagaaccgacctcgagctggacttcgccctcgcatcctcatcaagctacagctaccgccgcaagctagtcaaccctgcaaacacagaagaaaccctcccttttcacctccaactagagaaacaagtcgtccacgcagaaatacaaaaccttggccactggatggacggaacctttaacatcaaaaccgccttccactgctacggcgaatgcaagaaatacgcgtacccctggcaaactgcaaagtgcttctttgagaaagactatcaatacgaaacaagctggggctgcaatccgcccgactgccccggagtaggcacgggctgcacagcatgcggagtatatctcgacaaactccgcagcgttggaaaagcctacaagatcgtctctttgaaatacaccaggaaagtctgcatccagcttggcacagaacagacctgcaaacatatcgatgtcaacgactgcttagtgtccccctccgtcaaggtctgcatgatcggcaccgtgagcaaactgcaacccggtgacaccctactctttctgggcccactggaacaaggcggcataatactcaaacaatggtgtaccaccagttgcgtattcggcgacccaggtgacataatgtcaacaacctcaggcatgcgctgcccggaacataccggcagcttccgcaaaatatgcggcttcgccaccacacctacatgcgaataccaaggcaacaccatttctggattcaaacgaatgatggcgactcgcgactcattccagagcttcaatgtcacagaaccccacataaccagcaaccgcctcgagtggatcgacccagactcttccatcaaagaccatatcaacgtcgttctaaaccgcgacgtctccttccaagacctctcggacaacccatacaaggtcgacctgcatacccaatctatcgacggcgcctggggctcaggcgtcggattcacgctcgtatgtatagtcggcctaaccgaatgcgcgaacttcataacctccatcaaagcctgcgacatggccatgtgctacggcgcaaccgtcacaaacctcctacgcggcagtaataccgtaaaagttgtcggtaagggcggccactcaggctcacttttcaagtgttgccacgacacagactgcacggaagaaggcctagcagcttccccaccccatttagatcgagtgacgggctacaaccaaatcgactcagacaaagtgtgtgatgacggagcgcccctctgcagcgtcaagtgctggttcaccaaatcaggcgaatggctactcgggatcctcaacggaaactggatggtcgtcgcagtcctggtcgtgattctcatacttagcatccttctattctccttcttctgccccattcgcagcaaaaagtccaaacccaactga

SEQ ID NO: 15179 - RNA, 3399 nt, synthetic construct; identical to SEQ ID NO: 11893
  misc_feature 1..3399: note = derived and/or modified CDS sequence (opt11) from THAIV(Thai749)__L08756.1__GP
  source 1..3399: mol_type = other RNA

SEQ ID NO: 15180 - RNA, 3426 nt, synthetic construct
  misc_feature 1..3426: note = derived and/or modified CDS sequence (opt11) from TULV(Moravia/5302v/95)__NC_005228.1__GP
  source 1..3426: mol_type = other RNA
atgttctgcctttgccttagcctcctgggcctcctactatgctggcccgcggccaccagaaacctcctcgaactcaaagtcgaatgcccacacaccataggactaggccaaggtatagtgattgggtccgcagaactacccccagtccccctcgcgaaagtagaatccctgaaactcgagagctcgtgtaacttcgacctccacacctccacagcagcacagcaagcgttcacaaagtggtcctgggaaaagaaagcggataccgccgaaaacgccaaagccgctagcaccaccttccagtcctcaagtaaagaggtacaactacgagggctctgcgtaataccaacccttgttctagaaacagccagccgcacacgaaaaaccgtcacttgctttgacctttcatgcaaccaaacagtatgccagcccaccgtatatcttatggcccctatacaaacatgcgtaaccacgaaatcctgcctccttggtctcggagatcaacgtatccaggtcgtatatgagaaaacctactgcgtctcaggccaactgatagaggggaactgcttcaaccccctccacaccattgcaatctcccaacccacccacacttacgacatcatgaccctcgccgtccattgcttctttatcagcaagaaaggtggcactgacgacacactaaaaatagaaaaacaattcgagacacttgttgaaaagactggatgcacagagaatgcgctaaaaggttactacgcttgcatcctcggtacaagctccgaagtagtatacgtccccgctatggacgattatcgatcttccgaaatcttaagccgaatgacgacggcaccccatggggaagaccacgacatcgatccaaacgccatatcatcacttcgcatcgtcggacaactcactggcaaggccccatcaaccgagagttccgataccgtacaaggaatagcgttcgccggtacacccctatacaccagcacctccatactcgtccggaaagaagaccccatttacctatggagccccggcattatacctgagggaaaccactctcaatgcgacaagaaaacactacccctcacgtggacaggcttcatcacactccccggcgagattgagaaaaccacccaatgcacagtcttctgcaccctctccggacccggcgctgactgcgaagcctactcggacacaggcatattcaacatatcgtcacccacttgcctagtaaaccgtgtccagcgcttccgaggagcagaacaacaggtgaaattcgtctgccagagagtagacctcgacataacagtttactgcaatggcgtcaaaaaggtaatcttgaccaaaacactcgtaataggacaatgcatttacaccttcacctccatcttctcgctcatgccgggcgtcgcccactccctcgccgtcgaactctgcgtccccgggctccacggttgggcaaccatctccctcctcatcactttctgcttcggttggctggccatcccgctcctttctatgataatcatccgattcctcctaatatttacgtacctctgctctaaatacagcaccgactcaaaatttaagctcatcatagaaaaagtaaaacaagaataccagaagaccatgggttccatggtatgtgaagtctgccagcaaggatgcgagaccgccaaagaactcgaatcccacaaaaagagctgccctcatggccaatgtccctactgccttaaccccactgaagcgacagaaagcgcccttcaagcccacttcaaagtatgcaagctgaccacgcgattccaagaaaacttgaaaaagagcctgtccacctacgaaccgaaacggggcctctaccgaaccctttcaatgttccgatacaaatccaagtgctatgtagggctagtatggtgtatactcttaaccatggaactaatcgtctgggccgcctccgcagagaccatcaacctagaacccggctggaccgacacagcccacggctccggcatcatccccctcaaaacagacctcgaactagacttctccctcccaagctccgctacatacacctaccgaagagagcttcaaaaccccgccaacgagcaggagaaaataccattccactttcaaatggaacgccaggttatccacgcagaaatacaacacctgggccactggatggacggaacattcaacctcaagacagccttccattgctacggcagctgcatcaaatacgcctacccatggcagacagccaaatgcttcctggaaaaggacttcgagttcgaaactggatggggatgcaatccgcccgactgccccggtgtcggaaccggctgcaccgcttgcggcgtctatctagacaaactacgctctgtcgggaaagtatacaaaatactctccctcaaatatacccgcaaggtatgcatccaactcggaaccgaacaaacatgcaaaactatagacagcaacgactgcctagttaccacgagtgtcaaagtctgcatgatcggtacaatttctaaattccaaccaggcgacacactcctcttcctcggacccctagaagagggtggcatgatcttcaaacagtggtgcacaactacctgccaattcggagaccccggagacatcatgagcacccccttaggcatgaagtgcccagagcatgcaggctccttccgcaagaaatgtagctttgccaccttacccagttgccaatacgatggtaacaccgtctccggataccaacgaatgatagcgacgaaagactccttccaatccttcaacatcaccgaaccccatataactacaaactccctcgaatgggtagacccagactctagcctaaaagaccacgttaatctcatcgtcaaccgcgacctctcattccaagacctcgcagaaaacccctgccaagtggacctgtctgtcagttcaatcgacggagcgtggggcagtggcgtcggattcaatcttgtctgctccgtatcactaactgaatgcgccagtttcctcaccagcattaaagcgtgcgactcggccatgtgctatgggtcgtctaccgctaatttagtaagaggccaaaatacagtccacgtcgtcggaaaaggcggacactccgggtcaaaattcatgtgttgccacgacaagaagtgcagcgccaccggactcgtagccgccgcaccccacctcgaccgagtgaccggttataaccaaatagacacaaacaaagtcttcgacgatggtgccccacagtgcggagttcactgttggttcaagaaatcaggagagtggctcctgggcatcctcagtggcaactggatggtcgtcgccgttctcatcgccctctttatattcagcctactcctattctccctttgctgtcctcgacgccagaactacaagaaaaacaaatag

SEQ ID NO: 15181 - RNA, 5055 nt, synthetic construct
  misc_feature 1..5055: note = derived and/or modified CDS sequence (opt11) from CCHFV(10200)__U39455.2__GP
  source 1..5055: mol_type = other RNA
atgcacatcagcctgatgtacgccatcctctgcctacagctgtgcgggctcggggagacccacggctcccacaacgagacccgccacaacaagacggacactatgaccactcacggggacaaccccagctcagagccgcccgtgagcacggccctgtccatcacgctggacccctcaaccgtgacccccacgaccccggcgtccggcctcgaggggagcggcgaggtgtacacctccccgcccatcaccacgggcagcctgcccctgtccgagaccacccccgagctccccgtgaccacggggaccgacaccctgagcgccggcgacgttgacccctccacccagacggccgggggcaccagcgctcccaccgtgcggacctccctgccgaactcaccctccacgcccagcacgccccaggacacccaccacccggtgcgcaacctcctgtccgtcactagccccgggcccgacgagaccagcaccccctccggcaccggcaaggagagctccgccaccagttccccgcaccccgtgagcaaccggccgcccacgccgcccgcgaccgcccaggggcccaccgagaacgactcccacaacgccaccgagcaccccgagagcctgacgcagtccgccacccccggcctcatgaccagccccacccagatcgtgcacccccagtccgcgaccccaatcacggtccaggacacccaccccagccccaccaaccgctccaagcggaacctgaagatggagatcatcctgaccctcagccaggggctgaagaagtactacggcaagatcctgcgcctcctgcagctgacgctcgaggaggacaccgagggcctgctggaatggtgcaagcggaacctcgggctggactgcgacgacaccttcttccaaaaacgcattgaggagttcttcatcaccggcgaggggcacttcaatgaggtgctgcagttccggacgccgggcaccctctccaccaccgaaagcacgccggccgggctgcccaccgccgagccattcaagtcctacttcgccaagggctttctgagcatcgactccggctactacagcgccaagtgctacagcgggacctccaacagcggcctccagctaatcaacatcacccgccactccacgcggatcgtggacacacccgggccgaagatcaccaacctgaagaccatcaactgcatcaacctcaaggctagcatcttcaaggagcaccgcgaggtcgagatcaacgtgctgctgccccaggtggccgtcaacctctccaattgccacgtcgtgatcaagagccacgtctgcgactactccctggacatcgacggcgccgtgcggctgccccacatctaccacgagggtgtgttcatccccggcacgtacaagatcgtcatcgacaagaagaacaagctcaacgaccgctgcaccctgttcactgactgcgtgatcaagggccgggaggtccgcaaggggcagagcgtcctgcggcagtacaagaccgagatccgcatcggcaaggcctccacggggttccggcggctcctgagcgaggagccgtccgacgactgcgttagccggacccagctgctccgcaccgagaccgccgagatccacggcgacaactacggcgggcccggggacaagatcacgatctgcaacggttctaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggatactgcctccgcatcacgcaggaggggcggggccacgtgaagctgagcagggggagcgaggtggtcctggacgcctgcgacacctcctgcgagatcatgatccccaagggaaccggggacatcctcgtggactgcagcggcggccagcagcacttcctgaaggacaatctgattgacctcgggtgcccgaagatccccctgctgggcaagatggccatctacatctgtcggatgtcaaatcaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagactaccccggtaaacgcgatcgacgcagagatgcacgacctgaactgctcctacaacatctgcccctactgcgccagccggctgacctccgacggcctcgcccgccacgtgatccaatgccccaaacggaaggagaaggtcgaggagaccgagctgtacctgaacctcgaacgcatcccctgggtggtccggaagctgctgcaggtcagcgagtccacgggcgtggcccttaagcgcagctcctggctgatcgtgctgctcgtactgttcaccgtgagcctgtccccggtgcagagcgcgcccatcgggcagggcaagaccatcgaggcctaccgggcccgcgaggggtacacctccatctgcctcttcgtcctgggcagcatcctgttcatcgtgagttgcctcatgaaggggctggtggactccgtcggcaactccttcttccccggcctgagcatctgcaagacgtgcagcatctccagcataaatgggttcgagatcgagtcccacaagtgctactgcagcctcttctgctgcccgtactgccggcactgctccaccgacaaggagatccacaagctgcatctatccatctgcaagaagcgcaaaaccggctccaacgtgatgctcgccgtgtgcaagctgatgtgcttccgcgcgacgatggaagtcagcaatcgtgccctgttcatccgctccatcatcaacacgaccttcgtgctctgcatactgatcctggccgtgtgcgtcgtgagcacctccgccgtggagatggagaacctccccgccgggacctgggagcgggaggaggacctgacgaacttctgccaccaggagtgccaggtcaccgagaccgagtgcctgtgcccctacgaggcgctcgtgctgcggaagcccctgttcctcgacagcaccgccaagggcatgaagaacctgctgaactctacgagcctcgagacgtccctgagcatcgaggccccgtggggcgccatcaacgtgcagtccacctacaagcccaccgtcagcacggccaacatcgcgctgtcctggagctctgtggagcaccgggggaacaagatcctcgtgtccggccgtagcgagtccatcatgaagctggaggagcggaccgggatcagctgggacctgggcgtcgaggacgcctccgaaagcaagctcctgaccgtgtccgtgatggacctgagccagatgtacagccccgtcttcgagtacctcagcggggaccgccaggtggaggagtggcccaaggcgacctgcacgggcgactgcccggagcggtgtggctgcacatccagcacgtgcctgcacaaggagtggccccactcccgcaactggcggtgcaaccccacctggtgctggggcgtggggaccgggtgcacgtgctgcggtctggacgtcaaggacctcttcaccgactacatgttcgtgaagtggaaggtggagtacatcaagaccgaggccatcgtctgcgtggagctgaccagccaggaacgacagtgctccctgatcgaggccgggacccggttcaacctcggccccgtgaccatcaccctgagcgagccgcgcaacatccagcagaagctgccgcccgagatcatcactctccacccccggatcgaggagggcttcttcgacctgatgcacgtccagaaggttctgtccgccagcacggtctgcaagctccagtcctgcacccacggggtgcccggggatctccaggtgtaccatatcgggaacctgctgaagggcgacaaggtcaacgggcacctgatccacaagatcgagccccactttaacaccagctggatgagctgggacggttgcgacctggactactactgcaacatgggcgactggccctcctgcacctacacgggggtgacccagcacaaccacgccagcttcgtgaatctcctgaacatcgagacggactacacgaagaacttccatttccactccaagcgcgtcacggcgcatggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatcagctgcaaggtgcgcatccacgtggacgagcccgacgagctgaccgtccacgtcaagagcgacgaccccgacgtggtcgcggcctccagctccctcatggcccggaaattagagtttggcaccgacagcacgttcaaggccttctccgccatgcccaagaccagcctgtgcttctacatcgtggagcgcgagcactgcaaatcctgcagcgaggaggacaccaagaagtgcgtgaacaccaagctcgagcagccgcagtccatcctgattgagcacaaggggacgatcatcggcaagcagaactccacgtgcaccgcgaaggccagctgctggctggagagcgtcaagagcttcttctacgggctgaagaatatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccatctgaaggacgacgaggagaccggctaccggcgcatcatcgagaagctcaacaacaagaaggggaagaacaagctgttggacggcgaacggctcgccgacggccgcatcgccgagctgttcagcaccaagacccacatcgggtag

SEQ ID NO: 15182 - RNA, 5055 nt, synthetic construct
  misc_feature 1..5055: note = derived and/or modified CDS sequence (opt11) from CCHFV(IbAr10200)__AF467768.2__GP
  source 1..5055: mol_type = other RNA
atgcatatcagcctgatgtacgccatcctctgcctgcagctgtgcggcctcggggagacccacggctcccacaacgagacccgccacaacaagacggacaccatgacgacccccggggacaacccgagctccgagccgcccgtgagcacggccctgtcgatcaccctggaccccagcacagtcacccccacgacccccgcgtccggcctcgagggctcgggcgaggtgtacacctccccgcccattaccaccgggagcctgcccctgtccgagaccacccccgagctccccgtgaccacggggaccgacaccctgagcgccggcgacgtcgacccctcaacccagacggccgggggcaccagcgcaccgaccgtgcggacctccctgcccaactctccctccacgcccagcaccccgcaggacacccaccaccccgtgcgcaacctcctgtccgtcaccagccccgggcccgacgagacgagcaccccgtcaggcaccggcaaggagagctccgccaccagcagcccccaccccgtgagcaaccggcccccgacgccgcccgcgaccgcccaggggcccaccgagaacgattcccacaacgccaccgagcaccccgagagcctgacgcagtccgccacccccggcctcatgaccagccccacccagatagtgcacccgcagtccgcgacgcccatcacggtccaggacacccaccccagccccaccaaccgctccaagcggaacctgaagatggagatcatcctgaccctcagccaggggctgaagaagtactacggcaagatcttgcgcctcctgcagctgacgctcgaggaagacaccgagggcttgctggagtggtgcaagcggaatctcgggctggactgcgacgacaccttcttccagaagcgcattgaggagttcttcatcaccggcgaggggcacttcaatgaggtgctgcagttccggacgccgggcaccctctccaccaccgagagcacgcccgccgggctgcccaccgccgagcccttcaagtcctacttcgcgaagggcttccttagcatagactccggctactacagcgccaagtgctacagcgggacctccaacagcggcctccagctgatcaacatcacccgccactccacgcggatcgtggacaccccggggcccaagatcaccaacctgaagaccataaactgcatcaacctcaaggcgagcatcttcaaggagcaccgcgaggtcgagatcaacgtgctgctgccacaggtggccgtcaacctctccaactgccacgtggtgatcaagagccacgtctgcgattactccctggacatcgacggcgccgtgaggctgccccacatctaccacgagggggtgttcatcccgggcacgtacaagatcgtcatcgacaagaagaacaagctcaacgaccgctgcaccctgttcaccgactgcgtgataaagggccgggaggtgcgcaaggggcagagcgtcctgcggcagtacaagaccgagatccgcatcggcaaggcctccacggggagccggcgcctcctgtccgaggagcccagcgacgactgcatctcccggacccagctgctccgaaccgagaccgccgagatccacggcgacaactacgggggccctggcgacaagatcacgatctgtaacgggagcaccattgtggaccagcgcctgggctccgagctggggtgctataccatcaacagagtccgctcgttcaagctgtgcgagaactccgcgaccggcaagaactgcgagatcgacagcgtgcccgtgaagtgccggcagggatactgcctccgcatcacgcaagaggggcggggccatgtcaagctgagccgcgggtccgaggtggtgctggacgcctgcgacaccagctgcgagatcatgatcccgaagggcaccggggacatcttggtcgactgctccggcgggcagcagcacttcctgaaggacaacctgatcgacctcgggtgccccaagatccccctgctgggcaagatggccatctacatctgccgtatgagcaaccaccccaagaccacgatggccttcctcttctggttctccttcgggtacgtgataacctgcatcctgtgcaaggccatcttctacctgctcatcatcgtgggcaccctgggaaagcgcctgaagcagtaccgtgagctcaagccgcagacctgcaccatctgcgaaacgacgcccgtcaacgcgatcgacgccgagatgcacgacctgaattgcagctacaacatctgcccctactgcgcctccagactgaccagcgacggcctcgcccggcacgtgatccagtgccccaagcgcaaggaaaaggtggaggagaccgagctgtacctgaacctcgagcggatcccgtgggtcgtgcgcaagctgctccaggtgtccgagagcacgggcgtggccctgaagcggtccagctggctgatcgtgctgctggtgctgttcacagtctccttaagcccggtgcagtccgcgcccatcgggcagggcaagaccatcgaggcctaccgcgcccgggaggggtacaccagcatctgcctcttcgtgctgggctccatcctgttcatcgtcagttgcctcatgaaggggctggtggactccgtgggcaacagcttcttcccgggtctgagcatctgcaagacgtgctccatcagctccatcaacgggttcgagatcgagagccacaagtgctactgctccctcttctgctgcccctactgccgccactgcagcaccgacaaggagatccacaagctgcacctgtccatctgcaagaaacggaagaagggcagcaacgtcatgctcgccgtgtgcaagctgatgtgcttccgcgcaaccatggaggtgagcaaccgcgccttgttcatccggtcaatcatcaacaccacgtttgtcttatgcatcctgatcctggccgtgtgtgtggtctccaccagcgccgtggagatggagaacctccccgccgggacttgggagcgcgaggaagacctgaccaacttctgccaccaggagtgccaggtgacggagaccgagtgcctgtgcccctacgaggcgctcgtcctgcggaagccgctgttcctcgactccaccgccaagggcatgaagaacctgctgaacagcacctccctcgagacgagcctgtccatcgaggccccgtggggcgccatcaacgtgcagagcacttacaagcccaccgtgtccaccgccaacatcgcgctgagctggagcagcgtcgagcatcgcggcaacaagatcctcgtgagcggacggtccgagtcgatcatgaagctggaggagcgcacggggatctcctgggacctgggcgtggaggacgccagcgagtccaagctcctgaccgtcagcgtaatggacctgtcccagatgtacagccccgtgttcgagtacctctccggggaccggcaggtcggcgagtggccgaaggcgacctgcaccggcgactgccccgagcgctgcgggtgcacgagctccacctgtctgcacaaggaatggccacacagccggaactggcgctgcaaccccacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgacctcccaggagcggcagtgcagcctgatcgaggccggcacgcgcttcaacctcggcccggtgaccatcaccctgtccgagccccggaacatccagcagaagctgccgcccgagatcatcaccctccacccccgcatcgaggaggggttcttcgacctgatgcacgtgcagaaggtcctgtctgcctccaccgtgtgcaagctccagagctgcacgcacggcgtccccggggacctccaggtgtaccacatcggcaacctgctgaagggggacaaggtaaacggccacctgatccacaagatagagcctcacttcaacaccagctggatgtcctgggacggctgcgacctggactactactgcaacatgggggactggcccagctgcacctacacgggcgtcacgcagcacaaccacgcctccttcgtgaacctcctgaacatcgagaccgactacaccaagaacttccacttccacagcaagcgggtgaccgcccacggggacacgccgcagctggacctcaaagcccgccccacctacggagcgggggagatcaccgtcctggtggaggtggccgacatggagctgcacaccaagaagatcgagatctcgggcctcaagtttgccagcctggcctgcaccggctgctacgcctgctccagcggaatctcctgcaaggtccggatccacgtggacgagcccgacgagctgaccgtgcacgtcaagagcgacgaccccgacgtggtggcggcctccagctccctcatggcacgcaagctggagttcggcaccgacagcaccttcaaggccttctccgccatgccgaagacgagcctgtgcttctacatcgtcgagcgggagcactgcaagtcctgctccgaggaggacaccaagaagtgcgtgaacaccaagctcgagcagccccagtccatcctgatcgagcataaggggaccatcatcggcaagcagaacagtacgtgcaccgcgaaggccagctgttggctggagtccgtgaagtccttcttctacggcctaaagaacatgctctcggggatattcggcaacgtcttcatggggatcttcctgttccttgccccattcatcctcctgatcctgttcttcatgttcggctggcgcatcctcttctgcttcaagtgctgccggcgcacccgcgggctgttcaagtaccggcacctgaaggacgatgaggagaccggctaccgccggatcatcgagaagctcaacaacaagaagggcaagaacaagctgctggacggggagcgcctcgccgacagacgcatcgccgagctgttcagcacgaagacccacatcggctga

SEQ ID NO: 15183 - RNA, 5067 nt, synthetic construct
  misc_feature 1..5067: note = derived and/or modified CDS sequence (opt11) from CCHFV(Turkey-Kelkit06)__GQ337054.1__GP
  source 1..5067: mol_type = other RNA
atgcccaccaacatcatgcacacaccgctggtttgcttcatactctatctgcagcttctctgcctgggcggggcccacggccagctaaacgccactgagcataacggaaccaataacaccaccgcgcccggcgctagccagtcccccaagcccccgatgagtacgaccccgccccacgcccccgagtccagcaccatcaagcccaccacgcccatctccgaggccgaagggagcggcgagaccacctccccgcccaacaccacgcagggcctcagctcccccgagaccaccagcgagagacccgccaccacgtccatcagcacctccagcaccgactccaccaaccccacgacccagatgaccgacaacacccccacgccgacagttagcacctcacccagctccagccccagcacccccagcacgccgcaggggatccaccaccccgcgcggagcctgctgtccgtgagctcccccaagaccgtgaccacccccacgccgaccagccccggcgagatgagcagcgagacctccagccagcactccgccatgagccgcatacccacaccccacaccgccacccgggtctccaccgagatcaccaaccaccgcaccccgcggcagagcgagtccagcgcccagcagacgaccccctcgcccatgacatcgccggcgcagtccatcctcctgatgagcgccgcccccaccgccgtgcaggacatccaccccagccccacgaaccgctccaaacggaacctggagaccgagatcatcctcacactgagccaagggctgaagaagtactatggcaagatcctcaagctgctgcacctcaccctggagcaggacacggaggggctgcttgagtggtgcaagggcaacctgggctccaactgcgacgacgacttcttccagaagcgcatcgaggagttcttcatgaccggggaatgctacttcaacgaggtgcttcagttcaagaccctcagcaccctgtccccgacggagcccagccacgctcggctgcccactgcggaacccttcaagtcctacttcgcaaagggcttcctcagcatcgactccgggtacttcagcgccaagtgctatccgcgctccagcgcgtccggcctgcagctgatcaatgtcacccagcaccccgcacggatcgcggagacccccggccccaagacgaccagcttaaaaaccatcaactgcatcaacctgcgcgcctccgtgtttaaggagcaccgcgaggtcgagatcaacgtcctgctcccgcagatcgcggttaacctgagcaactgccacgtggtcatcaactcccatgtgtgcgactacagcctggacaccgacgggcccgtgcgcctcccccggatttaccacgagggcactttcatccccgggacttacaagatagtcatcgacaagaaaaacaagctgaatgaccgctgcaccctcgttaccaattgcgtgatcaagggccgggaggtccgcaaggggcagagcgtgctccggcagtacaagacggaaatcaagatcggcaaggcctccaccggcttccgcaagctgctatcggaggagccgggggacgactgcatctcccgcacccaactcttgcgcaccgagacggccgagatccacgacgacaactacggcgggcccggcgacaagatcaccatctgcaacgggagcaccattgtggaccagcgcctgggctccgagctcggctgctacaccatcaacagagttaagagctttaagctgtgcaagaactccgcaacggggaagacctgcgaggtggacagcactcccgtgaagtgcagacaaggattctgcctgaagatcacccaagaggggcggggacacgtcaagctctcccgcgggagcgaggtggtcctggacgcctgcgactccagctgcgaagtgatgatccccaagggcacgggcgacatcctggtggactgttccggaggccagcagcatttcctgaaggacaacctcatcgacctggggtgcccgcacatccccctgctcggccggatggccatttacatctgccgcatgagcaaccacccccggaccaccatggctttcctgttctggttctccttcggctacgtcattacctgcatcttctgcaaggccctgttctacagcctgatcatcatcgggaccctgggcaagaagatcaagcagtaccgcgagctgaagccccagacgtgcaccatctgcgagaccgcgccggttaacgccatcgacgccgaaatgcacgacctcaactgctcctacaacatctgcccctactgcgccagccggctgacctccgacgggctggcgcgccacgtgacgcagtgtcccaagcggaaggagaaggtcgaggagacggagctctacctaaacctggagagaatcccgtggatcgtgcggaagctcctgcaggtcagcgagagcaccggcgtcgccctcaagaggtccagctggctcatcgtgcttcttgtgctcttaaccgtctccctgagccccgtacagtccgcccccgtggggcacggcaagacgatcgagatctaccagacccgggagggcttcgcctcgatctgccttttcatgctggggtccatcctgttcatcgtcagctgcctcgtgaagggtctggtcgacagtgtcagcgagtccttcttccccggcctgagcgtatgcaagacctgctccatcggcagcgtgaacgggtttgagatcgaatcccataagtgctactgcagcctcttctgctgcccgtactgccgccactgctcagcggaccgagaaatccatcagctgcacctgagcatctgcaagaaacgcaagacaggctccaatgtcatgctcgcagtgtgcaagaggatgtgcttccgcgccacgatcgaggccagccgtcgggccctgctgatcaggagcatcatcaacaccaccttcgtcatctgcatcctcaccctgacgatctgcgtggtgtccacctccgccgtggagatggagaacctgccggcgggcacctgggagcgggaggaggacctcaccaacttctgccaccaagagtgccaggtgacggaaaccgagtgcttgtgcccctacgaagccctggtgcttcgcaagcccctgttcctagactccatcgtgaaggggatgaagaacctccttaacagcacctccctggagaccagcctgtccatcgaggccccgtggggcgccattaatgtccagagcacgttcaagcccaccgtctccaccgccaacatcgcgctgagctggagcagcgtggtgcatcgggggaacaagatactggtgaccggccgcagtgagagcatcatgaaattggaggagcggacgggggtgtcctgggacctgggcgtcgaggacgcaagcgaatccaagctgctcacagtgagcatcatggacctgtcccagatgtacagccccgtgttcgaatacctgagcggcgaccgacaggtcgaggagtggcccaaggctacctgcactggggactgcccggagcgctgcggctgcacgtccagcacttgcctccacaaggagtggtcccactcgcgcaactggcgctgcaaccccacctggtgctggggcgttgggaccgggtgtacctgctgcggcgtggacgtcaaggacctgttcaccgaccacatgttcgtgaagtggaaggtggaatacatcaagaccgaggccatcgtctgcgtggcgctgacctcccaggagcgccagtgcagcctcatcgaggccggcacccggttcaacctggggcccgtgacgatcaccctgtccgagccccgcaacatccagcagaagctcccgcccgagatcatcaccctgcaccccaagatcgaagagggtttcttcgacctgatgcacgtccagaaggtgctcagcgcctccaccgtgtgcaaacttcagagctgcacgcacgggatccccggcgatctgcaggtataccacatcggcaacctcctaaagggggaccgcgtcaacggccacctgatccacaagatcgagtcccacttcaacaccagctggatgtcctgggacgggtgcgacctcgactactactgcaacatgggcgattggccgagctgcacctacactggggtcacgcagcacaaccacgccgccttcgtgaacctgctgaacatcgagaccgactacaccaagaccttccacttccacagtaaacgcgtgacggcccacggtgacacgccccagctcgacctgaaggcccggcccacctacggcgccgggggcatcaccgtcctggttgaggtggccgacatggagctccacaccaagaaggtcgagatcagcgggcttaagttcgcctccctggcgtgcactggctgctacgcctgcagctccggaatcagctgcaaagtgcgcatccacgtcgacgagcctgatgagctcaccgtccacgtgaagtccagcgacccggacgtggtggccgccagcacctccctgatggcccggaaacttgagttcggaacggacagcaccttcaaggctttctccgccatgcccaagaccagcctctgcttctacatcgtggagcgcgagtactgcaagtcctgcagcgaggatgacacccagaagtgcgtggacacgcggcttgagcaaccccagtccatcctgatcgagcacaagggcaccataatcgggaagcagaacgatacctgcaccgccaaggccagctgctggctcgagtccgttaagagcttcttctatggcctgaagaacatgctagggtccgttttcggcaacctattcatcgggatcttactgttcctggcgcccttcgtgctgctggtcctgttcttcatgttcggctggaaaatcctcttctgcttcaagtgctgccgccgcacgcggggcctgttcaagtaccgccacctcaaggacgacgaggagaccgggtatagacgcattatcgagcggctcaactccaagaagggcaagaaccgcctactggacggggaccggctcgccgaccgcaagatcgccgagttgttctccaccaagacccacatcggctga

SEQ ID NO: 15184 - RNA, 5103 nt, synthetic construct; identical to SEQ ID NO: 11898
  misc_feature 1..5103: note = derived and/or modified CDS sequence (opt11) from CCHFV(UCCR4416)__KY484026.1__GP
  source 1..5103: mol_type = other RNA

SEQ ID NO: 15185 - RNA, 5103 nt, synthetic construct
  misc_feature 1..5103: note = derived and/or modified CDS sequence (opt11) from CCHFV(ArD15786)__DQ211627.1__GP
  source 1..5103: mol_type = other RNA
atgttcttacacttcaagttcgtgctcctgaccaacttcttcttctgccagctgttatggggcgggggcggggtcacctcaggcgggggcacgaacaccagcagcacccaggccatcttaatctccagcaacactcccaactccacgatgagcgttctagagagttcaaccggcaccgccgcggagacagtaccgtccacgaccatcaacacccccgacacccaggtcacaactgacagcgggagcggcgagagttcgaccgacccccagacaacaaacggggaagtgccatcaaccagtatcgccaccatcaagacccaggagtctgagacgcgacggacccagaatctgagtaccacagccggcagcggggcctccactccgggtaacaccacaagcaacaagcccgacgtgaacctactgaccagccccatctccgaggctaagagctccccttcgccgtccaagacgtctacgccccagaccgcgcaccacctctctcgcagtctgttatcagccgccaccaccgagaccagccaagccgcgtcagtcatgaccacaacccgggagaccaccaccatgagctcacccacgaccgtgaaaaatagcgccaccgccacccccacccagggcatcacgacctccaacaccagcaagcagaccgacaccaccaccctcgagatcccgcccaagatccagaccacccagtcgcagcagaccgccacccccgcaatcacccccgcgacgacggcgatcgctttcatcagcccgaccaaccgctccaagcgggagagcaaggtacagataatccttactttcagccaaggcctgaagaagtactactccaagattttaaagttactgcatctcacgcaggaggaagactcagagggcctgcttgaatggtgcacccgcgtcctcgaacaggcctgcgacgatgactactttaacgagcggatcgaggagttcttcatcaccgggaagggctacttcaacgacgtgctgcagtttcgcctgtacgacaccttttccacgaccgagtctacccagaacacctctcccacggccaagcccttccggagctactacgccaaaggctccctcacttttgatagcgggtatttctccgccaagtgctacccccgagccagcaattccggcctgcagctgatcaacgtgacccagcatagcgtcaagatcgcgaacaccccaggccctaagatctccaaccctaagacgatcaactgcatcaacctcaaggtgagcaccgacaaggaccacagcaagctggagatcaacgtgctactcccacaggtagcagtgaacctgtccaactgccacgtacttatcgagtcccacgtttgcgattacagcctcaacaccgacggcaccatcaaactgccgaagatagcgcacaacggggcattcatccccggcacatacaagatcgtgattgacaagaagaataagttaaacgaccggtgcgctctcttcaccaactgtgtcatcaagggccgtgaagtccggcgcggacaaagcgccttacggcaatatcgcactgagatccgtatcggacaaactttcaccgggagtcgtcggctgctcgccgagggcgggagcaacgattgcgtatccaggacgcaattggtaaagaccgaagtaaccgagatccacgaggatagctacggcggccctggcgagaagatcacaatttgcaacggcagcacgatcgtggatcagcggctggggtcggagctcggctgctacaccatcaaccgcgtccgcacctacaaactctgcgaaaacagtgcgaccgagaaaagttgcgagatcgacagcgtgcccgtcaaatgcaagcagggtttctgcttgaagatcacgcaggaaggccgaggtcacgtcaagctcagccgaggaaccgagatcgtcctggatgtctgcgacaccagctgcgagcttatgatcccgaagggcaccggggacatcctcgtcgactgcagcggcggccagcagcacttcctgcaggacaacttgattgacctggggtgccccaacatccccctcctgggtcagacagccatatacgtatgccgtatgtctaaccatccaaaaactaccatggcctttttgttctggttcagcttcgggtacgtcatcacgtgcgtcgtgtgtaaggtgctgttctaccttctgatcgtcatcggcaccctcgggaagagactgaaacagtaccgggagctaaagccccaaacctgcatcgtctgcgaatccatcccagttaacgccattgacgctgagatgcacgacctcaactgcaactacaacatctgcccctactgcgccagccgcctgacctccgacggcttagtccggcatgtcacccagtgtcccaagaggaaagaaaaggtggaggagacggagttatacctgaacctggagcggatcccctggctcgtccgcaaactactccaagtgagcgaatccaccggggtcgcgctaaagcgaagctgctggatcatcactctgctgatcctcctgaccgtcagcatgtcccccgtacagagcgcacccgtggggcacaagcgagccgtggaggtgtaccagatccgggagtcctatactggcatctgcttattcgtgctcgggggcgtcctgttcgcggtgagctggcttgtgaaggcgttaattgattccatcgggaacagcttcttcccgggtctgtccatctgcaagacctgcagcatcggctccattaacgggttcgagatcgaaagccacaaatgctactgctccctgctctgctgcccctactgccgcgcgtgcagctccgataagataacccaccggatgcatttaaacgtatgtaagaagaggaaggtgggcagcaacgtaatgctggccgtctgcaagcggatgtgctttaaggcaaccatcgaggcgaacaacagagccacattcatccggaacatcatcaactccacatttgtgatatgcattctgattctggtgatctgcgtggtgtccacctccgccgttgacatggagaacctgcccgcaggtatttgggaaaaggaggaggacctcaccaacttctgtcaccaggagtgtcaagtcacggagacggagtgcctgtgcccctacgaggccctaatgcttagaaagccgctaagtctggactccatcgcgaaaggcatgaagtctctcctgaacagcaccagcctggagaccagcctgtccatagaggcgccctggggcgccatcaatgtgcagagcacctttaagccaaccatctccgccgcgaatatcgccctgagctggtcctctgtggaacacaagggaaacaagatcctggtctccggccgctccgagtccatcatgaagctcgaggaacggacggggatcagttggtgtcttggcgtggaggacgccagcgagagcaagaccctgaccgtgtcagtcatggacctcagccaaatgtattcccccgtgttcgagtacctgagcggggaccgccaggtggaggaatggcccaaggccacgtgtaccggcgactgccccgagcggtgcggttgcacttcctcaacctgtttacacaaggagtggccacactcgcgcaactggaggtgtaaccccacatggtgctggggcgtcggaacagggtgcacgtgctgcggcctcgacgtgaaggatctgttcaccgactacatgctggtgaaatggaaggtcgaatacatcaagacggaggccatcatatgcgtggagctcacctcccaagaacggcagtgcagcctgatcgaggcggggacccgtttcaacctgggtcctgtcaccatcacgctatccgagccccgaaacgtgcagcagcggctgccgcccgagatcatcaccctgcaccccaagatcgaggagggattctttgacctgatgcacgtgcagaaggtcatgagcgcctccaccgtgtgtaagctgcagagttgtacccacggggtgcccggcgacctgcaggtctaccacgtggggaacctcctgaagggcgacaaggtgaacgggcactccatccataaaatcgagagccatctgaacacttcctggatgagctgggacggctgcgacttagactacttctgcaacatgggggactggccctcctgcacctataccggggtcacgcagcacaatcgcgccgccttcatcaacatgctgaacatcgaaacggactacaccaagaccttccacttccacagcaaaagagtgacggcccatggggacactccccagttggacctaaaggcgcgccccacgtacggggctggcgagatcaccgttctggttgaggtagccgatctggagttacataccaagaagatcgaggtgtccgggctgaaattcgccagcttaacgtgcagtgggtgctacgcctgtagctccgggatcagctgcaaagtccgcatacatgtgaacgagcccgacgagtttacagttcacgtgaaatccaacgacccggacgtagtggcggccgggagcagcttaatggcccgaaagatagagtccggcgccgatagcaccttcaaggctttctcgtctatgccgaagaacagtctgtgcttctacatcgtcgaacgcgactactgcagctcgtgcacggatgacgacacgcagaagtgcgttgacatcaagctggagcatccgcaaagcattttaatcgagcataaaggcactatcataggcaagcagaatgacacatgccccaccaaaacctcctgctggctggagagcatcaagtccttcttctacgggctgaagaacatgctcagcggcattttcggcaacatcttcctgggtatgctgctgttcctggcccccttcgtgttactcatcctgtttttcttcttcggctggcgcctcttgttttgcctgaagtgctgccggcgtacccggaagctgttaaaatacaaacacctccgcgacgaagaggaatccgggtacaagaagatcatagagcggctaaacgacaagaagggcaagagtcgcctgttcgacggcgagcgtctcgcagaccgaaagatagctgagttgttctccaccaagacccatgtcgggtga
